United States Patent 10,240,205 (METHODS FOR ASSESSING RISK OF DEVELOPING A VIRAL DISEASE USING A GENETIC TEST) - sequence listing, part 5

SEQ ID NO: 166 - DNA, 1628081 bp, Homo sapiens
agtagaatttgtatataactcaacaccaataaaattatatttgacgagactagattccctatgttctacattccactgaactattcttgttgtctctattttactatttacgtaggtacatgccttacgtgtagtactaattcattattccaacaataactcagcagtaagtggtgagaagaacgtgattttattttgaaatttatttttatcgaggtaaaatatacatatgtaacgtaccttccttaccacctgtaagtgtgcagttcagtggtaataaatacatttatagtcttttatttacccttcatcccccccttccccttctggcctctggtaaccatcactatagtcactatcttcatgagaaccacttttttagctcccataaatgagtgaaaatatgcaatatttgtctttctgtgcctggtttatttcatttaacataatgacatccagttccatccatgttgctgcaaatgacaggatgtcattcttcttatggctggataatattccattgtgtacatataccatattttctttatccatttatccattgatgggcacttaggctaaatccatattttggctattgtgacttatgctgcagtacacatgagcatgcagatatatctctttgatgtacaggtttatttatttatttatttctctgtttctttccctagcagtggaatacttggatcatatagtagttctacttttaggattttgaggaactccataatcttctccatagtggctgtagtaatttacataatttgaggaactgtgagaatattttccaaagccaccataccattttgcatacccaccagcagtgtatgagcattctgatttctccacatcctctccatctcttgttattatctgattttttcctctagccatctttgtgggtgtgaagaggtatctcattgtagatgacaaattattcagaggttaacactcgtttatgtgttgaagcatttggtcaaggctgagtattcatgaggccagtgaaataaatccatccagtgagaaaagagtgtttgcaaacagacaagaaaacaagatgtgtccagacattcccaaccacatttcgaactcttcaccttggccaagtatctcataatgcatcgttgtctcacatagccttattggaagacagcatggatgatcctttgtaaacttattgacattgttatgattccaagttcatacgccaccatgtttggttagcaggagcaattccatccgggaaagagagaatattttgtttgttttgcttatgttttaaccatctgttgagagacagaattatccttcacctctttggcagtgtctagttgatgaaaaaatcctcatagttctgttttctaaattgaatttgtgttacaaaatgattcagactgagaatgagaattttgggagtatccaggcaattcagcattccaattaatttgggatataggtcatggccaccgccatgaaatatgtgcgtttgtcaaagatgttaagactctactactcaaggctttcacctgaccaatatctcacctcccctaatacagctcccatcaagaggcaagcttgaattccagatattaattatttttctcatcctttccctgtgatttgggctgttaatatagaaaatgttattgatgataggatgatgatgatgatgatgatgatgacagagtttgtcagagcattgagcacttctcagcaggcttcaatacttgagcatcagggattttacttcggagatagcagtgatgttgaataatttcattagtgcctgactcaccaggacaaccactgtctcttgcctacccactatccatatctccttctttttttcaataaacagacctcaagctcgctcagaaaagtaataagactgattaaacccatcaatgcccctggattcccttgctgccttgggtggctgagactacaaactctttgatataaaaagacaaagatttatttgcaaaaccttcactcctttgctctttctccttttttctggactagggatcttgaagcatggagttgttgcactatcttgtaaccataaagcctgaggacgaaagcctggagcctagggatgtggttgcttcatccttaggaaaggaggggatgagcctagctacctaaggttatcactgagccatcacaccagctcacggctcagcactgaagctggaataatgttgcttttctgttatctgaatccgagtggaattctgtctgatatgctctgtcagctgcagggatctgaggattgttttacaactcagtacattgaaatatcccacatttgtctctgtgatattcggaaatcaagaccactttgaagagatgtgaaatgaagatggaatggaaaatggaatggaattcaactattgaagtggtcttcatgatgactccagacttctaacataaggtgccaggtaggtagtagactccttatcaagctagagaaactgggaatggtgaaacataataataagatgaaattaaaggattcacatttggacataatgagttgtgagacacatacttgcagaaatcaaggaggaagtgggagctcagaaaatggatctgagaaggagaagtcaatgcatacctcatcagcaaggtgatgaggaacagttgagattatccatggagactctgtggagggagctgagagtacccaccacacaccctcagcaagtccagcacttagaaactgattagagcaggaccctgtagaaaggaggataaggagaacactgagaggtagaaggaaaaccagaagaatgtgaagttaccaactccaagagagaagcattctaggaagggatcccatttagctcccatcaaatcatgcttaaacggacttaaaagaagatgcagcatagtatctattggatttgccaagatgaaatttataacattatacaaatagctctgaggatgatgccaagtagaaaaggctgaatagaaaatggtttcaaacatagcatgattatttaaatagaaatatatatgtatatttgtgttactggactctgagactaatatacaccttctcttggacataattggcttccaaaggctgacagagttactgttaggtggagagatctggagtgattcttatcttctttttaatatatgctataattttttgttcattttatacattttcaatcatttcttgattaattatatgaagtgacaaaaatagccaaattatgtggagtccattcatgtcttcatttaaactaatcctgtttttattggcaggcaatacacacaatttgggaaatggtcaattaactaatgtgttcatatcagtcacagtatttcttcttctttttttttattatagacagggtctaactatattgctgatatggtttgtctgtgtctccagccaaatctcatcttgacttatagctcccataatccccacaggtcatgggagggacccagtgggaggtaattgaatcatgggggcaggtttttcccatgccgttcttgtggtagtgaataagtctcatgagagctgatggttttataaacgggagttcccctgcacatgctctcttgcctgctgtcatataagatgtgcctttgctcctcctttgccttccaccatgattgtgaggcctctccagccatgtgaaactgtgagtccattaaacctctttttcttgataaattacccagtctctggtatttctttatagcagtatgaaaacggactaatacaattgctcaggctggtctctaactcctgggctcaagtaatcctcccacctcgttcccccaaagtgctggtattgcagccatgagccacaatgctcagtcagtcacagaatttctgaaaggattgagcttctctttttgccttgtcctgacattcctagattattgtctagacaaaaattatttccttttgaaccgagtttactataataaataatgctatgtcaaaaaaccatgggtagctttaaactcctttagattaatagattgttataattcctctcttttccatctcaaaaacctgcctcataacaaatgctccttttgcagaaatattaacagagcatttatttaatttttcatcaaagaataacagcaaaacaagaaggacaaatatgcatgtatgcgttggtatcccagaagacaatatacacataatgtataggaaataatcacaacatcaaattgacaaaactatgcatctttagtgacttcattattttaagttcatggagacccatctgtggtcgatgaggcaaaactgacagctgcctgttcttgtaaataaagttttattgaaactctgccacatttattaatttacatattgtctgtggctgtttttttgctacaaaggcagagatgagtagttgtaaaagagaccatattgtcttcaaagcctaaaatacttcctgtctggtcctttacaggaaaaggttgcagaactctgatttagagcatctactatgtgcaactaacagaaaaagaaaccttttcacgtggttaaaactcagagcaataacaaaattatcaaaaatactggaagaggtttccagaagatagagagatgatttccagctgggtaactgcagaggttaacaggagaagaaggtaaatgaggcttctttctcaaggcaaggatgtgaagcaaacatagctggagaacttggtccttttccactgggctgatgtttcctgaagactgtcccactttcttgatgagagctcctgagggtatgctcatctttgactaaccaaatgtataccagtccactcaaggttctaagaaggtctgcataaataaatgcagaatttctcaaatgcgtaataagtcatgaaataccttctcgggaatgattttgtaactatgcagaatgaggtaatgttttgggagcaggagtgcaatattctgggagagctagacttgggagaaattctgtatagccaggaaatgaggtactagatggatggttgaatttggccaaaaatagtcagaaagctttgctgctcatttgcttgttgtagtttgataactaacaacccagaagttttgggagcctttgcacaagtatgatattgaccgaggtagcaataacctaaatacaaattaaaataattcttagtccacttagaacagctggactaatgatactggctacatgacccacttaaaactgataatatttacttcttaaaatgtgtccaacagtatttgaatacatgcattgaaggaacatataatagcagtttctatagctggcaagaagctgaatcagaaaaacttgaccatgcactgcacaaatttccctgcctctcttctctccagttgctaccctgccttaaattctaccgaaagaagttaaagctcgctttgtttttgaatagatcttaaacatgatgattattgacctcatacccaaagccaattatactgaacaaaatcgagataggctcattcaaccaagaacaaaacaaagatccccatatagatatgattattggaaattctgcacaataaactaagatttggagtagaaatgaaaggtccaaatattggaaatgacaaggaaaaattagatttatttgcagattctccgaatgtctgctgtaaaagcatgatgatctattattagatggttgagcaaattgatttgttctaaagtatttcaatatcttttgtatatgccagatataagtaataagaaaaaaatgtttaagcagtcttgaaataataaaatacagagtgtaaaatacattgagatatactctgtaggggacaagtttccatcagcccatatatatgtgtgtgtgtacatgtgtgtatatatatgtgtgtatatttatatgtgtgtgtgtatatatatacatatggacatatgggctaaacttctgccttaaaacaagcaatgtgcctttattttattttatttttaaattaaattaaattttaagttctgggatacatgtgcaggatgtgcaggtttgtttcataggtaaacgtgtgtcatggtggtttgctgcacctgtcaacccatcaaccaggtattaagccccacatgcattagctatttatcctgattttctccctccccccattcccctgacaggccccagtgtgtgttgttctcctccacatgtccatgtgttctcattgttcaactcccgcttctaattgaaaacatgcagtgtttggttttctgttcctgtcttagatggcagaggataatggcttccagctccatccatgtccctgcaaaggacatgatctcatttctttttatggctgcatagtattctatggtgtatatgtaccacattttctttatccagtctatcattgatgagcatttgggttgaatccgtgtctttgctattatgaatagtgctgcaatgaatatacacatgcatgcatctttgtaatagaatgatttatattcctttggttacatacccagtaatgagattgctgggtcaaatggtatttctggttgtaggtctttgaggaatcaccatgctgtcttccaaaacggttgaactaatttacattcccaccaacagtgtaaaagggttcctgtttctccacagcctcaccagcatctgtcattccttgaccttttaataattgccattctgactggcattagatggtatctcattgtagttttgatttgcatttctataacaatcagtgatgttgagcattttttcatgttttttggccgcataaatgtcttcttttgagaagtgtctgttcatgtcttttgcccacattttaatggggttgtttgatttttttctggtaaatttgtttaagttccttgtagattctggatattagacctttgtcagatgaatagattgcaaaatttttctcccattctgtaggttaccttgtttactctggtgataatttcctttgctgtgcagaagctttttagtttaattacatccaatttatccatttttgcttttgttgcaattgcttttgaggttttcatcataaaatctttgcctgtgcctacatcttgaatggtattgcctacattttcttctaaggtttttatagttttggtttttatatttaggtctttaatccatcatgagttaatttttctataaggtgtaaggaaggggtccagtttcaatcttctgtatatggctggccagttttctcagcaccatttgtttgtttttgtcaggtggttgaagatcacttggttgtagatgtgcagtcttatttctgagatctctattctgttccattggtctatgtgtctgtttttgtaccagtaccatgctgttttggttactgtagccttgtagtatagtttgaagttgggtagagtgatgcctccagctttgttctttttgcttagcattgtcttgtgtatatgggctcttttttggtttcatatgaatttttaagtagtgttttctaattctgtgaagaatgtcagtggtagtttaatgggaatagttttgaatatataaattactttggccgtatgaccatttacatgatattgattctttctatccacaagcatgaaatgattgtgtcctctctgatttccttgagcagtggcttgtagttctccttgaagaggtccttcccttgttagctgtatttataggtattttattctcttcatagcattgcaaatgggaattcattcatgatttggctctctgcctgtctattgttggtgtataggaatgctactgatctttgcacatggattttatatgctgagactttgctgaagttgcttatcagcttaagaagctttggggctgagacgacggagttttctagatataggatcatgtcatctgcaaacagaggcaatttgactccctctcttcctatttgaataccctttatttctttttcttgcctgattgccccagccagaactttcaatactgtgttgaataagagtgatgagagagggcatccttgtgtattacattaatggccacccttcatgtcatctgctccgctgagtctacaggccaggtaaaaaaatttttttttcaaatagccatggggaaccaataaatgttttatgcaggaaaatgacatgatccaatttttgttttagaaaattctataaactctgactacagagactagaacacattgtaggtgatacatcctagagccagaggggccaaagagaaggaagtgtttgctgtaaaggagaaaaaaaagttttaaaactgtatatcctaactctgaaaaatgaggacataggtttttacttaaatctctctgatgtcctaggagccttaaaaagtttaagaagcatctaggatagctatggactcctgagaaaagttctttctctatgatcctcatatatggaaatatatgtttccttctgcaggttcctggcggaggttctgtgtcagtctagggcatgtctgcatgactcccacttgcttctggcttctgggagtcatgcagacatgccctagactgtcataaagcctccctcattttgagttctgcaattcctgctcttgcaatctgtgctcagctcagaggccagggtatttctctaaaaacataaaccatagcatgctctctgctgctaagcctgttgatgtctgaccaggttgttgcccactcactgcctggataaagctgaacactgagacagagatgttgccgtaaagtaagagtttaattattgcaaggcaaccgagcaaagagaacaggagatatttctcaaagccacctcctcaaaacttcagaggctagggcttttaaagttgatttggcaggcagggggactagtggcaggtgctgctgattgatctgggatgaaatcataggcgtgttgaaactgtcttcatgtactgaatcagttcctggaaagagagggagtcacaacaccagacaagtcagttcattggttggggtgacaggccactagtctggttgctgtcagttggcccactcgcgagccaggtctgaaaaatatcccaaagaccagttttaggttttacaataccttttgtgactgccagttactatggaaagcaagctgggaagcagtggtaggttatcgtttactatgcctggagtatagcagaaaagttttcaggaggtgatatttccagtaatcaaagctgcctggcaccccccttggcaagctcaacttctggaagccattgagggggtctgcatgatctaaggatccctgttttttaaaagaaaaaacaagttcattaatcttgcgggcagcctgcctaggggctaggacaggaagataatcaattattagtgattaccacttactgaaatgactataaacaaacaatcatgcatggaggaggaaaacatcagagagaaaggaaaatatcttactgaaattcaggcccctaccataattttaattttgtggccttttaaaattctatgaaggcagtttcatacctctgcaacaatgtacagctgcatttgaaatgcactgggaacacttggccctggtttatgcaactccatcttatcctctgcaccatcattgtccactctaaaaggagacttcagaaagttcatggaaatattgtgttatgaacaaactatgcatggatttcaaatttttgttccaccaagataaactcatactagcttgttataacatgggtcgagtttgaggcacgaagaaggattagacatcagtttgaaaagagcccctatcagagcaatatgaatttcactacaatggaagcaagaacaaacatcaaatttatgatgagccttgggtggaagaagggtgaaatcatggatgctttatgaaagttttatcaggaaaatgctcccaaagaaatcagcaatttacaaatggataactcattttaagaagggataagataatgttgaagataaagcttgcatggaagaccatccacgtcaatttgaaaggaaaaactaatcttgtttgtgccctaattgaaaaggactgatgattaaaagcagaaacaatagccaacaccataaacatctcaactggctcagcttacacaattctgactgaaaaattaaagttgagcaaactttccagaagatgggtgccaaaattgttgcacctggatccactgaagacaagagcaaagctttctatggaaattttaaacaagtgacattaagattttgaagcatttctctgaagaaccattaaaggagagaaaacatagctttaccagtaccatcctcaaggaaaagcacaatcagagcaatgattaccaagaggtggaaggggttctgccaaagcaaaagtggatggatcaaaaacaaagatcatggcaacagttttttggaatgatcaaggcgttttacttgttgactttttggattgacaaagaacaacaacatctgcttattatgagagtgttttgaaaaaattagctaaagctttagtggaaaattgtccaagaaagcttcaccagagaatccttctccaccactacaatgcttctactcattcctctcattaaacaagggccattctgcaagaatttcaataggaaatcattaggcatccatcttaaagtcctgatttggctctttttgactgctttttgtttcctaatcttaaaaaaaaattaaagggcacttttatttttttaacccatttaaagggcacccatttttctttagttaataatgtagaaaagatggcattgagacggttaacttcccaggagtctgagttctttaggaatggactaaaatggctggtattatcacttacagaacttgaacttgatggagattaagttgagaaatatagtttatattttttacatttttatcttttaattccatttgtccacgaactttttgaagtcccctcatgtctaacggcagaggaattctttatatgcattcaatagaataagccacttcccactgccaggccctttccctggctgtacctttcatcaggagagagaaatctcttgcctaattccagccctgatctcgcatatgatcagacttggacatggaatatttatcaggtgctgtctcttctggttttcctctagccaagtctcaaatctccccactaccagggtccagaactatttttcttttctatgtctcattcaaaagagtgttctttgtttattttttccattgctaccttcaaaatggatacacctactgtgtgagtaacacctactgtgtgagtaaacagtagcaaagaagagatcctctttcacactgaaagtgcaactaagaaaagacatcctcataattacaaaataagcgactgaaggataagctagacaatttctcacacagcttctccatgtgggctcccaaaaagaaattgttgataaaatcctgctaacttcccacttctactttttaactcaatctccaaatgtagttcatgatatgattcaggaaaggggagggcttatgtatgcaagcattgctcacaatctctcatttttatattctcggtggctgttttgttttgttttgagacggattctcaccctgtcgcccaggctggagtgcagtggcgtgatctcagctcactgcaacatctgcctcccgggttcaagcgattctcctgccttagcctcccaagtagctgggactaaaggcgtgcgccacgccaattgtagtggtggagaaggattctctggtgaagctttcttgggcatttttctgctaaagctttagctaatttagactggataatttttgtattttttggtagagatggggttttaccatgttggccaagctggtctcaaattactggcctcgggtgatccacctgcctcagccttccaaagtgctgggattacaggtgtgagccaccgcacccagcctcggtggctgttttgaatacacagatccatatgagtcttttagcatgaactatgcaaaagcaatatgccatcgtctcttccatttacctataagtcaaaagataatacagttctatgttcttagtgtcactcacaaatgacatctctggcatcctgtgtgtctgttgggcttctatagatcatgacagacagcagagatagaaaatcaacattcaagtcccactttcccttccaataggagcaccatttcctctctatgtagcctgtattcacagaatatctgcttgtaaagcctgcctgttccatatcccccatgaggcagagcatacagtctagtcatttctgtcatttgtccttgtaatgggttgaatagtatctccatgcagacatgtccacccagaacctgtggatggaaccttgtttggaaaaggggtctttacagatgtaattgagttaaggactttgagatgaggtcattctggattagggtaagccctcagtgtcatgagtttataagagaagagaagacacacagaggggaagccacgtggtgatgaaggcagagactggagtgatgaggccacaagcccagggacacctggagtcaccaggagctggaatcggcaggaaagattctttccctagagcctccagaggaagcatggccttctccacaccttgatctctgactttttttctccagaagcaggagaataaatatctgttgtttaagccacacagcctttggtaaattgttctggcatccctaggaaatgaatactgtcctgtagtataattatgaattttactcaatagctcatctctttaatgaacacttacattttgactttgtgttccaattattgaataaaagacttggtaatcaaatagaggatgtaaattcagatactgtcctgcaggtgagggagattctgtttagaggagtgagccacttgaaattccactgcttaggtgaggtaacgagccgcccagacagctctcccagacccctgggttaataagcacacattaaagatgaactataggcatgcctcagctaacacaggccttccatgaatgagtagactgtataggtgcctccgatattggtgggtaggtaggtgttcctagtgtattttcaaacagataaagaagagtttaaaaattaattttaataaagggagaaataacttgtaatggtaaattctaagaagacattatgtctgtgacgggcacatcagaagatgcctacattgattttcttaacttgattctcttacaagctagaattaaagtatcctaaagtgccaagatgaggatagttaaactatgaagttttgagaaggtgagtatctgtaatggagctaatcattaggaatcagaccaaaataaagaatcatttgattacacattttttttagataaattatgagaaacaagtgttagagaagaggttctcaaagcagtgtccacattagcagaaacaggctcatctgggacctgcttataaatgcacattctcaggtcccaccccagtcagacttgctaaatcaaacgctccagagtgaggcccagaaatctgcatttcgacaagtcctcccagagatgcagatgcaaaacttctgctagaatatggctaacacgaaaccgtttactctactagctctatgagtagtttcatagagaatgtgacaattgtatagaaagaatatagtttttactactttggagaaccgaacatgtaaccttttaatggtttcttaacgagactggctattgggaaatctgcattttattattaaaccttagtgataacaggttttcagctaataaattacatctggacaaaacctggctgcggaaaatggctgcaggagagcccatttttgatcacgcccctggggaaaacctggaatcagtgctgagttttcccttcctgaagcagttggtaacagcctcgtccctaaattggctgctcaagctgctctccaggaaaagttaatatgttcccagaggatgaaatcaaccttcagttggagccccaccctgggagatgcaaagccatgcgtctctgtgggatacacaggtgacctggagaaggggtgcgggtgaactccagagaaaaactgaaaagtttactctcccgtctctcttgatttccagaaaagagtgagaccagtaggctccgtgtccccattttccaaagcttatttagatttcaaaaccgctttgcagacccagccgtatgtgttgcataaagcctgttgagtttattactgatgacagtcctagctctagtaaaaaagaatgcaacacgaaattaaatcatctcctcgataatgacaggattgcaatcagagaataaaatttgttttctcatctggttatacccaaaaggctacattcagatgagccatctttccattttgaagaagtgaaaatcgtatagaatatttgtgtgagtgtgttgagggagtgctttgacacaggagaatcatagagcagcaggaaagtggatgtgaaagttagtcttcccagtaaagtgagagtgaagggaagatacactagaaacaggatatttcaaggtaattgaaacgcaaaagtgaatccttttttttttacttaattatgatagaagacaaaataaagagaatcttagaaatcttgaatattcacatcagtttaagtaagtaataaaaactgtatttactgtattacagaaaactgtaaataacatagaaatagcatttgctctctctgtctctgtctctctctctctatgcctgcctctctgtttctttctgtgtctctgtctctctctctttctttcacacacacctctccatttaagatagatagatagacagatatagatatagatagatagatagatagatagatagatagatagatatagatatagataaggtaacaggtagtattgctctgagtgggatatttacaatgtggtacacgtgattttgactgtgtttgacattcttattgtgaaaaaggatataacttggaaataaattacgtttatgcatccatacacactcttcaaacaggcaattggattgaaagtatgccagtgagactaaaaatcatacaactccgtgtaatgtggaaggtgaaggagcattttagaatgcatgttaaaacacaataaacataaggatagattctgtgatagaacagaatgcctgaattcctatcccaggatgtgatttcaaggcacaacgagataaaatgcctggagagagagaataacgacgactttagacactgaggcaattcccagggtaagttcacagtgacacactgctcctggaccttgagcaaatgagcaatggtcggttgggctcaggggacttctggggtggactagccctggctcggggtcagaagaagcttgacacagcctttgtccaagccgtacatctatcgatctaggaacagcaaaagtgcactcagtgggatttaggactttccccaaatcgttagagacacagagctccatcggtcatctgtggattctctcagttcccatgtcttgtcttgaggtttttgttggtttgggatttcattcctgctttgtccaataattcccccagattctgctgggatcacccagtactctctcagcatccacctttgtccctattgattgatacctgtaacctcttgctgtctgattttcccaccaatcccccagtgcacatccacaccacccctttgaatctactttttttctccaaggttaccagtgacctcagaaaaagcagtcagatcccgttaactcctgttagtccattattgacattacagtatttgactctgttcacgtgcatctcagtttcaaggcatggctctgtggctttgagtctgtttgccttcttcattgacttctgtttcaacaacacttcttataagtcagaatttcccaaagctatgcctgagttcagcctgtgcctccaaactctgctttctatgggctcctaaccatccctatagcttccaccatgagttctctgctgctaagtccctaatctgtgattctctgctctcatttctaaatgccaaacacctacacccggaactcagcacttctaaaattaaattcgtgattgcctactctcttcttgcagtcttgattgtttatttgtgttctctaatttaataataaaaccatggaatactacgcagccataaaaaataatgaaatcatgtcctttgatgcaatatggatgcagctggaggccattgtcctaagtgaactaatgcagaaacagaaaaccaaatacaagttttcacttacaaacaagagctaaacatgaggtactcatggacataaagatgagaacaatagatactggggactcctagaacggggagagagggaggtgcaagggttgaaaaactacctactggggactctacttactacctggctgacgggtttaaccatacacaaaacctcaggatgatgcaatatactcatgtaacaaacctggatttaaaataaaagttgaaaaatgtaaaaaaaaaaaaaaaaaaaaaaaaaaaagggccgggcatgatggctcacacctgtaatcccagcactttgggaggccaaggtgggcagatcacctgaggtcaggagctcaagaccagcctggccaacatggcaaaaccccatctctactaaaaatacaaaaagtagccaggcgtggtggcgcatgcctgtaatcccagctaatcaggaggttgaggcaggagaatcgcttgaacccggaaggcagaggttgcagtgagccaagatcgtgccattgcactccagcctgggcaacaagagtgaaactctgtctcaagaaaacaaacagacaaacaaacaaaaaccaccttccttgcctgcagactcaacatttcgctttgttttatcatggtctccttcccatccacccactcagcaatacaattggttgtcaaaatctattatttacagctttcaaacgtctcttctgaattcttctctcgatttttccttgcattcatcaagcacttgcccaccccgttgtatttgcacctccctgatttttctctagtttctcacttcttccatctcattgttttctttaaaccacaatcagcccagccctattaaatatctttgaaagaaactacatttttcttagtattagtcgcatttctcagtcaacatttgaattgttatcttttttggggaccaggttatacatctgcctcacttacctgacacctatttgaagtctaagatgatttcttgttcatccagaagcttctgcacattcagcaccctgtcacctgccaagagttgcaatgcacccaaaatcaggttgcctctctgtttggtaaggggatttttcaatgtgcttcaagctgaacatcatatatattatctcattcagctcacaacaattctgtaaagtattgattatgcctccagtatatatgaggaaaaggaagatcacagtgattaagcaattttgcttaactggttagtaaaagaattaaatatttattgtgtggcttggaaaccatcatttttctcccaagacaccacactacctctcagtaagaatatgtcaataattaatgctggatagatctctccggttctatcacaaatgggaccaaaatatatgacccctattcttcacttttcttcttatgtgaccaaagaagtctgtccacacaatatctaggacacaccatggaaaaaaaaaaggattaaatcaaaattctttttgtgtaatggtgggaggttgaatccacagtccccaaagttgttcacatcctaatcccagaagctatgaaaatgtcactgtacctggaaaaaaggaaatgagtaaggatcttaaaatggggagatcatcttgggctagccaggtaggtctttataagagagaggtaggagggtcagagttagagacagagacgtgaggatagaaagagatgtcagagtgatgcggggccatgagccaaggaatgcaggcgggctgtgggagatgggataggtaaggcagcagactttctttcagagccttcagaacaaatgcagccctggtgacctattttggacttctgacctatagaactgtaagacaactgtgatggtaaatattgagtgttaatttgattggattgattgaagaatgcaaagtattcttcctggtgtgtctctgagggtgttgccaaaggcgagtaacatttgagtcagtggactggaaaaggcagactcactctcaactggttgggcaccatctaatcagctatcagcatggccagaataaatgcaggcagaagaacatggaaagacagactaatttagtcttctggcctccatctttctcccgtgctggatgctccctgccggtgaacatcagactccaagttcttcagctttgggacttgaactggtttccttgctcctcagcttgcagacgccccattgtgggacctcactatgtgatcatgtgagtcaatactccttaataaacttccctttatatatacatctatcctatcagttctgtccctctagagaatcctgactaatacaacaacatacgtctatattgttttaagccactggatttgtggtaacttgttgtgacaaccataggacactaagacagccattgagattaaataaatttatgaaggatgaaaaattaatgagcacagataaaagactcttccatgcaggagcagggaacatggaaaaatactccccttcgtattttttctctttattttttaaacaaattctctccttgcatgcaagaaagaatcatagaggcatggtctgaacaaaagggaatggatgcattggcttccccgacttaattggggttgagggataaattttaggattcccagtgaagtttgaatttttgttgaacaacaagtgattttttaaagtgtgtgtattctgcagagacttacctcattggtatatgtgacacaggagttaagaagaaatcacttaggcagatagtaagggtatgggagtcctcagtaaggctttcctttttaatgaaaagcagccccaaatcgttttctaggaaagagcagcctgtaaagtcgagctgcagacatagacaagcaagctgggagcttccacgagtgaatgctggcaggaacttaagactagacatgttcaagatggcagctccatcttcccttttctgtcagccacatgtactataaggagcagacaagatggcactgatcaactggaaagcccatttgcataataagattagggtggggcaaccagtctccccccgaacccacacactatgtaaatgtcatacctgatcgaaccgatctgttaagccctatgtaaatcagacactgcctcctcaaacctgtctataaaatctggcgcattctctgccagccggtcctttctgcttggagacccctttctctacagagagagctgtttctctttctcttctcttctgtctgttaaacctccatcctaaactcctcatgtgtgtccgtgttctaaattttcctggcatgcgatgacgcatctcagggtatataccccaggaaacatagccacttcatatggacaccattattttaaaaaatagattgcagagtccctaatggaaatagatgaagacacagctgaaaagagtagatgtttagtgcatgtattcctcacggcaagtggttttgaagcgcggctcagagagccatggttcttgggctgaaattgaacccgactattgatttatatatgagaattattcccaaaacagagttagattgcatttatacactcatcccctcttccttcaaccaaattattgattttcatagattaagtgggcttcttattcttgtgactcttcacctcttgaattctgtatgcatttttaagcaaaatgcagacattttatctactcttctatgcaaatatttactggctaaaatttttaaaaagcagcagcctccagaagacagcacaatgagttatcatcagtcacaattacccactcaaaagtggtgggatatggaagtcaggctccaggacatgccttgataccaagaagagtggttcattgtagaaaaaaaagtctgtcagtgaaacaccttacatgtaattcacagataaagatcataggttttaaaatggcaagtccagagagttgtgccacctatcttttttgataagtgattctgataaggtttccctaagaagtgaacacctctaggtatttagagctcattttggcaaatgatttgtttttctaaaaaatacagaataagtgtaagtttagctaatgcaagtttagcatttatgcaagtttagaatttttaattgggttcaatatctgcttttgctgccaaacttctgaacagtaataacaggtagtaacaagatgttcaagatgttatccaaataaatgagaactggcagtaggggaaaaaagaagagtttagtgtacacacgcacatatatatacatatatgcacatatacatatatacacatgtacatacacactatcatacaacatactgtcaacctaaaatcatcaaaaggctcagaatccagtataaaagagtttattcagttgcaaagctaagaacagccattcaggtaacacagattctgaagaaatgggatcattgcttctaaacgggaacgctaaggtcttgcttatatggggagaaaacaaaaaaaaattgaacaggattacaatagtttttctacaaggctagtttatgagtttcagcaatttgattaattacagctgttttattttccttttccaattaaaaaatatatttaatatttcatcttagacaatgtggtaattgtgaggtctttctgtatgagaagtaagagagaagttaatccataatgaaaatcaacagtgcagtgggaaagggatcttccctggtgccctttagcctttcacaacattttacaaaacaatgtaggtaaagcaaaggctatttcataatcagcggaacaaatgttgcagctgcgtaggttacagctgtctgtcaggttactcagttctcataattacattcctttacgtctaaaacaaaattaaagttccaacagctttaattttgagttccttatttttataatacttatactaaagagttttttgttgtttatctaaaatttgaatatagctggtcgtcctgtatcatttactagttctgacaactctaaatggaaagttcagagtttgggcatactttggagaaacttcatctagcaactcctttatgaaccaagcacttgttttttctcctcacactggcctgcctgttgtctcattcatcttaaagttgactccattgatggcctaaggtcacttccaatttcactgcttcttgattcacgtccagaaaagaggcatgagttcacttaccccaacattcccggccaatcagagagctcagggggagataatgttatgatacaatttatctacattgcctatactcaacctggaaatccagggccatggtgatcttcttcagaaccatgtagcaaccaaaatatttaggaaagcaggagaagccatgagcagatgccccctacactatgcacaaaaccttgagagtgagaggtaagaagaccttgagcatggatgaagtctcactatagggctgtttgctaagcttggaaccttcagctttggggagtgtacttttgagcgtggatgctatctccagtttcctatatgcttggacttcaataattcttatgactagaacacatctgtttattattttatcgtttgatgctgggaattttgtgtttattctgtgtattaaggagagagtcaaagggttaagagtcaaagggttaaaagtcaaagggttaagttaaggtttcctctagtgcaggagttggcagatgtttggaggaaagagccagataatgtgttcagctttctggaccccacagtctctgctgcagctactcaaccttgctgtcatatggagaaggcagctacaggcaatatgaaaatgaatgaatatggtagttttcccatttatgcacactgaaatttggatatcgtataatttttattgtcatgaaacataagcctccttttgattcttttcccagtcatttaaaaaacatgaaaatgtattcttagccaatgggccctaaatgaacagatggccagacagatttggcccactagccattgtttaattgctcttcctccatggtggtagatcccttatcttggccgcacatcagaatcaccatcccaggtaaatctaattatacttcttgtgattgagatccctgaatcactagttctagagggaccatcgttgtaggcaacttaattcactcaagtggtaacagggtagagttcagggcagaagatctactcgagcatcactgaccttctgctgcatcacttacgctgcaaatctggagaaacagccctgggttaaaaaaggtgaagagcttcaagacttataaaaggctttttagaataaggagagtgtgaagggcaaatgcacacaaatgaggagtccagtaatagaaagcacgtcaccattcctgatacactctgaacaccggtgtgattgatagtctcccaacaaacattttcatagaatctgcattgctatctgatggcctgaaatgatcttttaaaagtcagggtttcaaacttgatagttctaagttatttaaggtaccacataacagcagagtacttatcaccagtagaaatgatttctccaaaggaaaaaaaaaatcacatattgaagactccgttaaaatagaattgtttctaatccaagaataaaaatggtagtttataggaatattgagttataacaaattttggcttctacatatactgatggctctcaaataggaatatttcaaatacctagatgtgtgtatatgtgtgtatgtgtgcatgtgttttgtctcacgatttcaagtgaattggtctgaatgttttgtaaaattacaataaaatatcatgacaagtctatcgtttcatctgacaaatttgcaatatttaatggaattggcataaaatcctctgtcaattgaaaatatgtttgaagagtacaaggaaaaggagagttacacttttgagaccaacatttctcatctcataaatgggaaataattagggtttttgaattttgttaggcaaatttacattaatcatatttttattttaaaaaatatgttgagttagcacattgcatttgttttcaaggaacttctataaaactcttttaattttttaatttttttttttgagatggagtttctctctgtcacccaggctggagtgcaatggcgggatctcagctcactgcaacctccacctcctgggttcaaggaattctcctgcctccgcctcctaagtagctgggattacaagcacctaccaccatgcccagctaatttttcgtatgtttagtagagatgcagtctcaccatgttggccaggctggtctgaaactcctgacttcaagtgatctgcccgcctcggcctcccaaaatgctgggattacaggcatgagtcaccgcacctggtgaaaacctttttaatttcatttattccatttttcagatatatgtatgtgtgtgcccgtgtgaagtctgtatgacagtatatatgtctgcatctatgtacatattatatagatattcatgggtataggatgggggatgagggaagagatttctttttaagtggttagccatatggcttgtacagccacactatgatctttgcttatccttctaattaataataccttcaaatgtgcatgagaacaacagcaagatctctgcaaatcatagtcagaatttgtcattttgcaaatttagggaacaagtttcaaatagaataatttgaggattttaaatggtttaaagatttcataccccagtgatttctcttttattgtcacaaataatgtaaattttctccctataaaaatgtaaaagtattaaaagggtatataaagtctacaacagttacttgtgtgcaataatttgacaaggacatagagtgcccagatatttgattaaacattattctgggtgtgtctccgagggtgtttctggctgaaattagcattgaactggtacattgggtaaagcatattatcttccctgctgtgggtacacatcatctgacccatggaagacctgaatacaataaaagactgagtaagatagaattatttctctctgcctgacggtcttagagctaaggcactggtcctctcctgtcttcagacttgatcttggactaaaaataacattgttgactctactgatccttagacctttggattcacactggaccttgcaccctcagctctccagggtctctagccaaaagactgggattcacaccattggctctcttgagtctcatgccttcaggctggaactcataccatcggttttcctgagcctcaggcctttagacttagactgaaactcacaccctcagctctcctgggtctcaggccttcagactcagctggaactcacaccattggctcttttgggtatcaggccttcagattggcactcacaccctcagcttttctgggtctcaagccttcagactcaaactggaactcacatcctcagctcttctgggtctcagaccttcagacttagactggaactcacacccttagctctcctgggtctcgggccttcaaactcagactgaaactcacatccttggctctcctgggtcttcggcctttagaatcagactggaactcacactctcagctcttctgggtctcaggcctgcagactcagaccagaactcacacccttagctctcctgggtctcgggccttcaaactcagactgaaactcacatccttggctctcctaggtcttcggcctttagaatcagactggaactcacactctcagctcttctgggtctcaggcctgcagactcagaccagaactcacaccaacacctctcctgggtctcaggccttcagacttagactggaactcatacccttggctctcctgggtttcaggccttcagaccagaactcacatcatgggctcccctggctttccagctttcccactgcagatcttgggacttcacggcctccacaatcatatgaaccaattctttacagtaaatctctctcattgcccattaaagcgagaatggtaaatatatgatgtaccatttctaagaaattatgtgatttctaagaaaaatgttttgttgttgcttgtcagtaatacctctaattcaaatgaaagtaaatctgacctttaagactgacaaggctgttaatccaattcatgttcaaagcattgttgtatgacttgtacaaaaatatagatgtgaagaagacagaattcagaccctagaacatttaggaccattcaggagggagatgtgtgcacaatgggccatacagtcaagactaaagagcacctaaaccattccactccccagttgctgactccaaaccaagcttttgtatgatatgtgcccatgttctgagcctgaatcccaaacaaggcccattggttggaaatgtctttattatgtttgtctctgtttaattctattcctttctcattcctctggaagagaagaaagataagtggtacaagatacttagtggtacttagtagttctcaacttgggggtgatcttgtaccacttctccaggagatgcttagcaatgtctggagacaatatttttgattgtcacagttgaggagaaaaggaactactgggtaaaagccagggatggtgctaaacatcctacaatgctcatagcagacctccaaaaccaaaaattgtctggcctcaagtgtcaatagtgttgatctcgagaaactctgctgcacttcagttttgataattctgacacacagtgggggaaacagcacaacaaaattaatgaaaaccttaactaatataatgcttgtaataaatctaatatgaattggaggttcatcacatcttgcaaatattaattcagtttttaaattttggttttttaaatttgttttgtttgaataaacttttaaagagcttcaattctatgatagggcctggggataaaaagcaaagtaaaatgctcatgcaacacttgaagttcagcagagaaagtagatgtgcaaccacatgtattagtcagggtactccagagaaacagagccaataaaaagatagatagatagatagatagatgatagggagataattagacattgagatagatagatataaacagatgtagagataggtatagatagatagtgtattagtctgttttcacacgctataaagatactacctgatactgggtaatttatagagaaaagaggtataattggctcacagttctgcatggctggggaggcctcaggaaacttacaaccgtggcggaaggcaaaggggaagcaaggcatgtcttacacggtgacaggacacagagagcaagcaaaggggaagtgctacactttaaaaccatcagctctcatgagaactcactcacaatcacaaggacagcatgggagaaactgccctcataatctaatcacctcccaccaggaccctccctcaacacatggggattacaattcaagatgggatttgggtggggacacagagtcaaaccatatcagatagatataaagacatagatatagagatagataaatttaaatagatatagaggcatagatagacatagagatatatagagatatagatatagatacagatagctatagatagatagatggatagacagatatagatatgtagatggataaatgacagatttatgataaattggctcatgcaattatgaaggctgagaattcccatgacctgccatctgcaagctggagactcaggaaacctggtcttgtaattcattctgagtttgaaggtctgggaaccaggacagtcaagagccaaggagtgtcaaccagcccaagagcaagagaaggtgagatgggatgtcctacctcaagcagtaagtcagaaaaaaagggatgattcctaattcctcctccttttgtactattcaggctctcggtgaattggactaatacactgtctatctgtacctatctctgtatctatttctatatctattaatatgtatctttctatctatcactacatctacctatctctacatctatctatctatctatctatctatctatctatctatctatctatttatctatctcttattggctctgtttctctggagtaccctgactaatacaccctcacagacacacacagaaataatgttcaacctgggcaacccatagcccagttaactcaacacaagtcaaaacaaacaatcccatcatacacactacaatactgtacaatttaataatggggcaaccctagcctctaggagccaggacaaggatttacttctcctaggggagcctgggtaccttcatagaggtggtacattgggtgtgggccttgagggatcagagaatatcagacggaaaaggaaaagagagggatccaggatggcaaacaaaagcccagcacgtcagaaaaggtgagtgtgttctgagacattaaaaagccagtatggctaaagccaagttagaaatcaatttcaataggatgttgagctaaagacagggaacatgatcatggttgtggatgtgattggcaatttgagaaattcacacactgactaaagacaacactttcaagaagtttctctgtgacaataagacaagcatcatcaaaaccacagtgagatatcacctcaccccagttaaaatgtctattatcaaaaagacaagaaataacagatcctagaaaggatgtggaaaaagggagctcttatgttctgttggtgggaatgtaaaatagtacagctgctatggagaaccatatggaggttcctcaaaaagctataattaggactaccatatgatctagcaatcccaatgttaggtatttaccctaaggaaaggagatcagtatattagaggaatatctgtactgtcatgttttttgcagcagggttcacaatagaaaatgtgtaaaatcaacctaaatgtccatcaatgaatgaatggataaagaaaatgtgatatatatgtatatatacataatgaaatattattttaccatataaaaatgaaatcctgtcatttgcagcaacatggatggaactggaggtcattatgttaagggaaataagccaggcacagaaagacaaatatcgcatggtcacaatcacatgtgagagccgaggaagtggatctcatggaggtagagaatagaatgacagataccagaggctgggaagggtagtggggaggagggaataaacagaagttggttaatgggtacaaaaatacagttagatggaaggaataagttctagtatttgataccagataaggaaagtataattgacacaaatttattgcatatttttaaattgctagaagaaaaggattgaaatgttcctgacacacaaaataagacaagcatttaaagtgatagaaacgctaatcaccctgatttgatcattacacattgtatacaggtatcaaaatctcacatttacccccaaaatacatacaactactgtataccaacaaaaatatattttaaaaaacacgtgtccacataaatgtttttcctccattttgtaataatagagggaaaaatagagttggctttttgagctggcttctctcaatttttggatagcttgcaaatattttcatcagcctttacaaggagtgagacaggcatgtttatgcttttctgaagctgcatgtcgaaatttagacacctgctggtgtctaacaggtcggaggtggctttatgttgggaaggagttgaatcaataagcagagatttcagcaaaggggcagctgagatagttgctcttggctctacaatgtctgttcttgtgtgcaggatcaggctctcccataagacttcagtcttggttttgcatctgaatgaaagatatctggcattcctaggagattgttttagttcctttcatgggtttcacagattgagcctcttttctacattcttactacttctgcctttgaacagttttcctttgcctcattcagagacatttgcaacagagatgtccttccatcagtctcttcctctcaaacatctctgtgttactttttaaaagttcctgaatatggtaacaaacaggggtctagtttcattcttctgtatatcactagccagttttctcagcaccagttattgaataaggtgtcctttccccatttacttttgttgtcattgcaaaagatcagatgattgtaggtgtgtggttttatatcttgggtctctattccatttatctatatgtctatttttctaccagtaccattctgcttcggttactatagccttgcagtataatttgaagttgggtaatacggttcctccagctttgtactttctgcttacaattactttggttattcagcctctttttcggtcccatatgaattttagaattgttttttctaattatgtgaagaatgatgttggtaatttgataggaattgtgttgaatatgtagattgctttgggcagtatggtcattttgacaatattgattcttcctatccatgaacatgggattttttttttttacaccatggaatactacgctgccatttaaagaatgaaatcatgtgtttcacagcaacatagatggacttagccattatctgaagtaaaataactcagaaaatcaaacatcacatgttctctcatataggtgagagctaaacagtaggtgcatatggtcataaagatggaaacgataggcactggggactccaaaccaagggagagtgggagggagcgaggatttaaaaactacttattgggtactatgtttattactttgttgggtgatgggttcactagaagcccatatcccaccattacacaatacctccatgcaacaaaccttcacatgcactttcaaacctaaaatttaaaaaacagtccctaaaaaaaaataataatgcggaaaaaaaacacacaaagaatgaaaaacaattaaaacttattatcccagtaccctcctcctccacctggtgcccctagccttcccctattgcgggatctggccagcagcccgcaatgcaacggggctctccctctgctcctaggtggatcggcaggttgagaaataatagagacacacaatatagtgaaagctgggtccaggggggtcaccgccttatgcttccacggtgccaaccatgcactggatataccagcatttattattaagtttagtgagggcgggggtaggttagtgagggatttagggtcatttgattatgaggtgagatggtcacatggggatgaagtaattcttcaacataacatttgtatgtagaagtacagtacatttgtatgtagaagtacagcatacagagataagaatttacaatatagtgtgtgcgtcagtaatttctaacagagccttagaacagaaacacagtccttccataacctatgattagcaagatattaatcagcagtaacaattgcaacaaaagctggttacaaacaatccatggaaacaggacgtgaagctaaacaactggttagaccagaaattctcagaagggagtatgctttaaccctaaaggggcctagaagagctgtggcaagatgagggcgtttatagccctatcttatccatatggacaggcgccccccatgcttccatttataggctctccacaagggtcgcattccattcccagagctatgaacatctgcttttctgggataggaatcttggtgatgtgaaacctccctgactgcacgtccattcataggctctctgcagggggaagcacatcacgcactgttggctcgttctggcagtccaacctggcattgtctttacacaatcctgcatgcaattttgtatttacaatactcaggagcatttcatcttttattccatagcaatagtttcagggggtctccctacattctcccatgtggtcctgatgcctcacctgctggcatctccccatctccaacagccaggtgtgttctactatgctccctcatcaaagatgtctcaggatctgtttgcacagcctccaagtgcagccaaacctagaagagctgatggtccctcatctaaacatagggaaatgagtggtctgatttatgttcctgacaagtgacctaaatataaaatgcatgccactgtcacagagtctaatccacccccaccacctcctcacttgcattctccgtctttccatttgtcatttacttagcagagtcagcaagtgctgccaagctctaagaaccattatcgcagaagcaaccatcgtcaagaagcctgcacacatgtttattgcagttgatatagatgctagtaaaatgcaggacagttttaattctttaatttctcatctgcccatcttgtggtggagctacacggatatttaatgtgatgtcgtaaagctctgtgttaggaggagaaagcaggcaggaagcggatgtttgcaaacgataggcttataaaggtgagggtagtgaagttaccagactgacaacctggtgctgtagtacgatagtagtattttgtatttctatagtaccattcttcacagaactcaaatgagtcagatgcgactttttatggcttgaaaaattcctaccagtgagcatcagattttatttttagactgaggaaatcgttgttaccaagaatgttgttttaaaattgttaggtatgtgtctgttatatatttcattcccaaatattgcgtcttacaatgaatataattatatagagattagagaaagagaaagagagagagagatacatagatatacggatataacatatcctctgtgatgagggagataaagtaaaaatataatatcaatgaaaatataaaaagctatagataacatcaagaagtgctgctttcattagcattccttcaaaaggtactcttaacatttttaacatagacttcagcgcatctaatgcacaacaataattgacagtcataagaccaagtacaagacactgaaagtttctaatctatctcctgagttgtcaaagaaatattaaattatgaattcactcaggacaaaagtgagattgattttagtttatacttcagtaactattctgtgtttatttggaaaaatatcccagaggttgtcagcttttgtttgcctctcaaaagagaatgatattgggtttaaaaaatttaaaaagctattaaaaaaaacaatcagagcagtaaggtgacaaataccttttatctattttttctgctttcgttgggttttaattttaacttgcttttaaatttaaattaaaagtcaggcacatacatgggaggaaaatctcaagggaaaaaagcagtgtgcaatggagaataatactgtcaaaatccagatgaacaactctttctataccctttgtgtattgttctggtgaacagacatctgtgtttagttgtgtatatgaatgtgtatgtatatatgtatctacgtgtctgtgtgtatttatatatatatttatgcatgttatcttttcacaattggagacacatatacaatcttctgtaccgtattttttatttcaatagcttatcttgaaaaccttttcatatcttcacacatacattatagcatcaaagtaatcctttgtacgagagtactctattttactagtccccgattatgtccacttgggttgtttccagccttttataaataacgtcaaaatgaacctttgtgtctgtagggctttgtgcatatttgaatatatgggtagttacatattgagattttcaattgccatatcaaattttttccaaagaggttgaaccagtttacatcgtgaccaacagccatatgagtgagcctgttatctttgccattaatgtaaatattttcaaacttttgaaacaacaggctaagaagaatttttgctgttttaatttgccaattaatattatgaatattattgagcaacttttcgtatgtttataagtaaacggtttatttttctgtgaaatatctgttcctatcttttgtccattctttctgccaggattttggtctctcagtaaactgtaaaaactctttcactgctaagcaaatttaggcatatatatatatatgggacacacacgcacacatacacacatatatatatacactatatataatatcttgcattgatttattttgacttttcctgttttgggcagcaattattgtttttcaaatttatatcatcaaatttatcaatttttctgctaaagcagaaattcagataacataaagaaaaatggtatctgaaataccattctgagtatcagaaatgcctgtgatactcttaaatttcatcttatctcttctagtctgaatggactttttccttctttaacgcttaaatctttggactatgtataattatctttactggaacaagtgaacttaccctttttttcttttttcccaaattgttacttatttgactcaatacatagatggacaaatccatgttttccaagttggtttgaattgctatctttactaaaaataaaattttgaagcatactgaaggcagtttcaggattctccattcctctatagatctaattacacatctatatgaaatttttattaatattgcttaataccatgcttccatattacatacaccagtcctatctcaatgctttcagaaatgttttggtaattcttttttttcatatgaacttaatatgtatgaacttctataaagttcatatacttctttaaattcataaacatatatatttgggtgtattatgtattatatataaatacataatttatattatacataatttatgttatataattatatattatatttataatataatacaaattgtatatatgtatatatttacttgtttccaatggttttggaataacagtctagatatttttcagttatagactcatatctacaaattattccgtctcttctctcctaatattccttccatatttctctcttttctcccactaaattgactagtaatttcagaacaacattaaattattacaaggacaatgggcatccttatcttgcactgactttaataggatttttttctaatgttttcatatgaattaaggtgctggttcatggcttaaaatgtgtatttttataacaaaattatcagtccatttttattactcatttttatcagaatacacatggagttttatcagattccttttggcacacaaagatcacatggtttatatcttctctgatttattattgtggagaatgacattaataaatattgatccattcttatattttacagaatgaaacagttttaagtctcctaataatttttaaatttgataatattaaaaaagacatttcttcttcagcactgggcatcaacctttggcagagaggttctgattttagggtcagcagtttcagaactgaaattcctcgaatgagccccacagtgtggggtactttatgtttattcatttgttcatctaagaggcaggcaccaggcaccaggaatagaacaagacaaaccctgtttctgacctcacagagcctagagattggcttttgttctcactttgctcattaagaaaggcatttgtactttttcttgttcggacttctcttgggttctttttatatttttcatgaaggcttttgaactaatgaaattaattacatttaatctgatagaaaaaggtgtgtaaacctcaaagacattttgaagaaatgtatttgaagacactgaaaattttacttatgtttatttgggcacaacagcctactttttgattattctaaacacaacatgattggatcattggaaccttgaaatcagggatttatttgcacattcctggggtgccccaatgtttcatcatgggtccctttaatgcttcaggtggagtagactctttaatactgaatttaaactgctgaactcattcttcagaactcaaaagaatactagttagtcccagtgatcacccagtctgaatataacacagaaaaaaaaattgttctaactccaaggaatgaataaagtataattagttggagaatcataacagttaggattgcttttaagccatcaatattagaattaccataatgggatactttttagaaaagaacatattaaattcagaatttttgctttcaatttttttaacttggaggatgaaagaaaacctgtatgtctcggtgcagtggctcttgcctctaattccagcaccttgggaagccaaagtgggagggctgcttgagccctggagttcaagaccagcctgggcaacatagtgacattctatctctaccaaaaaagaaaattcttttaaaaaattagtcagatgtggtggtgctcacctgtagtcccagctacttgggaggctgaggtaggaagataacttaagcccaggagattgagtctgtagtgagctcaggtgtgattctatgatcacaccattgcactctagcctgggtgacagagaaagaccccatctctaaaagaaagaaagaaacaaacaaacaaaaaacccttctaatatgaaacaaatgtaggtggcaatttatcatgaataagtttttgttggtttcataaggcagtcaatattcagtgttgggcattgtcgtgaaaggtagcagatacagtgttctggaacactttatctactgtagggttttttaaagataactgagtggtcctggggtgtactagttttcttaccttgcctgggtttgctgggaaaaaaaaaccctcctgtgaaaaacataatgtaaggactgacctggaaatggactgcttagatttcactaatccattttaatgcctgaaaaataaagagtaaaaatggcctcacatctataaaagtagaaatggcttttggctcactagacggacatagagcatgctgaataataaaggatgctgattccaaaatttaagaaaattagagggtgggatatgatcgctcattctttacaattttgcatctttgattgtttttctataaaacttgtgtgtcatttctcgatccagtgtctaaactcaatgtggatatttaggtcattgttgtagctacctcttcatcccaaatacatcagaaatttgggatttatttatctatcattttatgctttattttccaccagttgatgttatctaggaaattagataataagctttcaatgactccactagataattttaatatgtcttttaaatcaatacctagtgatatccattaataaagcatgaatgggtaaaaacgggatgtgtctatttgataagtgtcgttttaaactgcagtgccacctgccacctctgatcccttctttctcacctctaaaatattcttctgaatcactgttgcccctattaaaattggttattgatttgcatagttatctgtgtcgtggctgatctccgccactccaatgcgttgtacgttctatgcaagtttaaggcatgttcctgttgtatctgcaaggcttaatagagtatgaagaaacatgggagaattacaattaatttatttttatgtttttcaccagaagaatggcacagcaaaaccattaacttgctaattggagaagagatatatttccattaaaagctctgaggatatcatagttggtgtgacccaatttaagtggtgaaaatcacagatcatgtttatagaccattgccgtatttaattttaccacctccctaaggagtcatccctgttttacagtgtattaggctgttctcatgctgctaataaagacatatccaagactgggtaattcacaaaagatagaagtttaatggacttacagttccacatggagggggaggcctcacatacatggtggaagacgaaggaagagcaaagggacgtcttacatggtgcaggcaagaaaacttgcacatcgggttttctttggtccaatatttatgtgtgaggttaaaaataatttgacaacacatgcaactacatggaaagtccaaccccagttggcatatggtatcctttcatgcaaaaagtaagcctagatgactgctctcatcaacatcaaggaattcctaagtgacttaaatgacctcagtctgaaagcaaaacaaaatagaagggtgatattcctgaagtggcaggttaatcttccttttcttttcattccaagttcagcaataataattcagtcctagaccattatggtgtttatcaagtttagtatgaatcatagagctattcatgtaaagtatccagagcacttgtactagtaatgttaactctgttctatattgaataggtgtgattgcaaagttctactttagcccttgaaatactacagaatttcttaaattaaaaattaaagtgctctttacattcatgtgaaatgaatattggactcaaaattgggatacatctctaaaggatactgtttatgcattactaatgttttatcaggccatccttgcctttatacaactttggcctcagcttttcagggtaagttttaaaaggagttatagtatgtttttgcctacaaaaaaggttacttttgtaagagtaaactggtttctgacataaacgtttcatttgaaagtggctgaaagacggttgaggggaaagtggaaaagaatggcttcattctttgcaacacttctagacaggtttttactcttattatttgaaagctttttttgagactagtcatatttttgattcattcctccaactttatctgtttccttataattctaacttaccgtcaaatatagagaaagagcttaaaggaaactaatatgcagggcacagacacaagaggggtgggtttggggatggctctcttccaatcaagcttctgaactgttcctgccatttctggctttgactctgcaccgtgccccctgctggtccctccagggagtagacaagaaatgccaaatcgaaaaatctagagcaacctctcaaatgctgcttaggttattcaggttttcctaaaatagggaactttattaaaccggcttgcctttaaaactcaggtgggtaatactaaaatctttcctcccgaaatgtattcaacttcattttaatcagatgaagaaacaaatcaaatgaagaaaaataacactctactaattagcaatagtattgctgggatcagccttaagctcctaggggatcggaccaaccagatgcctctaattattgttttccgcccatacaggaatatttcagtctatttctgagatgctctttgcacaaagcaaagaagagatacagctttctaggagttattcattcttcctgcagtttcttcatgtccagcgaggcaagtcccatcacagtgtttaaaggccttgtgactggtagtatttatgtaatatatggaatttttatcctcaaaatttgtgaaagctatgaaataaaagtagattctttaaaaatgccttgatggtgatttcaagttcatcctttactctcttaacacactatttaaagaaatcccatacaagttcaggatatagtaactggccgcaagatgtgatagaacaccaacttttgcaacactggcttttgtgagattctattctaacatcgactttggtgagtttctattccaaataagtaactatacacattataagaaattttataaatactacttcatttaatcctccagcaacgctttgcatcattttattgataaggaaaatgaggtgtggagagtttgaataacttgcccaaggtaacagctgataataaatgatggagccaagacaagcccttcatttccaaacctttactctttccccatgccttattgcttacctaagactttttcccaattcaaaagccactggatttacatagatttgtgtgatgtgttgacaaggagaaaactccaaaaggaaaaagagttctttgctaaacattcagtcctacttttaaaactgttacatttccaaatacttggggtaaaaaggatgaatggagtaaggccaggagaaaaaacaagcttatatttgatacctcgagatttttacacatgaaaaatccaaaatagacagatcctgcaaaaaaagaatattcaaatggctgataaacattttttaagggtgttcaacttgattagtttcagagagaagaaatgaaaactacagtctaccataatggctagaatttgaaaatatggcaatatcaaatgttggagaaaatgtagagcaactggaaatcacactcacgtatgctggaaatgaaaactgggcagctactttggaaaaactggtagcttacacaaaaattaaacatacaaccacttgtgacacagcaattccatacccagacaaattagctttatacattcacccaaacagacatattaactcccaaaaaaccccaaagctagtcaaatgtccaccgatatcaatatggacaaacagtttatgctatattcatacaaggaaataccctgcagtaataggaaaatataaactacaactacacaaaaaatatgaataaatccctaaacaatgttacctaaaagccaccagaaacaaaaggttacatgctgtcccgttttctttaaataagttcacaacataggcaaaactaatcaaggttgctaaaatcaggtgtgggcctgtgctcggaatgggtggtaactctaagaggttaagggcaagttactgggtgctggaaatgtccagtttcttgatctgaatgttggtgacatgaattttctcaggcaaattcgtcaagctgcacatgttggcctttgtatttttctcaatgtacatggtataccaatcaaaagtttcagaagcccaaaagagagaggataaaagtattttggagagaggaagacaatttataaagtggatatacagatggagattgcccttgctgaacatattttacatggaagagtgaagagaaaaaaaggaacaacacagagttcatgtagaacttctttttttaaggtagtttatttatatttctattttatctagaatgcttttgtcattgacaaataaaaattgtatgcgcttaccatgtacttcaaactacatgagaaaaaggtaaatgttggagtgttttatcttcatgtgcaaaggtgatatttcagataaaatacaaactttattaagactttaatttgaagctatctagaaaacaatttgggtctgtctccacgatcttttcccagcacctcactgtatccttctcatagcatgtgataatgcattgaatatatgtgccggttactagaaaaaaacataacaacctatctggtttggttttatgcttatttctatctccatggttgctttgatctctctttctcttatcacacttgccttctggatctttctctaattttcttcttgtcctgagagcttccaaatcctccagacaggtgaaagtgttcctccagtttgcatccaccaccacatgttttatgcctcctctccttgtctccctagagaagccacaaactcttgcaggacatccacaccaaaggtattacccattgcctggtacatagacaatacccaaaattgtgctgagttaatagaagatttaaaattcaaacaataggttggcaaattgtacatagtgaagaagcatgtccctttttaaatggagagactgcataccagctttgtgaaccaaatagaatttattgcatctattttaatcctcatgcaggggaccgaggttagcatattcagaaactcaccaggcttgcacctgctcttcatcaagtgggtcctacttcacgagggtgagacccatgtcctatagggcctcagctcaaagggctcatgcttggtttaatgctctgctaatgtggtcttgaagtccttaatttataaacactgggccactcgttttcacttttcctgaaccccacaaattgtgtagctggtcctgttcatcacaaatagaaaaatatgttgccaagcaacatgagaaaatctagatgcccattcatcttcctaaagacaagatctaaagcagaaggacaggttcactttatttacttatgtaattatttatttatttttttattttttatttgagatggagtcccactctgttgcccaagctggagtgcagtggcaggatctctgctcactgcaacctccacctcctgggttcaagcaattctcctgcctcagcctcccgagtagctggaatttgtaatccgaccaccatgtccagctaatttttgtatttttttagtagagacagggtttcaccatgttggccaggctggtctcgaactcctgacctcaggtgattcgcccacctcggcctcccaaagtgctgggattacaggtgtgagctactgcaccctgccctaattcacttttgaatggacttttttttcaacctgcagcatagtaatgtagaattcaggactattgttatttgactatttatttatttatttatttactgaaagaaggtcttgctctgtaacccagactagagtgcagtgccacaatcataggtcactgaaccctcgacctcctgggctcaagtgatcttcctgccccagcctgccaaagcactgggattataggcatgcacaaccgcacctagtctctgacattccacaatttaatatttcacacttgtcatacaaagaccctaagcatattttgaaacaaaaaaagtctcaaaaatgtattgtctgccaccaagcacgaaaaaggacatcattcagcccactgcctctttaaaggaccaacaaagagggtatctaggcaaatattacatttgctatctcacaacaggaaatacatagctcagagccagaaccttgtctagacataatcatctagttctaaacccagtcactgcctaaaatttaaactaatttgctctgtcttcaaacttgatgggtaagacaatcctactccaaataatctgagtcacaagatagtaagtcaaactcatacagaaaaaaagaaatcatatgcatctcatgtatatttagactctttaaacaatagtacatagtatattttatattacatatacacagactgtactttatttatttattggagatggagtctcgctctgccacccaggctggagtgtggtggcgcaatctcggctcactgcaacctttgcctcccgttagctgggattacaggggcccaccaccatgcccagataattttcgtatttttagtagatacagggtttcaacatgttggccaggctggtcttcaactcctgaccttaagtgatccacctgcctcggcctcccaaagtgctggaattacaggtatgagccaccatgcccggcctgtactttatattttagttgaagagtaaatgtttccatttatcttgaaaatggcagtgtatgaattttaaataaaatttttaaaacctataagcacattaaatctaattttatttgtgccaacccctcaggtttttgtagctttcagtgtcattttataatgagttgctcagaaaacattgttacactcttcatctttcaaggttctcccatcacctaaagagccagtatgaaggtctgaaaattgcttatgatttaaccatctttatatctttcttgtatgtttctttttctttctatatttcagtggataccactcactcagggaagacttgctctagtataacctttaagaccaatggcaaacttaagaattggatactgaaatatccaatttaaaaataaattttaaaatttaaaatttattgtgattttctcactttctttacttttggttagctataacagagacagttcgctgggtgtattagtctgttctcacactgctataaagaattgcctgagactgggtaatttataaagaaaagaggtttaattggctcacagttccacaggccttacaagaagcatggctggggaggcctcaggaaacttataattgtggcagaaagcgaaggggaagcaagcacattttacatgtccagagcaggaggaagagagagtgatggggaaggtgccacacacttataaacctcccgatctcgtgagaaatccatcatgaaacagcactagggggatggagctaaaccattagaaaccacccccatgatccaatcacctcccaccaggccccacctccaacactggggattacaattcaacgtgaaatttgggtagggacatagagccaaacaaaatcagttggagacagatgcaacctctgtgtttctcaacaacagtagcacctatgctttaagtatttggccgtttctaactgtataaacagaaatctgtattcttcccataaatttaacacaaggcagtatccataatgcccctgaagctttggacatggagatatggtctcctctcttttttcttcctcttattaaaagaaagcctttgcttactggttaagtggttcagatttatttaaagcaatatgttgggtgtttatttctcagtggcaggaaccttggccagatgtccatttgaagtgtatttcagttcggcaaggtccataactcactctttcagattattatggtttagctatatggatgtccaaggctgataaatccactaattgtaagcgagatttctataaattgatttttcacactatacttcatgttctatggtatcaatgacaaattgcaaaatctcctgtctttcttccctgcgggtctatttcagaaatagtgcaacagacactagatgatgagacatgaaacttttgctgaaaccatactgtgtgaagttttctgttattcaggaagaatacaagtaagccctgtcacatcagtaaaacttaggagtgtcatagcacgcattcaattgagtatcgtgtagaagctaatgattgtgcttttcatttctctgaataatataaagaaactccaggaattcttgcattcagactttgtgtctcaatttagaagagattgagctatgccctgcattgggaaggattgaattgctctcgttcatttgctgttagttttttttttcttgaaataataggataaatgcacatggcaggaataagtggaaaattatttcacaagtgtgacatctatggcttattcacaatccctagttgcttcttaaaacatagattaatagaccttgtccctaaggcttctgactcagtaggtccgacgcggtgcctgagaagttgaatctctgagaagtatcaggtaacgtggctgatggcagacgactctgacagaaccacctttctatcacgtttcctagtgtagccagacttccgcctagtacagcgtgcctccttgctcattgtgaatctgtttcatctcatatgtttcttgaatacttgatatttctcgggagccagatcatctcaataattcagaatcttgatcaggaccagtggctggaatatctcagtctggccacacgaaacatcttcgtgacccaggcagagaagacagaatcccattgcaagatctagcaattcccaaaggggtgggagcagggcgctaaggggattgttgccatctactggacctgccctttgcattgtaatgcacagaggcagtggtttctttccattgtgtgtgaccagaggatgcaggaactacccactttctggccccaacactaaaagtctcctcctgccattttagatgtttctctttctcctcatgaacttttccccttaaatttttgaaattgtttctcctctgctcagagctctgtggtgcgtgggagaaattgcacactccttatgctagtgcaagtaatattatttggccctgggcaaagtcctcttgctctgcagttttcaggtctttcataaattttatggagctttcttcttctttgtttgcttctgtggctcctggtccaaagtttctccttagacctacattgaaattaggagtctatctgtctgtctatcaatctacctacctacctacctacctacctacctctccacccatcatatctgcctatctatctatctatctatctatctatctatctctctatctctctatttctatcatctattctgtctacctataactataatctattctatttatctaagtatcatctctatcatctctatctgttatctatttatccacctatctatctactatccatttatccattctatctatcatctatctatctatctatctatctatctatctatcatctatctatctatctatctatctatctatctatctatcatctatctatctatctatcattcattcatcttttttccattactctcatccatttttccactgcctttgtcttggcattccttctcacatttgtttttatttcaataattcagctttctttagtatccactctgctgtttattgtctccttggctgctttcactgagtttctctgttttgtctccatccatgagtgtctgacttcaaatcacctctctatgacttccttttcttgtgtatagatgtgctttcatcttgaattgtgcatgtgtatgttcatgcatgtgttaatggaccagaaatcttcaaataacttctcctgattctttccataagttctagtatatagataccatatttggtatgagacaagttacttgatttccatttttgtttggttatgaaaggagaatttgagtgagtcaatggggcttaaatgtccaaacttacattgatatgccaacataaaatactataatgaggattagaccatgtatactcttttatatcctagttttttcatgtaatatatagtatgtgttttccttctgtggccccactacttatcatcatatgaatacgctgtttagtcaatttacatattatcacatatttagccaatttacatattatcacatatgttacttagtcaatttacatattatcacatatttagattgcttcttattataggtattataaaaatatgactatgactatccaggtagtaagataaatctcttactacatgtctgacagtttctgtatgaaatatttctaaaaatggggttacttggtcaaaagcagagactcaatttcaataccctaattgctttaaaggaacatttcagaatgttctcagtcccaccaggagtgtatgatatgctagtttcttagataaaaatctgttcatacttttcttactgtaatgcatgtggttgtttctcatggttaagagccatctactttttttttctaatctgtatcccttgggtattattttgttctagtgttagatatttttcacctattagttaataagtgctcttataagatgataaactccattaccatgtctacttttatatcgactacaactttttttattttgtggagtagtatttctaataaatttgtttaaaatattctatcatctgaaactggtcaaataaattataattgaactatcatgacctgtgaggacctcatgttggtctctgacttataattcttgctgttccttttataaataactctttgtataaagatatgattgtgtttatgaccatcacagctatattttggcagtgaaaaacctcccatatttctatcttgtatcttttatttaacgtatttttagagtcaaaagggaaaaaaaagtgtaaagattgacttactcaagaaatgacttcattacattttacatgtatctgtgtgacataccttgcaatgatgtgagttcttgtagatggctaaccatggctttttttgcatgtattaacttatttgtttgtttgtttacttaagaaggcctgcctgctttggcattattttctcacagccttctacttatttgatttgcactaagtggtttttgatgtgctatatattttctgttctatttaggattgattagaagagtttaggtaacacacaaagttcaaatcagctagagtataaaagaatacttcctaatgtaggtttccaggactaaaattctttttttttttttttttttattatactttaagttttagggtacatgtgcacattgtgcaggttagttacatatgtatacatgtgccatgctggtgcgctgcacccactaacgtgtcatctagcattaggtatatctcccaatgctatccctcccccatcccccgaccccaccacagtccccagagtgtgatattccccttcctgtgtccatgtgatctcattgttcaattcccacctatgagtgagaatatgcggtgtttggttttttgttcttgcgatagtttactgagaatgatagtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgacttttgaatgatcgccattctaactggtgtgagatgatatctcatagtggttttgatttgcatttctctgatggccagtgacggtgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggaattcactcatgatttggctctctgtttgtctgttgttggtgtataagaatgcttgtgatttttgtacattgattttgtttcctgagactttgctgaagttgcttatcagcttaaggagattttgggctgagacgatggggttttctagataaacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagtccacttgatcatggtggataagctttttgatgtgctgctggattcagtttgccagtattttattgaggatttttgcatcaatgttcgtcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcaaggaatgtatccatttcttctagattttctagtttatttgcgtagaggtgtttgtagtattctctgatggtagtttgtatttctgtgggatgggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtatccagtagtcattcaggagcaggttgttcagtttccatgtagttgagcggctttgagtgagattcttaatcctgagttctagtttgattgcactgtggtctgagagatagtttgttataatttctgttctcttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgtcgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatggatcttgactttttatccaacttgccagtctgtgtcttttaattgcagaatttagtccatttatatttaaagttaatattgttatgtgtgaatttgatcctgtcattatgatgttagctggtgattttgctcgttagttgatgcagtttcttcctagtctcaatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgagattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttgtttttattcttttttctctaaacttcccttctcgcttcatttcattcatttcatcttccattgctgataccctttcttccagttgattgcatcggctcctgaggcttctgcattcttcacgtagttctcgagccttggttttcagctccgtcagctcctttaagcaagaataatttaatcaataatcttacaagttcctgatgaaagacaatgagtttcatgagaagggtatctttttccttctgcaagaatggcatttctttgcacctgaaaatcaacttgtaatcggactccacccgtgatagttaatactttcatctttcagaaggaaaagtttaatgagaaaaataaggcagaagtctttaactcacccaggtgctatttattacttatcttatgttttttaaccttgaggcaattttcttagcaatttcatttccagcatgtcgttagaaagatgatcttatcacagcttcaattccattatgcataggattcttgcaacaggcaccagcaggtgtgcctagagagtggtgcagaggaacctaaactattcagcaaaaacctacaggaagagctgagtgttaacagaaaactcattatgccctaatactgagagcttgccattttagaaatgcaacaaagaagctcttttaaataagattgtgctttggaggatggttggatgcaaaggtcaactagagcagggttctccaaatttagtaggcatttgcaatcacctgaatggccccacttcccaaggtcctgattcctttaggtcaagggcaggaccctagaatctgtatttctaacaagtttccagctgagcctgatgctgctgaccacattttgagaacccccaaagcaggcgaattcttacggctcctcaaagaggtaggatctactcctgatgtgctaaatttctttcctctctgaagttttcaagtcctgattacagtggggcagaaatctcccacagacctacaaaattatgtatcttaatgtgtctgtagttcttttgcgcatgaatgtttggttattgcccccgtttcgataacctagttggcttaatcgttgctttcacaatgttgacattttatcttacaggaagaatattctatggtgtttttatagagtctctgtgtttgaggaacctcttggcattcagacttacaaggttacttttgctgttgcacgacacagaaaattcacaagagtggctggaaccctcttatccatggatactttccttcctggtgtcttctgcacacttataacaaactgtcacgctgtctccatcccatttaaaaacgtgatccacaaaccattttcattttcagcttcatgagttccataatgatgggctcaccttcctgcctattagccattctctcttctcaaaatagtgatattctgtagattttttcctacaaaaattctaatgggaggtttacgtttcttcttggctttctttgtattgcttctctataatgtatgtacaactttaaagccagaaaattgcatgaacagcaatgaatcatttttcaagactttacaagaaatacatcaatcttttattttatggattgctttgctgagattttaaaactaccctttagaaaccacaaacagaagaggacttatctttccaagtctttttttatttcttcccaggttcttcaaatggctccttattgactggtttctaggaaaattccttctcgaagcgtcttcttttttacatattcaccatccttcttaattggctctgtcttcacgttctccctctgaaacacttaagagcccgaattactcagcttattcattttccctccaaaaggccactaaaacacaaggtttcctactgacaattctctgcaaacgttaatataatactatcaatgctttcatgaacacagttcttcatatttttaaagcactattaaatgtttttatcttgggacaatgccaagaaatctagacttgattcacaatcgacttttcttttaaacatgaaactctttaaagctaattcttcttatctcctttatcaccacaatatttttatttttccaagtggattaggtccaataatatagagtcaaaactaatagctattccaccagaagatgcctttataaagaggtacctttggaaatcttcattcgtaacccaacataaagccctattttattttcttaacttggaattgttgatgcttttgcagtatgtcccaatttttaaatttttgctatcagcttttctcatttttattcagacttcaggtgcaataatgccgttttatttttcatattggaaagccctgcacatttgataattgagtacatgaatctttccaattaattagaatatggattccaataaaaataaattagtttttattttattttaaatcaattaacttatttttgttgacatataatagttgtacatatttggggggtacatgtgatattttggtacctgtatacaatgcttaatgatcaagttagggtgattggggtatccatcacctcaaacatttatcttttctttgtgctgggaacattctaattctagttattttgaaatatataataaattattattaactataatccttctaccatactatcgaacagtagaacttattctttctttctaactagtacagtttttagaagtttccttctctatatgatggagagaaaactaggatggagaggacttcactccacaaagattcagaagttctgggttctgatcatggccttggtactgaccacctatggggatttggagcgaatcctaaaaagttcgcctgatgctggtttttttccactacaaaatggtgataagaagttttttctttaactgtataataatttcttaggaaatgagactatcactggataagactgtagatcctaagatgtcatatgatgacaaactgggttttgtagtttgcctagggcacattcttacctatcccagcaaaagtcctgattccggccatgtttgaagaatgatagaaccattagagtatccattcatatatctctttgatgtataaaatttcccacgctccctgttcagtcttgatagtgtaggaaaacgtgtctgctttttcttctgaattccacgcttttgaatcactgtctggctttacattctcttatgaactccagtaagtgggtaaaacaaacattcatgggaatgttcaaatggatttattgatttatcatctcagcgatgctcaaggccaacgctctatcctaaagcaacaactatttgggacaagacaagtcaacattttagcacaatccaaaaacagcttcattatttttttaggttcaatgcgcagacattgaattcacagcataagatgggattcagttgagatcaaggaagtttagatggcagtgaatatcagatgtggtccagtgctaaggttgtattagaaagagatagtaggattgcagaagtccaaatgtgcttatgaatgatagagtttccatagcacccaggtgtacagagtcatgtattttgaaactctaaaattaattagagatgtataaggaaaaaatgagaaaccttaaatctatccatgccacttacttgacgtatgaatgtattcatctacttggttctattaagagtttttgtcaaggatcttaaattttcctcttcccagagagcggtttcacaatcttgtattctcagagagtcaaacacctcattcttcttaacgggctcattaagcccctttagcattccttgataaaatatgttactgccttgcagtttctatcataattagccattagggatatcttgggtagctgtaaatattcaaaggcaacactgcacctatgaactgtattttgaagaataccagaaggtatatgggtaataaaaagaatatataaagctctctaatgtaaatcaccctcttagtggcatacaaaaaccaatttttaattagattaaagtctgagattcaaagccatgattccttgaacaatggacctgcttttctttgcctcagcacattctaatgggaaatccctatatttcgatttattttgtcaatttggttgcactgttgattattattatttttaaactcaagagtagagtgggtaatgattaactgaatgcagggaataaaagcataattgtggatggatatgagtagtgtaggatggacctattgttgggaataatttttactctaatactctattattggggataatttttactctaatactgaaatcactcaaagaactcatggatttcatttaaattctgtagaataatagaatgagaaaaatttggctgctgacatggcattaatattgtgaatatacccttaaaggaaaatggctcatttaagcaaaagtgggtatatttggaaatcagaatgtaggaatgcaattttgaaaaccatcatggacactccattactaacagacagctttccatccactcatacctcacattaaagagaattaagtgtaggaaaagaagttcacagtaaaacccaacaattcaagtacataatctatgtattatgggaagtttaacctggcaaaagtatcctttaattgggtgcacatcaaaatattcaagagcaaatcaataatgacccacttatgattacatcacaaagctatcagtttttcttcagatggtctattgatagaatagatttacacaatggagtagtgataaataataaattacagcgaaatattccaacctaaagcaatttacaagcataacgttaaatttttttaagaaagtcaaagaaaaattggtccagtccgatcatatttatcataatatcaaaacatgaaaagtagaatgacataaaatattactaatatattcgatgtatctatatgcaaatatgcaaatatatttaaaacaatatggaatatagataaatatgtatgtgaccaaaatataaataaacctaaaaaaggccaggggtggtggctcatgcctataatcccagtgcttttggaggctgaagagggaggatacttgaggccaggagatcgagaccaagctaggcaacgtagtcagactccacgtctacaaaaataaaaataaaaacaattatctgggtgcagcggtacacacctgcagtctcagctacctggtggctcaggtgggagggtcgcttgagctcagaggttggaggctgcagtgggccgtgactataccactgccctctagccagggtgactgagaaagaccctgtcacctcctccaccaaaacaaaaaaacatgaaaagcaaattacttaatcagaagcagttctctgaccagaacgtgctacttccaggggacttgaatagaagtggtggtatctacctaaatgaattcaaggcagaagaagggaaggtaacaaaaactgtccctaaggcaagaaatgggagaacataaaaagacagatttcttgtagagcaaattgaatgcagtgagatgagtggaagtcatagcaaacaagtatcaagaaggaagacagaaaaaatgttcttcagtgaggataacaactttgtaggttgctatggagctcatactgacataagcaaaacataggcctgggttattttgtttagagtttttttttaaaaaaaaagattgttggtagaaatgtgtgtgctcatcaatataaaaggtggattaaaacacctcggatatgtgatcatgttataattgtcaatagtatgtaaggatgatgtattagtccattttcaggctgctaataaagacattcccaagactggataatttataaaggaaagaggtttaattgcctcacagttcagcatgtctggggaggccttgggaaacttacaatcatgatggaaagtgaaggagaaatggtcatcttcttctcaaagtggcaggaaggagaatgaatgcaggaagaactacaaaacagttataaaaccatcagatgttgtgagaactcactcagtatcacgtgaacagcatgggggaaactgccctatgatccaaccacttccacttggtctctcccttgacacatgggagtaatggggattatggaaattataattcaagatgagattcgagtggggacacaaagcctaaccatatcagatggtaactgtaaaaaaaagaaaatccagcatgctctaaaaaagccatacctgataattgttctaagagactaacattataaaatataatcctgatgtgcatcctttacacctctggaagattatattttatgattttagatttttagaactaaattataacattacaaaacagttgagaagtatagtcacagaaaaagtcattaatccagcaaaatttctgtcaaaaaaaatggaattggggcatggaaacattgaggcccaaaaagttaaacatagaattaccatatgttacccagaaactccagccctacgtgtatacccaagagacataaaagcagaaactgaaacagggattagcagcattattcacaatgatcaaaaagtgaaaacaacccaaatctctatcaacagatgaatggataaacaagttgtggtctattcatacaatagaatattattcagccttaaaaaggaatgcagtactgatgcacgcagcaacgtgaatgagccctgaaaacaccaagctcagtgaaagaagccagacacaaaaggccacatattaggtgattccacttctattaatcacatggagagacccatagagacagaaagtagattagtagttgtcaggagctgggtgtgaggatggggtgggaggagtgactgctgcatggatacggggttcctttttctttttgagacagagtcttgctctgtcacccaggctggagtgcagtggcacactcttgctcactgcaacctccacctcccgggttcaagtgattctcatgcctcagcctcctgagtagctgggatgacaggtgtgtgccaccatgcctggctactttctgtaattttagtcgagacggggtttcaccatgttggccaggctgatctggaattcctagactcaggtgatccacctgccttggcctcccagagtgctgggattacagatgtgagccaccaaacctgttctggggtttctttttaaggtgatgaaaatatttaggaaccagatacaggtgatggttgcctgacattgtgaacacattaaaagtcacagaattttacactataaaatggttaatcttatgttatgtgaattttatctccatcaaaaaaaaaaaaagaatgaagctcttctctgcaataaaaatagtctgaaacagaacccggtaaactgggtagcatataaggaatgtaggtaaatgtctgtagaacttttttaaaaaatctctaagacaaacaaaggaaaaagaatgtatgccccacttttaaaatgccagagagttgcaggatgtttttttcttaataatttaagccttatttattatttagcactttgtttgaagataactatagactttccaaaaagtttccaaaatagtacagagagttctgctcacccttcagaatgtttttctaatgttaatgttttttgtcatcatagtacaattataaaaccaggtacttatcattgatagaatgctgttaactgaactacagatctaagtaaaattctgacagttttacccctagtgttctgtattagtccgttttcacactgctgtgaagagactacctgagactgggtaatctataaagaaaggaggtttaattgacttataattctgcatggctgggaaggcctcaagaaacttacaattatggaagaaggggaagcaaggcatgtcttacatggcagcaggagacagggcagagaaaactgccatttttaaagccatcagattttgtgagaactcccccactatcatgagaatagcatagtccaatcacccccatgatccaatcaccacccgccaagtccctccctcaacacgtggggattataattcgagatgagatttggatggggacacagagccaaaatatatcatgtactctttatggaccaggagccaatccaggattgcacattgtatttaattgtcatagctccatattctcctccaatcagtgacattttctcacttttttccttgcattttatgaccttgatgcttttgaagagccatcgtcagttattttgtatcttgtctgtgggacagttttaaaagatctaaagatctcaaaggaagaaattaagtatttagagataaacatactcatctgagaaatgttcggcacgggaataagcagaaataaatggcaaaaaaaaatcggattctcaaaaattatgaacaccaattctttaaatgatacggagtcaagctgcagacatgaacaaggtctctacaaaatggcagaagtgcaagaagttcatatagtgaatggaaattaacagggaggatggggaaaagaaagatttggcaaatgtgatgctatgctgaccatttgcagcgggtgagggatgaggctgtctagagtagtttagatgtagctcttagcctatcagcatctcaccatggtggcatgacaaggccacccttatcatggccctgctttgcttgttactatatcaagtgttacttaaactcaagcttctcaaagattgggaacacccactccccctatgccctcgctccctgtcccctaactcttgactttaatttctgtatttgtattatctccttgaggatcatctcccctcaataaattgttggccctcaattgtctctgagctcaattctccctcatggtatactctttaccgatgttattttatcactgaatattttcagcttcttctatgaatatcctttaaatctgccgtatctgtctaacacaaatccaacttattttggagtagaagacaattgctacaaatcatgagacaattttcccttatttcattataccaagctcctttattgacatgttcttatagtgcatttattttaacttgaatgtgctctgattcacaccccatttctattacctataactcttgcttgtattactgatgtgcttaggcatgaccagtcatttctcaaagaagatatttgcaggttgattatttttgtctcaatgtatacttgccaataacatatgctgtgcttctagctccatcagggtacttctgtattagatgacattcttcaagggattaatggccatttttcattctttatcagttgtaccttcagagttcaaattgatcaccttaggctttgacgtaaatcattcaacatcctatgagaaagcttaggaatcctcaagacagtggtagtttcaaagacatcccacatgttacttctcctttcaaatcaattatttaaaatttcctggtaaaataaatgtacagagaaagtagagcgaaatgtgaaaatctcccatagtcttcaattgtatacaacggatgtcccattggtcaagaaccctggctcacaccaaaatttggtctggacaaattttaccaagagaaactatttccaaacagttcccaggatgagactgtatggtatagttcagttttctatttctttacatggtcttcccttgtgctaggttcttgcaggcaaggatggttgctaaagatactcggaagagtcattatcatcaaggacagtagaaagtgctcttgaaaaagcacttttaggttgggcatggtggctaacatctgtaatcccagcactttgggaggctgaggcaggaagatcccttgagccaaaaagtttaagaccagcctaaacaacacagcaagaccccatctctaccaaaaaaagatgtacttttatagtacatactgctccaaaaatgtagaggaaagctcattttatgttcataacattgtgtggtatgaagaagcatttaccttctagcagagtttttgattagtgtttttacttgatccataaagaaattaccgggcagaggtgtaaccttcttcttttcttttcccactcacatctgagatgacatagacaagaagaaagagaaattttaacatataaaataaaatctccttccctctccccctactctgcaaagaaatcctttgtattttcaggaaaaccctcatgtttaaatgactataatggtttagttccccaatgctgagggattttaaaatttgaactaagatagccttttagcatagaaggtttgaaaattcatacctgacaatatctcatcaatttacagaaaagactgcctctgggagaatatcataatcttccaagatttatatggagctgaaagcaccttgtctatgaaatttcctataatataccgaaacatgattaaaaatgtggatctaaaaatggaattgcagagcatgcagcattggggaaagggatggtgataaatataaaaatattggggtggaaaatagttttaccatgtctacaatcagcaccaaaatatcacttgtactaaagtaatagaatgagatgggttacaaaaagcatgtttttattgcaatataggtgcaaaacatttgaaaaggagaggcttttttaaaatccagcttcatttggagtatatctttgatacacagccattgagtcaatctctctagaccattcaaaatgagaatatccaatgcacaaacgtaaatgtgcccaatttcctaatctcctgtaaatactatcacttccctgagagctactggactttggaagggtggattgattcctctgtctcatcacaacgttgggggaaaatgttgtgactccagtgtggatatcctatttatctcccgttgggaaagaagtatttacatgtattatgatgctttgaaatgagatttagaatggttagaggaaaatatagtgcctgggttccagccactgggcagacagattaccatagtgctgtgtgagtaacactttataaatgcatttgtcacacaggagcagtgtcacatgaaatctgattcattgcatgtaatggattaggtgaaattcacttagatttttagcaatgtgtgtaaaataactaacttaacctatctgcaaaccgtattttatctttcaaatcttgtaagtgctctctgggactacacaatgaataggcagttatatttcaacaggtatcgtaaggaacatcagtctcctaccagaaatcatcatgaaaccagcccattcaggctgtttgctttacatagaaaaatgtgtatgaccatacatattatagaattattcactcatatgcatgtggtcttgtgtcaaaaaagttgtcccttattgaggcagatgttctggctaggaaaatatctaaaccaaaaggtctgaatatttgattaactgatggtccttaaggcttaatgccatattttgcttcttaagatttactgagaatgtcatcattgcatctttcttcatctgtccgggctgctgttgtagaataccctacctagcctgggtgaattttaaaaaccaatgtatttcttacagttctggaggctgagacatctgagatcagggtgctgccatgctcaggttctggcaaggggcttctgtccagtttgtagacagccaccttctttctcactgtatcctcacatggccaagggggagagagaaagagaaagagggaaagagaaggggaaagagggaaagagaaagagaaagggaaaaagagaaagagagaaggagaaagagaaagacagagagagagagagagacagagaaagctcccgtttctcttcttaaaagtacactaattccgtcaagggctacaccctcatgatctgatcacctccaaaggtccccaatctcctaatctcatcacactggggattggggtttcgacatatgcatgctagaggaacacaaacactcagtctataggagcatctgcatttccttttgggagaattgtctccttttcattgtgtgaaattgagtgctaaggtagaccaagtcaactgtctccattttagaaagcccaatgggacaaatgtggtctctgtccaagaagcaggcatttgacttaagtctccctagtcagggcattgcctcttgtgcaagggacgagcatgggatggatggcccttgcctaattgctgcagactggtgtgataacgaatggcttccaggagcctctagaatcaagatcagagatcaagtgcatatctttgtatgcacttgatcccaagtgtttatctccacactcaagtggattttgtatctctttccaatgtatttctcccaattccaaaatgagcttcgattgccttggactaaaacccacagtgatatagatgtttccccagtggaaggtgtgtgacaggaggtaggaataaacatttgaaattaagtttcatattatttatctcatgagtatcaatttcatccacaaaaaatgactacaaaggcaacctttataaggaattaagtaactcattctcattttgtactttaagactgtgactatatccagaaaaaccactggactaaatgctaaattgtgtcagtttttttaaaagtaaagtttaaccttgatttaacataatttttttctgaatttatcatttttttagagacagggtcccaccctgcttcccaggctggagtgcagtggcacaatcagagttctctgcagcttcaacctccccagctcaagggatccccaggccttagcctcccaagtagttgggattacaggtgaacacctccatggccagctaattttttttttcttttttgatagagacagagttgcaccaaagtaaattttgacatgaagactgctgtttagttgtgtgatattattatatatatgcattagtctttttttctcactactgataaagacatacctgagactgggaagaaaaagaggtttaatggacttacagttccacatggctggggaggcctcacaatcatggtggaaggcaaggaggagcaagtcacgtcttacatggatggtggcaggcaaagagagagcttgtgcggggaaactcccctttttaaaaccatcagatcttgtgaggcttatttgctatcacgagaacagcacaggaaagacctgcccccacgattcaattacctcttaccagattcctcccacaacatgtgggaattcaagatgagatttgggtggggacatagccaaagcatatctatctgtatctatatctacatgtgtcgatctaatctgtcatctatctatctatctatctatctatctatctatctatctatcaatcaattggggtggttcaggaaatagcagatgtaagaccctgtagaaacaacagctctaggtaaagagtcttggagaacactggtgttctttgacacatacctattctcacctgggaaagagaaacattctactcctcatctaccattttctatcaagtgtttagtcctttgttccctttaaaacaaaaagctgaaattcattgaatgataaaagcagcacccctttttaaatcatatatatatatataataaatacgatatattgtgtataagatatagttttttatccacagttccggggtcataactcccataacccttgctataatgttggggtgcttttggcctcagaagcacacttcagaaaacagaatctctttctcactgaccttctcctgccttccttccacctgccgaaagtaggactataacctttccctgacttttttttttttttttttgagatggagttttgctctgtcacccaggatgaagtgcagtggtgcgatcttcgctcactgcaacctccacctcctgggttcaagcaattatcctgcctcagctagtagctgggattacaggcacctggaaccacacccagctaatttttgtatttttaataaagacagcattttaccaagttggccaggctggtctcaaactcctgacctcaagtgatcctcccaccttggcctcccaaattgctggggttacagacataagccactgcacctggacctttccctgactttactatccatagtaagatgtattatcttttgcaccactgacccactgatatgatttggctgtgtccccacccaaatctcatcttgaattgtagttcccataatcctcacatgtcatgggagggacccggtgggaggtaattgaatcatggaggcagttaccctcatgctgttctcatgatagtgagtgagttctcacaagatctgatggtttcataagggtcttttccctcttttgctcagcacttctctcctgccaccctgtgaagagggatgtgtttgcttccccttctgtcatgattgtaagtttcctgaagcctccctagccatgtggaactacgagtcaattaaacctctttcctttataaattacacagtcttggatatttattcacagaagcatgagaacagtctaagacaccctccctcccctagtagtctgactgtgggacataagacccttattttagaagacagcctgccccataccctggaagaacgactgctgcacagagaggccaagaaggatttgaacagttaggccttgctgtgtcctcttactcacccttctagtgtcacatcatagcctttttgtccaatcacatttctacatagttgtcaatcatgcctatccaatgaaatctggacaaaaaggccaagaagactgtgtttggagaccttctagagagctgaacacgtggaggctggcaggcaggtggacaagaactcacccatgtgcctggagtgtggtgcactccaacactacggggagacactgttgtggtctggatctgcccagacctcaccctatgtatctcttcatgtgactgtttttgtcctttaaaatatcctttataataaaccaggaagtgtaaataagtgtttttctgagttctgtgagccacttcagcaaattaatccaacccaaagagcaggtcgtgggaattaccccaagttgaagctgattggtcagaatttccggaggcccagacttgtgactggggagatggagtaggcagtcttgtgtgaactgaggtggtgtcccctgcagaactgcttgcttgcttggcgtgcggggagaagcccccacacatttggttgtagacagcttctatgtggattgtcattgcagtgtgagagcagaggaaaagcactttgagtttgtgtgtgagtttgttttattctcttgagacaatttgtattaaaatgtgaaactgtggagtcgactctggttgggttggtaaacaggggtgctattattgtcatccagtgaatttcagctttgtgttaaaaccataatagaaattacaagtaaggaatggaactagagtctcatggttctctttccaaggtgagaataggtatgtggcaaaaaacaccaagactctttagactgtagctaccatttctataatactagtgtcctacacctgctgtttccaagatcatcccaattcaggtcatcgttatctcttactctaattattgtgagagactcctaactgatatccgtgcttctagtttctcccttattctgctccgtttttcaaactatagctaaagctacctttaaaaatagaaatctgatcatgacactcttggaaaccatgcacaacttggacggctttccatatctcttagggtaaggtctattcccttaccttgtcctttcctattgatggcccagcctccactcccctggcctcttcacatttcatcccagacacattgcatttatttctatttcctacatgaggcttagcctgttagatctctgggctttctctcatgaagttcatgttgccccaaagactctctaccttctcctcctgttttgaaacaccacatctaccaccaacatgtatattttgcaaaatgtctactcactcttcctgcagtaagcatttcctgtcttctcccatgtttcttcctcatcctttccctgtcaacaaacttcctattgttttactttgctgagttcccttctgaatggtataccccacttgactgcattcttatggggggaagtaaggagggtctgtcattcacctttgtatttctaggacctagtgtaattcctggctcctagcaggtgttaaaaaagtcagcatatatttgactgaataccaaattcaatccactgatgagatacaatgggaccaccagtatctatttcttctgtgaccttcatccctcaatggtcctttgaaaatgctaacccagacattgagaaagaagtctatttatgtattgggggatagttactcaggcaacacagcctatctgtaaaatataaaataaaataaaatataataagatattagaattagactacaccaaaatgacattgattgggttcacattcccactacacaatgcacaaatcctggcacagatttttgaaaatggtaaaatactgcacaaatgtaagacactatcatataggatcatgagaatgcacacacaaataactataatatgacagcatgaccaaggctgtgggtactcattgtgagctttttcaataaccaggagatgaacaaatatcctaaaataatgctattaaccgacgtgttatgaagtcatattctgtgaagtactattctatctgcacaattttgcaaccagaaaaaaaccctataacatttaaaatgtctgcttaaaaatgggaccagactgacatgtttaacgtaaaatcattaggagaatttaagaagtagcaattctggtaattaccaaatagcatgattctctcccagtaaagcatatgtcaaattacagaaaaacatcactatgttgctttcccttttaaagattttacatatgaagcatatgagtttaaatattcccctgctttttgcatattttatttaagcttttttaatgggatttaacgctcctttgttttcactttttttgtgtgagattccaagcactgaaagtttcttttgatctcttcccagtaatttttcaggtaaaaatgaaatatacatatatatatagcttttttgtttgttttgcgaagacatagagtgggagaagaaattggggggtggtgaggcagagttgttttactctcctaagagaagaaaggaaacatttctgcatatctcattcttatagataacacttcccatcacgtctcgtggaactaaggctatttgtttcgttaactaatcgtcatttatgcactccgttattcccggtgaaactcttcagacagcttacaagtattgtcatgcttattattattattactattattattattattatattgctggcactatgttatattctttcagtataaaaataccaatactgagttgatgtcacaaaccacgtgatttcatttttgttgtgttctattcttccaagttatggggatgattactggtttgggccaatatggaagctactgattggaattcagcctatagccacagattaaagaaaaagaaaaaaggaactctctcaggcaatggtagtactcagggtttggcttttctcataaacactccaagtgtttactttgtgagctaattaggaatgagtttcccaagatgatccaacaattgagaaaaaggaaaagaaaaaaacagtctcccaccagaatacaaatatccatgggtttccaattcacagaagcaaaatatgtggactggtttatgaaacacacaccattatcttcttccctcggggaaaagcagcttgctgaacaaacacttcatgtcagagactgttccagccacgtgaaaagcccactgcacaccagtaaaagtcatggctcaaaattatgacacgaatgttcagatgaggaaggatttatatttacaaaagcacttgtttcataaagctacacttttcaggagcggcagcatcagtattgccatggactgaattatgcttcctccaaaactcatacgttggagccctgacccccgcaatgcgatagtaataggaggtgaatccttgggaagacagttgagtttagatgatgtcgagctggtggggtcctcatgatgggattagtgtccttataagcagaggaagagtcaccagagccccctctctctccctctgctatatgaggactaagagaccaggtggccgtctacaagacaggaagagagagttctcaccaggaaccaatcttttgggaccttgataatggacttccagcctccagagctgagaacatacatttctgttcttaaattacccatcctatggtttgctgttgttattgttgttactgtaattatggcagcccaatgatgcaaatctaaacacatgatgcaatatacgatgcaaatataaacccagaatgaattgaacacatccaccctttagtgccctcacctttatagtaaaacttccaccctgaaatccatgcaaatcagtgtcccccaggagagagtatgtacctgagttcctcagtgctcaggttaattcccttaatcgatctgcaaacatacagatgggaagggatgggcacgatcagtttcctaactccctgattatgcagaaaaggaagctggagcccagactgtttgggtgacttgtttgatgtctcacaacaagtttgttgcagagattcaaatacagattgagcatctcacatccgaaattccaaaatccaaaatactcccaaatccaaaacttgttgagcaccaatatcatgcccaaaggatatgttaattacagcgttttaaattttggggttttttggatttggggtgtcaaaccagtaagtataatgcaattatgccaaaatccaaaaaaaaaatctgaaatccaaaacacttcttgtcccaagtgttttagataaaaagatattcaacctgtagaacccacacttttcacttgcaaccagtacaatttcaactataacatgacagattagtactagacttttaacccagatttccttttgttgatgaaaatgcagaaaaggttttgataatcccattcaccgtacaaataatcacatgtatgtatgaatgtgtatgcatgcatgaatgtgtatgcatgtatgaatgtgtatgcacgcataagtgtatgtatgtaaacacatccagacatgtatgtaagtaaattttaaatgcattaatatgtcagcttgataataaattgctacatggtaatattaaagcaatcaataataaaataagaggaaggtcatatcttaaatccttcctgcatttgactttgtctctggtctaaattgatagtcagagacaccatcaataacatcaacagaaagtatgacagatttaactcctggcttcatcagggtcccttttgcaatgagttttgggagctcagacttagctgggtagaaaggaaggaaggacccgacattacgaggggtacatatcataacctttaaaactatgatcctatttaattctcaccacaattgtacaaagtaaatgtcactcacattccacaaaacacttagcagattcgtagctctgccataggaggcactgtgcaacccggtggtttgaactcagcttctttctatcttcacaagatgcaagcttttaaagccaggaggggtgagttatttatccttgtgtctcccccagataactgatatgctaagtactgtatgcattgggttcataaattatgggtctcctttcctgtcacatattgtttaaaagaaaactttccaaatcatttttcaatatatgaagggcactatggtgtgatggtgaagactttgagctgtgaagttgagttgaatcaatttacatcagtatccattgttatttctctccctgcctgactccgcttacactgtttcttgtctttgcttccagctcctggggaaaaactgtctagggatccatttctctgcccctgattttctttgtggggaaatactttctcccaacgtgcataaatttgttgagaagttagctccatatgcctcctccctcttggtgagtgcaaagagacagattttcccaagaaaagaggcagatgtttggcctaagctatatccattcagacactctctccaagaccaatttttttaacttgggctcaaattccccgttcttccctgaaacaattattcctacctatgtaacacttataagccacatacggggacatctccctggaggtaacatcttatgtgtgatctcaggatggaaggaaaccttttttctgctgaattttcaaacgcattgtcatttctttttgaaagtatgaagacatcaaaaggtcgcggagctcaggtaatccgcaggcattgcaactcaacagagtgctctgatgagctggtgatgttaagggcacatgacagctgactgccaaaacaacctctgtatggggaacagaagaaagagacactcatgtggatttgactgaagccaacttcaaggcttcccagtctgaggcatgctgtgtattgatagctggggaataatcatggtgagcaggacagaaaggttgaggaggctccacggaaacaagagtgtcaaatccattgagcaaaaaggccaagggaaaaggctgatttctagtgatagcaaccaaaacgaatggccaaatgatacccaggaaaacatggcaggaggggaatcaataatcacccatttttgtttctaaaatccaatagatgaagaaaggcagtgaattcaatgaatattcgaacacttatttaatatcaagaagggttctagaagccaatgcagtcactgaaagcagtcagactttgaagcagatgctgttggcatttggatcataacctttcagtttgctggaggagtcagccacagctccggtgggcagactgcaaagagttttcaattgggggtatacgagagaactccccaagatgccacagagcaaaatcaagggagattccatttaaaggcaaaggtatggtgaatcaagaaagagagggagagagagagatagggacagacagattgacagagaaggcacacataaggaatccaaaagatattccaaggaccagacacaaagtccttgggcattatttgcacataaaccctgttctgccttagaattgaaccatcaaggtatgcacaaaaaagtctgacttcttcaggaaaatgcaaagtacaagtttgtggccagcgtttaaagctcctctggctatgtcatcaaaccagctctgtctaactgattaggccaattttgcaaaccatcagtggagaaattaatcatgatggtctccagggggcacttcagactttaagcagcacatcctaaatcccacagcccttaatttgacaaagagtcagaaatcacacttgcaggtagcctcagggataatgataaagctgctgcaattcagtggtaaatcggccccatctgtatagtgagttcttgacaaggtctgccctgtatggctctgcttgggaacttctcaggcagtataacatagaggggcatggtaggcccatgggtctagaaacttacgggtgtaagtggacaccccaggaactaccttcactcactaagggatgggattttctagataaatgctccagcttcctttcccctgggctggacaattctgagattgctgccaccatagtccctcgcggaatctccagtgggatgaagatctcattgtccacagaagtagccctttgtcaacacttcttgtattgttatagatggtagaaatctaagatgcaacccaagattccagcctcctgggctcccaacatgtataatccctttcttttgagagtggacaaggactttgaatatgatgaatgtcactcacttgaaccggttaccaattggttgactttgagtccatcagttatcctgggtgggtctgacctaatcagaggagactttaagagggggaagagtcggcaaacagccatgatgataactgcttatgggacaacgtggcaatgaaatgcaggcagaactcgagaagtagagagtggtccctctaacatagctcttacagaaaactgggaactctagttctacaactgaaaggaactgaattttgccacagctacctgagcttgaaggagaaccctgatgtatgcctgtagtcccagctactcaggaggctgaggtggggggattgattgagcctgggagttagaggctgcagtaagccatgatcatgccactgtagtccagcctgggtgacagagtgacaccctgtcacaaaaaaaaaaaaaaaaaaaaaaaaaaaatcaatcaacaaagagaacacggagatttaaatgagtataccttccctgcagtcttgtgagacctgtgcagaggatgctgctaacctttacctggatacctgatccttgtgagagaggaggcaggactcaactccagaggtggggctgggatgcaggaccaaattgaagactagctaaaacaggtcccggacagaagaatcttttcatcggacatgcccaccagtgtgccaggtcagtttgccattgccatggcaacccccgggggttaccaaccatttccacagcaatgacccaatgatccaaaagttgctaccctttctctagaaatttcagcagaaaccgcccctcaatctttatgcaaataaaaatgggtataaaagtgactgtgaaatcaccctgagctgccactctctgcccagggggtagccctgttctgcaggagcagccacggagctgtaacactgctgcttctgtaaattttcttctacctccagcttgcccttgaattccttcctgggcaaagccaagaacccttgcaggctaagccctgctttgaggctcacctctctggcatcatttggaagctctgaggtaatattaataaaagtgtgttgttgtaagtcacttcatttgtgctaatttgttagacagcaatagcacactgatacagttggctttcctcacctcccagtctttttctggccatacctacaaggatcacctctcaaataaactacttttaccaaaattcttctctcagaatctacatttggggaacccaaacttaggtatggttctcaaaaagtgtaaaatcttgatgggtgaatagcaaggaattgaggaaaaatatatgataatattcaccttacctttcttgaagggtaaatgaaatgaaacatggtcttcttttgaactaaaatgttcccaacatttaattgttcccggcatttaatcccaacataattggggctttcttctcattctaactaggaattgttttttcacaaaggaaacaaagagagtataaatttaaattatcatatgaaaaaattcaggaagatgttagaaataatttttggcctgcaaattgatttgcaagatgttgatggaaaatgtttaaggtttattttatagagatgttaaggaagatagtaggaattataatattgaagtggttggaatagcaattctataataaagggaacagatcttcttgagggaaaatactagctacaattttcccatttggggtaaatatcagtatgtttacattactgttcttctcacattttattctaagttattgacgatgaagaaacacaatacaagctaaatttatcctcatgaatgatgttataggaaggtttcttttcatgcagtatattagttttctaggacttccataagaaagttccacagaccaggtgacttaaacaacaaagatttattttctcacggttctggaggctggaaatctgagatcaaggggtgagcacggctggttcctcctgaagcctctctcgtagccttgtagatgccatcttctccctgtgtcctcatgtggtcgtccctctgtgtgtgtctgtgtcctcatctcttcttcttatgagatgtcttagtcaatttcaggcttctgtaacataataccatagacttaatggcttacaagcaacagacacttattctccacagtcctggaggttggaattccaagatcaaggtgtgggcagggctggttcctctcgaggcctctctcctgagcttgtagacactgtcttctccctgtgtcctcaaatggttgtccctctgtgtgtatctgtctcctcttcttatgagatggcttagtccatttcaggctgctataacagcacaccatagactgggtggtttacaaacagcagacatttattctcccacagtcctggaggctggaagtctaagctcaaggtatgggaagggttggctcctcctaaagcttctctcctgagcttgtagatgctgtcttctccctttgtcctcacagggtcgtccctgtatttatgtctgtgtcctaatattctcttcttataaagaccccagtcctattggattggtgcccatcttagtgacctcattttaccttaatcacctctttaaagaccttatctccaaatacagtgacattctgaggtcccaatgtttaggatttaacatataaattttgaggaaacacaattcagcctgtaacatgcagtaaagaattttatatggaaaatcctttcagttccttcagcctctgagctcccgattccatatgcacttagataatttcctaacatgcacatatggtattagagttattttttttaccctgattgtacaattaacatttacacagagagttgctgctgtgagttgtagataagttctcagactcatctatatcaccactttatttcgatcttgcgacggacagattgattctgaatgtcccagaggagagaccataatcaacacccccatattcccgccaagcttgctcactcatcctaggggaggctgacattgcaaagggttcctgattgagaaccacaatgtcttgaccagctgcactttgcactgggcttcagctgacttccagagggcagacctgtggaccaacagaaagtagatgaaaatagagaggaactaagatggatctctctgcgtcctccaaaatttcccttctgccccatctcacttcccccttggctcggccatgtttataaaaagagctgtgataacctcaggtcctaacaacgctgatggcacttttgtaaaaaggacactgcatggcagaatctagattttgtaaaagtatttggatacctcgaggtgcaagtcataaagtcattaaacttgttttcgttgcagcatggttcgatgcataaaaaggttgtgtgaaaggcaagcttatttttgggtttgtgttgtgaatcatctgctctcaccctggggtcctgcacgatatcatcttatttctttttcatgaaaaggaaacaaattagacccagttcaatcatcctgattctcctgttcgagcttacctttctgtctctctgctgatggcagcagaatccatgacatctcaaaagaccctgtttccagataaggtcatattttgaggttctgggtgatgtaaatgtcagggagaccccattcaacccattgcagaatgtctctttctttttcgttgccatctttctatggctctcacctcgtactgacccctccaaggagctgagaagtcgtcttctgcaggaaaaaggagaaagtctgctattctcggcacagcctgttatttttagagtgacactgttcacagagcccaggcccagacagccttgggataaacaatctgtaggatcccatgtcagccgcagaaatgagaacaaaagtgaaaaactctagcaacaggattaggaacctgagccacagccccaaggctcatccttctctgattaacggggctaactgcaaaatatccaggtgttttgttgctttaatcaggtattgtttttcgtcttaaacgtaataagctcagcagcactgttgatctgagttttctctcatttttagcttgtgtccccaggttggaagactacttagcaatgccccttccctgctgtgattctttctagaagctgggtcaccggcatcctcagtgcctgtccatcagagggatgcaggcacaaaaggtttgttcaagggctgcctgccaagtccggggaggccgtcccagcattgagctcacattcaagcagattatcaacgctctcagggacactgatacatgccaaagaaatgtttacagaatgtcttgagatctcattgctggcggtgataagatggtggtggtggtggtggtggtggtggtggcggcggcagctacactccagtcactgcagaaaagcaaagagagatccaatgagtgttttggctgaggaagagggattgagcttgacctgtgtgcaaagcagaggggaggtgacttaatagctcctttcatctctaatgggtattcattcaagtcaaccaggataacacaagtgtatgcacaaatgtatcaccgggatggatgaagatgtgaaaaaaaccagtgacatttgcctgcctttctggaagtcgataccaaagaaaacgtagtaatcatagtgattatggtaaatctgtgtgcatagttagtgatttttctttctaggattgaaaatggaaactccgccttctctcctcccctggggttagaaagtatgcatactttgatttctcatcatcctggcttccttcttcagaatgctgttgctcaaaagctttgtctgtcatcaggttgaacatgttttgaccttgaagcattactttgatcttaaggttaagtctctgatcttcttgtttgaatccaggaacataatgtgtttagatccagatgattagatcccacaatcaccaccttcaattcactcattctttcctgcatccattcattcaatatttgtctagcatgtgctactcataaagcaaccatgtgtatcaggggtttactaagtgtaggagatgttctagaggctagaaaggcattgttaagcaaggcagatggttatgagtgatgacttcctctgaggtagagagcacaaggctatggggaaataaaacaatgtggccttggtctgtctgggaggcagagagcaggactagagagtgtgacttttagcataagcctaagcaatatccaggagcaagagacaggaggagaaggcactggcattgttggtggagttggcagcaaatccaagaccatgagtgaaatggtttggatttgcatccccatctaaatctcatgttgaattttaatccccagtgtaggaggtggggcctggtgggaggtgactgaatcatgggggtggtttctaatagtttagcaccatcctcctagtgctgtctcatcatagagttttcatgagatctggttatttaaaagtgtgcagcacctcccccttcacactctcttcctcctgcttccaccacgtaagatgtgcttgctaccccttcaccttctgccatcatagaaagtttcccgaagcctccacagccatgcttcctgtacagcctgtggaactgtgagtcaattaaacctcttttcttcataaattacctagtctcaggtagttctctatagcaatgcaagaataaacatatacaatgagatatgttaggataagctaggttttgctgctgaaataaaatccatgagacataaatagccacagcttcaaatgttattaatttctcacatcactgtctgatgggggctgggccatctccctaggccttatagctttgccgtctggaactcatgacctcacaggggacacctcacaaggaaagagacagaagaaaaaggagtattgactactcactgcctgcatgtagaaatgccacatgtgccttctgctcacatctcaccaggcagaactagtacttggtgctatgtaattgtgggacagtctgagaaatataggaaaccacatgatatctggtaatctgtcagagctacactatttctagcacaaaccaggaagaagctagctacattggaagactgaaagccaacctgaatgactagggcaacgaacagaggagagacagcatcataaaatgagtttggaaccagaatggaagaccacgccacgcagtgtcttaaggccacattgctgagtactttaagggtaatgggaggagagcagagatggacagggattggtttcttaggtctgaaaatatcttaagtgtacaagagtagatctagaggttacaatcattgactactgatgacaatacataggctaaaatgctctacaaacaagacaatcagtaaaacttcatcattccgaaacacatcaacaaaactttgtaattcagaagtaaatcagcatcctattcaatgtcagtaggttatgcattaatcagtatgtcaacagtctgagaaacttatgttaagattctttgctcagagatggagtctccgtgcatcacaagaccttcttaaggcaggttagtttggaagcctgctgatatagtttggatgtgttttgccacccaaattttatatggaaatgtaatctccaacattggaggtggggcctagtgggaggtgacttgatcatgggggtggatttcttataaatggtttagccccattcaccaagtgttgtcattgtgatagtgagcgagttctcatgatatctgggtgtttgaaagtgtgtcgcatctcccccactctctttcttcctcctgctccagccatgtaacatgcctgctcccccttcaccttctgccacgattgaaagtatcctgaggcctcaccagaagctgtcatgcttcttatacaacctacagaaccataagccacttaaaccttttttaaaaaaattactcactctcaggtatttctttatagaaatgcaagaacagactcacacagaaaattggtgttggaggtggggcctggtgggaggtgattgaatcatggaggtgggtttcttatgaatgatttagcaccatccactttggtgctgccttcataatagtgagttcacatcagatctggttgtttaaaagtgtgtaacacctcccctctggctctcttgctgctgttctggccatgtgatatgcctgctcccccttcacattctgccatgattgtaagtttcccaaggcctccccagtgactgagcagattccagcgttgtgcttcctgtacaacctgtagaactatgagccagttaaacctctcttctttatatattacccagtctcaggtatgtctttatagcagtgtgagaatgggctaatacccctgccaaatgtgacctgcagtttatcaaagtcaacaaattaaaaagctgcaggggtgatacaagtgagaggaggtaagattgtggatgcagtccatggctgtgggcatcaacatagagagaaaagaacttgttggagggatattaaagataagcatgacctgagactaataactgggtttggggcatgcggcaggcagaataaaaatgcacatgtcctaatccttggagcttgtgaatacgcaacctttcttgtcaaaagggagtttgcagatgtgattaagttaaggttcctgagatgggaagttgatcctggattagccaggtggccctgtgtcatcacaagggtccttataagaaagaggcaagagggtcagagtcagagagagatttgaaggtgctattgatattgcagaagaatgatcaatagcatcttcaaatctgatcttgaagaaggaaagcatgagccagggaatgctggcagcctatagacattggaagtgacaaggaaacagatttttccctacagtttgtagaaagaaacactgctattttagtctgttttcacactgatgataaagacatatcccaaactgggtaatttataaacaaaaagacatttaatggactcacagttcaacatggctggggaggcctcacaatcatggcagaaggcaaaaggaacatcttacatggtggcaggcaagtgagagtttgtgcagggaaactcccctttataaaaccatcagatctcatgagacttattcactatcatgagaacagcatgggaaagacctgcttgcatgattcagttacctcccactgggtcgtcccacaacacatgagaattgtgggagctacacttcaagatgaaatttcggtggggacacagccaaatcatatcgactgccctgcctacaccttgatgttaacccaagcaggacttttcatctccaaaacagtaaaatagtacttgggtgttttttaaagcccctaagtttatggtagttggttaccgcagccacaggaagaaaatacaggacagatgaggagagagacagcaggttgattcccaggttgtggaggacaactacatggatggtggatctctcacctggtccttccacagaggagtagttctgggaataaatacatattttcttttgcacaccttgcatttgtaaccatgacagagcaatctgtttcaacttttatgtaacaaagttatgagttgtttttcagttatcatgcatccccagtttaaggtcacctaacctgggcattcccagatgaaccaaggtggaacctaagtccttggaacaaggaatgggaactgaattaagaagcagacactgcatggcaggatccacgatccaatcagattgagccctggtgtcaccacatggcggaatccagtcagatgacgcctcccaccctcacctcattgcaagatccaatcacatcatgcctcattattccatgtttataaaacccaacctatctcccaatcagggagacagatttgagcatttcctcctgtctcctttccttgccagttgagttgcaataaagcttttcttttctcaaaagccagtgtcatggaattggcttctttttgcgtcagacaagagcccattgattgctcagtaacacatttgagatggaaatggatggtagacaattggctagaaatccagagttctgaggccaagttctctgcgctgaggacagagaagagctggtgttcaagctgtttgaccatgggtctgaatgaatctgtgactgccttccggccttagaaaaacaaaatagccatatccgtgcaggctattaatcaactgggtgtgcaagtccttcacacaacagccaacacgcacaccatccttatagatggtgcagatgaacacatagccattgagaacatcttgcagaacatcaatgtttagtgtaccaactatgaacaacacactatttttttacttcagatctcatagcattttcctctggttccttcaaatattttaatctattggtctttctccttctcaacatgtttcctagttttctataaccattgccaagtcctctgcatcttaaaataaactccctctcattttgatagtatggcttccatcagtcacattagtgagagtcattgcagaggtgacagggaaggacagaattcaaacagcatttggtgtaggagaaaataagccagagctatcataaggagagtgtagaggaggaaaaatgaattcctgggcaccagtctatggagatgcagcaaaatcaccaaggggggtgttttctttgattttattttcctctgagttgtggattttaggtttgttgaacaatggctgggtgtggtggctcacgcctgtaatcccagcactttgggaagctgaggtgggtggatcacgaggtcaggagatcaagaccatcctggctaacacggtgaaaccccatctctactaaaaatacaaaaaatcagccaggcgtggtggcaggcgcctgtagtcccagctactcgggaggctgaggcaggagaatggcgtgaacctgggaggcagagcttgcagtgagccgagatcgcaccactgcactccagcctgggcgacatagtgagactctgtctcaaaaaaaaagaaaaggtttgttgaacaatgaaaccaagtctggtgatgcatgtattcatttccaagcaaaatctagtgcagggattttgggggtgggggggtggggcaggtaggggaaagtgggcaggtttatttattcctaacaccatttatgcacatgacactgctttgaatagattcagcctcctttatacctgggaaaccactccctatccagttagcaccagttgccagaaagctctattgtataatatcaaactcaatctgatcgttaatgttacttacctcagccttgtgcctccaagagtttatagatcttgaaataaaagacatcttgtaggttgtaaggttgtctacatttcctcatcctaagaaaaagagaaaagtggcaaagaaggaagaggaggaggaagaagaaaaggaggaggaggaggtggaggcttggtcataacacttagcctctgtggctaagaaagttcagttccagcctgaaacctattcggcatgttgaataatgttctacttctttgagttcatgttatcactggactatcttattgttttaggatgcgtatggctgatactaaattcttattccattccttgagtactaaggtttcgtgaagtaatttgaacacaaaagtccactaacagattgcttctattattgctgtaacctgagcagtattgagttttccttctttctaaggcagacattggcaaatgatggtactggtccaacccagcctgcttctgtttttgtaaatgaaattttatggacatgaagtcatgaccatttgtttacacattgcctgttgctgttttcatgctgtagaagtagatttgagaaattgtggagaccccatggccccaagagcctaaaatacacatcctctggcccttcaccaaaaacatttgttagttcctgctgtagaagatcaatagtcttgtggagcaaagtgtgtagcaaaacagattcctcgtctgtgatatgcttgctgtttaatatttttatgactaccatgatatcgactaagtaaggaaataattgagagaaaatcacaagccattcatgagtactaaagaaaagatttaaaagagagaaaggaaggaaggaaggaggagaaagaaaggaagaggaaggaagaaaggaaggaggggaagaggaagggagggagggaaggaaaaaaggaggaagggaaagaaggaggaagggaggatgggaggaagtgaagaaaagaaggaaggagggaaggaaggaaagaagaagggagggaaggaaggaaggaatggagggaaggaaggaaggaaagaagggagggaaggaagaaaggaaggaagaaggaaggaaggatgggagggaggaaaggtgggagggaaggaaggagggagggagggaagaaaggaaggagggagggaaggaagtaaggaaggaagggagggagggaaggaaggaaggagggaaggaaggagggatggaggaaaggaaggaaggaaggaaggaagggagggagggaaggaaggaaggagggaaggaaggagggagggagggaaggaaggaaggagggagggaaggaaggaaggagaaagggaaggaggagggagaaagggaaggaaggagggagggagggaaggatggaaagagggaaggaaggaagaaggaatggagggacagaaggaaggagggagaaaaggaagaaaggaaggaaagaaggaaggaaggaagcaaggaagggagagagaaaggaagatgccataccaagagcagtgagaccatgtagaattctaccctaaagatgaacaataaaatatgcaagaaaaagtgtttactttcataacataattctctttcctacatataaaatgtctgtctggaccactagatttaaaaaaaaaaaaaaaaaaaaaacttctcctacttatgttcacatacagagtttctttcagtattctgacttcaatttcattctccaacattttttctctgtgatatgggactatttaagtctaacatctgcagttcttggaaaaggcgattgtttcaaacatatctaataacatcttatgggtcttcacaattgaagaggaactatattttactttgaatatgctgacatatattaacatggttaggatttgtgtccccaaccaaatctcatcttgaatcgtaatccccataatccccacgtgtcaaaggagagaccaggtggaggtaattgtatcgtggggtcagattcccccatgctgttctcatgaacatgctgttctcaagtgagttctcatgagatctgatggttttataagaggctcttcccctttgctcagaacttctccttcctgtcaccttgtaaagaaggtgccttgcttcccttttgccttccgccacgattgtaagtttctggaagcctccagaagcctcatgttaaactgtgagtcaattaaacctcttccctttaaatattacccaggctcaggcagttcttcatagctgtatgaaaatggactaatatattcagatagaatttggatgttagttatctgtatttacagtgaaatagtttggctctgtgtccccacccaaatctcatgttgagttttaatccccagtgttgggggagaggcctgttgggaggtgattaaatcatgggggtggatttctcccttgctattctcatgatagagttctcacaagatctggttgttttaaagtgtgtagcacttcctccttcaccgtatctctttcttccaggccatgtgaagatggacctacctcccctttgccttctccaataattgtaagtttcctgaagcctccccagaagcagaagtctgtacaacctgcagaaccacgaacacaattaaacctcttttccttataaattacccagtctcaggtatttttttcacagcagtgtgaaaacaggctaatacatacagcatgaattttgacatgatttgacttccttttgaaatttgataacatatgttaacacagcccactccagcccttctctgagaatgacctgctggccttcatacctatatttctgggacatacacagcatgaaaccacttgggtatttatgctaggtctgacctataaattttagtgatttcatattgcctctaataagttaagatgcagtgactacctttccacagtggtttccagttgctatccaagtttcattgtaggctatgtcaatgctgagaggtgaatatcagttcagaggactttgctagatatctttcttttttctttttcattctttcaccttctgctctgcgcatgataatacccttcaataatgcaaaatggtgcaatagttgttcttcagcaatgattctgccagaccttaacaaccataatctttagcaacaagttcaggaagaattacactttcaacatttcacaaggtcatggagttaatacttatatccatttttcttcatttgtcatgaacatcctaactgttgtatattaccagaccatcaaaatttgtcctattaaaatgcatattagaaaatttaatattcaaaggataatggagtaatttttttccatttctggaaagtgtacaataggaatcagttattcaatgctgatataagaaaaaaaaactcacttactctatgaaaataagcaagtgatcatagacaaacatacatggggcctgaggctggagtgtgggttgaaaagaaggtaacaatgtgcagtgtaatacaaggttagagtgagcagactatggttaacttagaccagggactacatgtcctttttcatcaaggctgccttaggcacagagaactgtccacaaggtccctgatgtctacaaacttcccagttctccgttgtttttgttacaaaattaatttttttaatgaagaaaaatacaaacattactgaaagacgtagaagacacaaatataaatgaagtcatatggcatgattttggatgagacttttcgatattgttaacatgttagatatttcagagttagcatatcaggtttgacacaacactaatgaaaaccacaatggaattttgctctgttctttagattaagaagtgatttttctgatcatctgaaagaacaaacatacaagcacagtcatggcaatttgagtaaaaagatcaatacaggaagagagaggaagatttgaattatcttggtataaatttcaaattattaaaatcatgttatagtataatagctgtgtggtgactgattatgcaaaaaatgaagtagccaaataaaaaacaaatgaaaaagcaaaaaagcaaaagcgtattggattgccttgtaatgcaaggctataagcatttggattaattctttaggaaaaaaaattcatttcttacctaattgaaccccaggattaaatatagttgttaggagtccctcttccagttcaagaaagaatatcactctcatcttaataaacaaaacaatagatatttgttaaaaagatgttttaagttaaaaaaatcatagtttcttaaacatttgtggttttttaggtttgttttcggttttgtttcgttttgagatggtcttgctctattgtccatgctagagtgcagtggtaccatcgtagctcactgcagacttaaactcccatgcttatgggatcctcccacctcaacctccagagtagttgggactacaggcacatgccaccatgcccagctaattttaaaaaataattttatagagacagggtctcgctgtgttgcccaggcttgtcttgaagtactggcctcaagcaatcctcctgccttggcctcccaaagtgctgggattataggcatgaaccattgcacctagctaaaaattttaattaaacctcaggaaacaatgaaacacctataaactcaattccaaaaagtaacagctctatataagaaagaaaatacccctgactactttcatctttgttggagttggagaggcagaggaagctgctaatgtgggaaaggagacactagctaaactttttataaaatgtagtgaccacaggcaggtaggcatatcaggttagacaacttaggagtcctagtctctgaacatatcttcatccacctgccacctgcttcccaaacctctctacagagggtagagtgatagtacatcaaatgtggtggagacaggaagaaagagctgggagacatagctctgcagacacaaggaatctaccccaagttcaaggcagcctctctcagaaggtagggatcagggaaggaagcctgaatgaaaccctgcatggtcatctctgacctttacagagtatgggacaatagccctccaaagactgaaggcagtgtcacaaggtggagaaagttctcttgaggtacagaaagctgggcatgagagacagagcaaataggcatgccagcaatacctgaaaaatagcatcgaaacattccatgaaaaattccagacataaacaattcccaagttttaaattgcatgttgttctaagtagtatgtattattctgttctcacagtactattactacccaagactgggtaatttataaagaaaagaagtttaattgactcacagttccacatggctggggaggccccaagaaacttacaatcatggcagaaagcaaagcaggcacatcttacatggtggcaggagagagagcatgcaaggaggagaaatgccagatgcttataaaaccatcatatctcatgagaactcactcactatcacaagaagagcatggggaaaccatccccataatccaatcacttcccatcaggtctctccctaaatacttgtggattgcaattcaagatgagatttgcatggggacacaaagcctaaccatatcatagcatcatgaaatctgccagcatccctctctgtcctgcctggaacatgaatcaactttcttttcagcatatctatgcggtagacatttaggagccatctcagttatcagatccactgtcctggtatggcagtgcctgtggtcaaataacccttattttcctcaataagcacaagagtggacatgccagcatgttgttataattgttctactttgttatcagttctgttaatctctcattgtgcctaatttataaactaaactttgtcataggtatgtagatataggaaaaatatagtattaatatctatagggttaagtattctctgcagtttcaggcattcactaggggtcttggaacatatcccctttggtaaaggggaaaaaatggagtataatttttctaaagttgactgtgatatgttaaagataaatattgaattatctacagtcatgctttttaacagaactttctgagatgatgaaagttgcattagcctgttggaaatgatataataaaataccagagactgtgtagcttataaacaacactaacatatttctcatagtctgggaggctggaagtccaaaattgagacaccagcagattcagtgcctgatgaggacctgcttcctgcttcatagatgacaccttctcactgtgttctcacatagtagaaggggtaagggaacacgaatcccattcacaaggccccactctcatgaccttatcacctcccaaagtacccactttctactaccatcattttgggggttaggtttcaatacaggaatttggtgagaggacataaatatttagtctatagcagaagtattctacatcattcaatatggtaaccatcagccaccttggctagtgagcacttgaagtgtggctggtgtgattgaggggcaaatttttaaaattgtatttaattctactttctttcaatatccatatatgactagcaagtaccatattggaaagtaaagctccagggtagaggtgggcaacctttttctattaaacaccaggcagtatatagtcataggaggggtccccaacccctgggccatggaccagtactgtagccacactgcaggaggtgagcagtgggtgagcgagtgaagcttcatctgtatttacagtcactccccattgctcacattaccacctgagctctgtctcttgtcagatcagcagcagcattagattctcacaggagcgcaaaccctattgtggactgcacttgtaagggatctagattgtgcactccttatgagaatctaatgcctgatgatctgtcactgtctcccatcaaccccagatgggactgtctagttgcaggaaaacaagctcagggctcccactgattcgacattacagtgagttgtataattatttcattatatattacaatggaataattatagaaataaactgcacaataaatgtcatgtacttgaatcttccctaagtcaatcaccccagcttggtccatcgaaaaattgtcttccacaaaactggtccctggtgccaaaaaggttggggactgctgttctatagttttggatttatagactgacaggcaatgtcaaggatatcatgttggtacatatataactatttaaaatgtaacctatttaaaaatgtagaaacccttcttagctagtagaccatacaaaaccaggtggtgggctacagctttgctatagaataatcactaatatgtgtatgtgtgtgtgtgcatgtatatgtgcatatacatgtataggtatatatgcatgtgtatgtatatatacatgcatgtacatacatatatatgtatatgtacatacatacatatatgtgtattttttagtagagtagataaaaccacatactaagtgtattagtctgttctcatgctgctaataaagacataactgaaatgggtaatttataaaggaaacaggtttaatggattcacagttccacatggctggggaggcctcacaatcatggcagaaggcaaatgaggagcaaagctgcatcttacctggctgcagacgagaaagtttgtacagaactcccatttataaaaccatcagatctcatgagacttattcaccaccacaagaaaagtatgggggaaactgcccccatgattcaattatccccactggccccgtccttgacacgtggggattattacaattcaacgtgagagttcggttgggacacagtcatatcactaagaaagagtcaatccaaaggaaggtatgaaatgagtaatggaattataagaaacaggtagaaaataactgtggtagaattatacctacctgaaattcacacatacattttggttggatagtaaatggcaagactactttgtaaaatcatctgaagtattttttataaagtcagacatacgatgatgccacaacccagcactccttctcctagatatttattcaagaggaacgaaaatacaagtcctcacagagactcttcaagaatgtctacagcaagattatttgtaataaagaaaaacaggaaacaacccacatgtctatgaagaggggaatgaataaacaaattgcaatagagtcacacaatgaatactatagtagtccgatttcacgctgctgacaaagacatacccaagactgggtaatttataaagacaaagaggtttaatggactcacagctccacgtggctggggaggcctcacaatcatggtgaaggcgaatggcatgtcttacatggtggcagacaagagagaaaatgagagccaagtgaaaggggtttccccttataaaaccatgagatctcgtgagacttattcactaccatgagaacagtatgagggaaacggcccctatgattcaattatctcccatcaggtccctcccataagacatgggaatttggggagctacaattcaaaatgagatttgggtggggacatagccaaaccatgtcaaatactattcatcaacaaaagccaatggaggaataggtgcacatcttggtaaatgtttagaaattggacacacctatataatcactatgcacatcaagagctggatcaaaatgagcaaccttgaaatcccccttgtgtccttcccaaggaggtcaattttgcttccttttaaagatttctgtattttccaaactttctacaaaaaaggtaaacatttttaaataaatatttttcagtaagttccttgtctttatggagtttctgtgccgattttcctagaattgagatgctctgctagcttgcatataaaacatgacatatttaaaataaaatattatcttttcaatgattatcctggaactgtcctctgaagcaattcagaatacaattaaagatttaatttaatgtccgtgaaccttaatttctaatttggatataggctggagcaaatagattgtaaaaaatttttaacaaaaattgatattgtttctcatatcatttcctaaggatttgataatttatgctatccttaatgactttgtacctcttcaaagcacattgatggaaattgattttcctgattatttcagcagtctttgggaggtaacatattttagtgacaccctggaaaatctctctagtgtactctctaagttacccaggacaacagctgctacagaaagaaatctcttcataccacccacctttgttcagccagaaacaaaaatagtgctttgattgctctctctgacctacttttgtgaaggagtactaacgacctaaattcccaaagtcgtgggccttggagaaactgtacaggattttccaacccgtcctcataaccttaggccgaattccacttccactgtgctagattcacacaagcctgtacttttcctagagatttgcaaggattttgcaccattcgctttggattgtctatcagatctttatggaagtgtatggctttctattttgtattccaaaaaataatatgtaaccggttcatttaatggcattatgaagtttcagagttaggcaatgcaaaggaggactgagcacaggacatttggacttataaatttgtctgtcacacaccctagccctattagtagttcacagaacccatttttaggaatcattattacatcagaatctatccagaaaaatcagcatccttacctggtcactggccaatgccagcctgagggatacccagcctcccaggtctttcttgagtctttacctcggacatgataggttcacatcattgtttccagtgcttggctttaaatagttgtgtcctgtctcctgaccctttcattcatttcagccaccttcttttctctaactaacacacatagttataatctatagactggcaggtttcaaacattggccctcaattctgactcatttcagagtcaaaagaaccctcatgaaagaccacctggcatgcaggtgcatcaagttccagaagggacccttgactgaccttgccgactttcctctaccttttcatcccttatcatgcaccatcagtaagttctcttcaatctaatatctacgtatgtgtacatgtgtgattacgtttgtgtacctgtactttgttttgttctttttccaaatttgtgcattttcttaatttttactgcaaccacccaacttcacaccactgtcttcttctgcctggactgttatagtagactcccagcaaggtatctcagactccctcatgtgcacctccaatccattctcttcaaggcagcctgagtgacctttctaaaacaaaatttagattgggcaattgggccacttctctgcttaaaatcttgcaattattttatttgtttttttgatttaacatttgggtagtcaaaatgtttaaaatggcctacataggctctacttcgttaatcttgcccctgcttctgtcctccagaacattacattataatgataaaatgttcctgaagagacaccaaagcttataaatggagtcacttaaaatattttcgtaggatttaaagcaatttctactgtttttctgatagctgaattattttcttgagacagagtctcactgtgttgcccaggctggagtgcagtagtgcaatcatagcttactgcagcctccaacttctgggctcaagtaatcctcccacctcagcgttctgggtagctgggattacaggcacaggtcaccatgcacagccaatttttttaaaaaaaatttgcagagacaaggtctcagtatgttgcccagggctcaagcaattctttcacctgggttgagttcctgggctaaagtgatccttccacctcagcttcccaaaatgttgggattacaggtgtgagtcatcgtacctaggctgatagctgaaattttaacctcatggtactgttcgctcaaaaaaaaaagtgtgggataacctgctcccagtttcctgacccagggcaatcacattatgagttcacattgtaagacttttgcagaagacaatttgaatgccttagcatcaattctgtacagaccctgaaggctcatcatagaattaggaagacttcctctctcctaccttcttgtccatctaattgttctgtttcataagccctattctcacaatcaaggacataatcacttttcaatctttatactgtccaaataaggaatggaatctcattaaaataaaatttaaaaatttattggctgttgtctttatttgctagagctgtcataaccagataccaccgactgggtggcttaacccacagaaatgtattctctcacattctggaggctggaagcccaagatcaaggtgtccccagggttcattcctcctgaggcttctcttcttggcttataaatgccaccttctccctgtgtcttcacagggtcgtccctctgtgtgtgtctgtgtcctcatctcctcttcttatggggtgtcttagtccatttcaggcttataacagaataccatagactggggagcttataaacagcagacattgattctcccacagtcctggaggctggaggtccgagatcaaggtgtgagcatggctggttccttctgaggcctctctccttggcttgtagatgatgtcctttccctgtgtcctcatgtggtcattcctctgtgtgggtctctgtcctcatcttctcttcttataaggacatcagtcctattggatcagagccctccgtactgacctcattgtatcttaatcacatctttaaagactccatttgcaaatacagtcacatcctgaaattctgggggttaggtcttccacacatgaatttttggggatgaaattcagcctgtcataagcactttaaatatgagtgcagttcccgatgccctcttccacagcctatccctctgcattattacctgcagaaataactgattggcctgaactcctatgaatatgcagaaacaaccaatcttcgcatcagagtattctaaaagtattaagtgggattggatgcacgtgtctgtgagtgttgcctagaatgtcaaccaatgtcagtgagccttgatcaacatttcctctctaagttcacttttctaaagcactgactgaggaaagatcttaaaactttagacatggaaagattcatttttcaaaccccagtctctagaaaacacattacattaaaacttgaaaaaaaaattagccatgtttcagaagcaaacttcattttgaaggaaggtcaggaaaagatatataatatatatattcatcatttgatagttggacccttgccactggtaggttacttgaaagactattaacagagtcacaaaatcagaatttaaatcgagcccagtttatttcctaccacgtgattttggggaaggctaatcacagaggttagaaaattaattaaacatagaatgaactcacctctatcctttggaaaagtctagaggggatacctttacaaatttacaacagcttgacagagaaatgccagtttcaggaaagaaaaaggctcgctaccacaacctgtaaattgttagaagcaacatcttaacaaatcaaaatggcagttctgttgcacatcctgtaggctagtgagtatgattcagaaataagcatatagttggtgaaaaccatgattcactggacaatatttccagcaagacttcttttactttaaagtaaacactgagtttttttaaaaaatcttttttggggaaagtttacccgctcccctccccccatcctaccttctgttctcacttgattcctgtcataatcctcaatttgttgaatcacaattggttgctgtggtgatgattgcgatatcacaaacaagattatgacttcaagtggggaataaacagcaggcactcgaactcttaacaaatgaaattctatcattatgcaaatagccttcaaataatcaagtgtgacccaaaatgcataattttcttttgtgggatatttttcttcctttggcatagaaaatgcatcatcatccactagattcatttctaacgaaaatgtcatggaacttcaaagatatattttaggttgaaacactctcgtatataacaattaaacatcatcaacatgctgcaaagatcattttataaaatgtaatgatttgtccaaatttaaccaggcaaactttcccaaatcagaagagtaacagcaatcatactgaataattgccaaattatgggtttaaaattaaggaacttgtaatagacatggaatatgcttaacttggcttctgagattacagcagttgctgatcactctcatgtagtgcctaaatcctgaccaaagatacacagacggacagctagataatagatgaattgataggcgataggtatacatatagataatacggataggttgatagattatagatgattgataggtgatagggagatggatgatagatcgatagatagaaaaaatgatatctagtattccatgaaagtctcctctgaccagaaatacatctgaataaatgtggagcgcacacacacacacacacacacacaccgtcttgttattctcatttttatgtgatttgaaggcttaaagagaataaggattgagttgtgtctatggctaataagtttcagagtctgtatttaaagctcaacactcagcactaccccttagggctcaaatcccttgaaaaaacacaattatatatagtcgtaattaccagtaattattatcttggctctatgtaggtttaactgtccagctgtccggtcattgcctgaggagagactcgagctcctaaaataagagaaggtgggagcaataaacgttggcctctgtcagggatgcacaaccaaattgatcatgtgtctggtaaacaaaatatctacaggacatgtggcttagggaaaattttctgtaaaggttccccaactgtaatattctatcatgagaaatgtttttacgcctctttgaatcttggagtttaactcaaagggactggggtgggtagattttacacagaggataggtctcttaaagattttctgataacgaacaccttgatgaggagttcttgggcccttcctctattagagggtaaactcgtgaaaaataagctatacgataggtattatgtgttcgttcttttaaaacacagaatgaagtgacttctgtcataagcccatggtgatttccattgttgttaatacttcaagatacagggacatgtgagttgaaataagtggggaaatctattagagagagaagagacaagcataaaaagctattcatatttctttgcaagacccattcaggaaagttgagggaggtgggggagtgtctgagggttcatatatctacaaaaacaaaatttacttttatttatttatttagagacagagtgttgctctgttgcccaggctggagtgcagtggtgcagtcatagctcactgcagccctcacctcctgggcttaggctatcctcctgcctcagcctcctgagtaaccacaccctgataacattaccattcttaagctattgatgactgctcctggaggtcatgaaaattacagtgaagggtcacccaaatctacgatgatggcatatccctctctattagtccattctcacatggctataaagaaatacctgagactggttattcataaagaaaagagccttagttagctcacagttctgcaggctgaacaggaaacataatgctggtgtctgctcggcttctggggagacctcaggaaacttacaatcatggtggaaggagaagaggaagcagggacattacatggccagagcaggagtaagagagaagaggaggaggtgccacacagtttttaaaccaccagatctcactggaagccactcactatcttgaggacagcaccaaaggaatggtgctaaactatcaggagaaatccacccccatgatcaaatctccccccaccaggccccacctccaatactgggaattacagttccacatgaaatttgggcagggacacagatccaagctctatcaccatcttaggaattgtatcctatgtgtcagtactggattagcccagccgccagccagtaataaggataccatccaaagcaagaattaacaggatgtgtctgtactgccggctgggggccctcactgtgttccctcccacatctgttctgtttagggagcagaagccttggcccatatggtcaggatggcaggatgtctactccaccagcctacgacatctctggtcaacattggcctctcatgactgatcgcccgtgcctgtgtggaaaagagcccttctaggaaagccgttacttggcattccagagatctgttcttcctgtgttgccattagagtcacaagcaggagcaagtacctccaccccatggttcctggaaacaaagaaaatcagtcagctggtggtgggtttctttggcttgtggaaagttagagacgcacttcgatttcatgaggaggttgtaatgagcctggatcataacactgcactttaacctgggtgacaaagtcagaccctgtctcaaatagtagtaataataatgatgatgatgatgatgatgatattgagcatcctttcgggtgcctattggctattcatgtatattttttggataaatgtctgttcagtttctttgcattttcaatttggttatttattctttcattattgacttataagagttctttatatattctggataatgtcccttataggatatgtggctttacaatatttcatcttagtctgtgtgttgtcttttcactttcttgattgtgtcttttcaggggaaaacacttctaatattgataaagtccaatttttcaatttttttcttttgtcatttgtgcctctagtgtcaaatctaagaaatcattgcctaacccaaggtcaggaagaaatattcataggttttcttctaagagttgtataatgtagctcttacatttaggcctatgattcattttgtggcaagtttgcgtatggcatgaggtgtttttttttttaatacatggacgtataatttggaaatgagcttgttttgcctcagataaatgaaacaggctctttgtcgtctcttctcttttatctcttttcttgttttaggtgtctcctcattcctggtcctacataaactcattttgacattcgccttaggcatttcagaatctggccctcacccttatggttttcacatatcatgaacaattttcttcttttaccctcttatttggggtgcctaagcctctcctcaatgaaatggcaaccggttacaaacgactaagccaaggtgacaattacccataattatggcttaataaatatagatgccattgtggtttggttttgtaacaactttattgaggcataacctccatatcttattcacatgcattaaatgtacatttcagtgacatttaggatattcacagagctgtgcacccatcaccatattgtaatttacaacatttccagccaagcacagtggctcacctacaatcccagcacttttagtggccaatgcaggaggatgacttgaggccaggagttcaaggccagcctggggcaacacagcaagacccccccccgcatctctacaaataatgaaaaaattacccagatgtgtgccatggatctttagtcccagctactcaggaggctgaagtgggaggatggcttgagctcaggaggtcaagactttagtgagctgtgatggcaccaccgtacttcagccttgacaacagagtgaaatgctatctctaaaaaatagtattaaatttaaaaaagaacatgtccatcactgtaaaaagaaaactcatgctcattgtcagtcactacctgtttccttcatcccacccttcccctagctctaacaaactctcaaactactttgggtctttatagatttgcctttcctggatagtacatataaatgaaatcatattttatacattctatctatctatctttatttaaatattaattgtgatgaaatatacatggcataaaattaccaccttagagtgtacaatccagtgacattaagtacattgttgtgcaaccatcacaatcatccatacacagaactgttttcatcttgcaaaactaaagctcttcttaaacaagaactccgggcctggcatggtggctcacacctgtaatcccagcactttgggaggccaaagggggtggatcacttgaggtcaggagtttgagaccagcctggacaacatagtgaaacctcatctctactaaaaaaataaaaacaaaaaagaactcctattgcccctacagtatgtgatttttttttttttttagtgactggctttcttctcaaaatttacccatgtcctagcatgtattagtacttctttccttcctccattgtgtgtatatattacattcatctatgcattcatcaggtggtggacatgtgggttgttttcaccttttggctattgtcaataatgactgctgtgaacattcatgtgcaagtttttgtatggacaagtgttctcacttctcttgggtaaatacctaagagtaaaattgctgtgtcacatgcacacgtatgtttactgcggcactatacacaatagcaaagacttggaaccaacccaaatgtccaacgatgatagactgggttaagaaaatgtggcacatatacaccatggaatactatgcagccataaaaaaggatgagttcatgtcctttgtagggacatggatgaagctggaaaccattattctgagcaaactatcacaaggacagaaaaccaaacaccgcatgttctcactcatagttgggaattgaacaatgagaacacatggacacagggtggggaacatcacacgccggggcctgtcatggggtggtgggaggggggagggatagtattaggagaaatacctaatgttaaatgacgagttaatgggtgcagcacaccaacatggcacacgtatacatatgtaacaaatctgcacgttgtgcacatgtaccctagaatttaaagtataataaaaacaagaaaaaaaaattgctgtgtcaaattctatgttaatattttgagaaactgccagactattttatcaaagcggctgcacaacattacactcccaaataatatatgagggctccagcttctccacatccttatgatcatgttattgtctgctgtttttattttaacaatcctagtgattgtgatgtgtgaatgtggttttgatttacatccccctaatggctaatactattaagcattgtggctcatgactataaccccagcactttgggaggccaaggcaagaggactgcttgagcgtaggagttcgagtccagtgagggcaatatagtgagatctcatccctacaaaaataattgtttttaaattagccaagcatggtggtgtgtgcctgtagtcccatctactcaggaggctaaggtgggaggactgcttgagcccagaagtcagaggttgcagtgagccaagattgtaacactgcccttcaatctgggtaacagagactctcaaataataatagtgatgatgatgatgatgatgatgatgatgatgatattgagcatcttttgtgtgtctattggctattcatttatctttcttggagaaatgtcttttcagttcctttgcattttcaatttggtgatatattattttattattgagttttaagggttttttatatattctggataacatcccccataggatatgtggctttccaatattttatctttgtatgttgccttttcactttcttggttgtgtcttttgaagagcaaacacttttaatgttgataaagtctaatttttgaatttttttcttttgtcatttgtgcttctagtgttaaatctaagaaataattgcctaacccaaggtcaggaagaaatattcatagattttcttctagcaactgtataatgtagctcctatatttaggcctatgattcattttgaggtaagtttttgtatggtatgatgcaggggtccagctttattttgtttatatatggacactcaaggcaggaaccacatatatcttatatgtgatatttacccccagcacctagcctgttgccatgaaaatagtaagcacaaaattcagattttctaatagatagatgtttagcttttttgtgtacttttaagttcagggttacatgagcaactttgttacataggtgcatcatgggggtttgttgaacagattatttcatcatccaggtattaagcctagtacccattagttattttcctgatcctctccctcttcctactctccagccccaagcacgcattgctatctgttgttttcttctttgtgtccatgtgttctcatcatttagctcccacttatacctgagagcatgcaatatttttttttccgttcctgtgttagtttgctaaggataatggtctccagctccatccatgtccctgtaaaggacatgatctcattcttttatatggctgcatagtatttcatgatgtatatgaaccacactttcttcatccagtctatcattgatgggcatttgggttgattccatgtatttgctattgtgaatagtgctgcagtgaacatatgagtgcatgtatttttataatagaattatttctattcccttaggtgtacactcagtaatggattgctaggtcagacggatgttttataactgtagagtctatggttccaattctcaaatccagatttcatgcttcagttgttacaaaaagtcagaagacagcagaataagacaggaataagaaataatatattatatatatatatatatctgtatatctcttctactaagcatgatacatgaatggcatttcatttttctcattaaaccttttccatcaactgagaaggcacatattaaaataaactatcaaggatgcaaaaatacctactcatgcactttgaatggaacagtctgaatagaatcaagacaagaggcggactcttcagacaatattgagcatctgctgggttaataataatgttcagttacaccagtccttcattgaattctactgtacccaggcatgaaaatccagcagtttagatggcaccaagaaggtgccacagttaagctgcacaagccagttacaaaatcgcaaactatgcaaaattgatttctagttcagaaaggaaattattatagaattgggtagacataaaaggctggcatgtgaatctcatgcaatgacaccccacctctatgccatgtgtcactctgctatccacatgctttctgtggtaactcgctaacacacggtctgaccttgtatatccaagtggaattatcatttagttactttactgcaaacagcctataaatagttttgcaattataatcttgatttgaaaaatatgaatagaaaaggaataacttccttggggaagctgttaagtgcattattattccatctttcaaatgagaatgcacttttaatcccagccttcctctctgatcagaatttcttttatgcactggattcaacagcactctggaagttcattctccactgcaagcccacagatgcataatcacacaagggaaggtgcttcacccaccacatctgagtctcaattttgcccaataagaatccacttttctcaatgccatgaatcccacaaaatgtacatgtattagtccattttcatactgctatgaagaaatacccaagactgggtaatttataagcaaaaagaggtttaatggactcacagttccacatggctggggaggcctcacaatcatggtggaaggcaaaggaggagtaaaggcatgtcttacatggtggcaggcaagaaggcatgtgcaggggaactgccttttataaaatcatcagatctcctgagacttattcactatcatgagaacagcatgggaaaatctgccctcatgattcatttacctcacactatgtccctcccatgaaacatggggattatgggagctacaactaatgataaggtttgggtggggacaaagccaaatcatgtcattacacaaagctagttgggctgcttttttgaaccactgaaataactcttctaagagatgtgaaaggaaaataagtcttggggaccccaaaatcactaagctaaagggaaaagtcaagctgggaacggcttagggcaaacctgcctcccattctattcaaagtcacccttctgctcactgagataaatgcatatctgattgtctcccttggaaaggctaatcagaaacttaaaacttaaaagaatgcaaccatttgtctctcacatacctgtcatctggaagccccctccctgcttgagttgtcctgcctttccggacggaaccaatgtacatcttacatatattgagtgatgtcttatgtctccctaaaatgtataaaaccaaactgtgctctcaccaacttgggcacatgtcaccaggacctcctgaggctgtgtcatgggtgcatgtcctcaaccttgacaaaataaaccttctaaatgaactaagacctgtctcagatatttggggttcacagaggtaactaattcatggaagaaggttctaatgttattcaatggcttaaaaaaagctaattagctgagactgaactggttgacttgacagacaaggatatagtctgaaagtaaccacaattgatatattagaattagcattttgaatgaactctgttctccagctacttttctctctctttacaaattattttctgaagaaatctggttttgtaagtttttctatgtatcttgattcaaaaaactttgatttcatacttagttagaattgacaagattgccctcaaccacactgcatcgtggagagtaatgacctcctggtgaaaatgaaggatatttataaaattcagctctgcctgccttcataaatccacattttcaaaggagaatgaaacccacacccattgaaccacaaagaatattccccccacttgtcatttttctgtggacttttaaagtaacatacctttcagagtccagaatgctcatttcaaagagatttcttttgttctgttattatcagtgatggaagggcctttattgggagtattctgtaactcattgtaacttgctttaaagtgaatatttcagcttcatacctggtcatgtggtttctcctttagctcttcttgtttgcacagttaagcaggaaggaaaccaaccatttgtacaaataaaagtggagaattaaggtatgctgtcatttttaaaatttctccccaaggggttttactgactgtctaaactgggcttgtgggttatcagttttctgaaattctatggcccaatttgataggtacaattccaaattgtaatttcaagcacaatctagttgattgccctcaaaatgctgaccctgacccataaagactagtcaaggaccacaggatttcagcttccttcttggacaggctgggtgttggccacaccgcaaaagtaacagggacatagctgatgtattggcttttctacacctgctgatttctatttttgtttaaatatttagggcagacagatagttaggtcagcgtcttgccttctctttgtaggacttaattcctagatcaacccaggagccctcttttgagggagtatatccatcaaagctcccatgtaaaaccttgtctctgatttcctttaatttttttaaatttaaaaacaataaaaataatctttctttctctctcttttcagagaagcctagatctcagggactgatgtttcagactgaagaattcacaacactgcattgaaaatattccttcctcctttaaaaacatccttttctcgtgacacccacctcctcattcaaatatagtaaaatcgtgagaagaagacgacaatggagaagctagaatcttgggactggcaacttttcaggagtctctaacaggatggaatcctctaccttggcactattgatatttgaggcctgataatgaaaccgcctttgcaaaattatgacagtaagagaaatctgatatcattgactccatcttacttctgacctttaagctgtccttgctcattcctgggcataggccaagctaactttgggaggaatttagtttatggtttaactttgaaataagaatgattatagtccctccctaaaaaataatcccctcccttttaggggctgaaaccacctttgtaagactaatgaggagtcagaagatagacatagtttctctcatcccttactgctcaggagtcatgtggccaactcacaagatttgtgacctacccaatcgctcctatagaaaacatcactactgttgtttttttctgagttgtttttcaggctgaccccacccagacccaggactcattactgcactgttcctgtggtcctacccagaggtggactcagtgcatggagaccgctttctacacttctattatttcatccccagccaagcagcagtacccattccctatgcccctgcccaccaaattgtctataaaaccctctaacctctaagccttcagggagactggtttcagtgataactccagttctgctgcgtggaccagtctcatgtcaattaaactctttctccattactgcaatgctacggtctcagtagattgattttgtctgtgcagtgggcaagaagaacccacagggcgattacaataattctctgtgatggggctgtcctgtgcattgcacgatggttagcagcatttctggcgtccacccactagccagtagtagagcactcccctacctctaactattaaaatgtctttggacattgtcccctggtggacaaaattggcattgcttgagaaccctatgatgttaagaggtacttacccaaagaatatgcaacaattattattatctgcatagctataacaaaattctccttactaatgtaaaaccctttttctattgtaatgctttaaaaaatattccactttgcattcccaaatcattttactaaaaaagatttactcttctcatttcaaggttttgagaaatccaggtggccttgaatgttagatttatctttttggatagaaaaatcctaagtgttttctgtctcgcagataactggctggctctgtttcacaaagttctgcaaagaatgaacacatgttctattcagtatacagccatgttaaagattccagaagtttttctgctccaatgttaccattggactgaatttaatgaaattgaaattgatcaatggaaaaaaaaactccataaaatattttaaagatgtttattctgagcccataattgatcgcagcccaggaaaaacacaaacccaagaagccttgagtaagtgaccccaaggcggtcagattacagtttagttttagggagacaggagttacagacaaagacataaatcaatatgtggaaggtagatattggtttgacctgaaaggtggaataacttgaagcaggggcttccaggttataggtggattcagagattctttaatttgcagcaggctaacgaactaagactctttctggaacttggagtcagcagaaaagaatggttagattaagataaggaaactgtatgggaagactgatggcctgcaggcatgacttaacctttgcctggcatggcctgaggttctatttataatttggtgtctaattgccacagggtcttgtcagtcttgcggtggagaagtttttaacattaatgctggtcagttgtatctaaattccaaaagagaagaggtataaagaagaatgtttcacttctgatatggtttggctgtgtccccacccaaatctcatcttgaattgtagctcccataattctcacttgttggaggagggaccccatggaagacaattgaatcatggggggcagtttcccccatattgttctcgtggtagtgaaagagtctcatgagatctgatggttttataaggggaaaccattttgcttggctctccttctctcttctctgctgccatgtaagacgtgtcttccgccttccaccatgattgtgaggcatcctgagccgcctggaactgtgactccattaaatctcttttcctttgtaaattactctgtttcgggtatgtctttatcagcagcgtgagaacggacgaatacaacttcccttcctgtcatggccagaactcagtttttcaggattctctggggttccctcagtcaagacaggatctgatcagttggtggagagcttaggattttatttttagtttacaaatttaacaagatgtgtgatcatatagtgttttcgaacagtacttctgataccatctatgtgtcactttcttatcccaattctgcaattctctgatatcaactgggtttccaacagctccattcgattctgacactaacacctcgagttagcacagaccacacaggttaagggttcagtcccacagggctgtcatacttcaagtcccagagaccacctatatttccgacccactggctagaagtttgggggttcccataatgccttcttcaggctcaataaaaattctctagaatgactcacagaacttaggaaaatattttacatcactattactggcttatttacaggataccaatcaagaatagccagatggaagagacatatagagcaaggcatgggggtgaggaggggcacagggccaagaacttccataccctctgcagacactccaccctcccagcacatcagtgtgtgcacccacctggaagctccgcatatcattgcttaagggttttcatagaattcagtgcccagcttcacttccctatggtcaggggatggagctgaaagttcccattctctaatcacaggtttgcccttgctggtgaccggtcctcactctgaggctatctaggggtcccctcaccactcattggcataaactcaggtacgctggaaagggggtccttatgaataacaaaagacactcctctatcactcaggaaatgccaagggttttagaagctttctgccaggccacagagatcagatttttatagcatagtgacaggcaggagcactggcccaatccagccacaatatcagggcctggctaggaggaaaccaccaaaaggggagaagctctgcgtgttttgctgagctaaaggcagcaagattctgcacaactaacattcctaacagctcctagaaatggccaacccctcccatgggcattcaagttgtagcatgtgatagaatttcttttctctttaaggctgaatactagtccattgaatagataggctatgttttatttatccattcatctgtcattgaacattagggttgcttctacttcttggctattgtgaatagttctgcaatgaacacgggtgtgcaaatatctctttgagatcctgatttcagttcttttggatatatatccccacacaaagattgctgaatccttttaattttttttttcaaagaaaatgggcaacatagttgaagtcagcatcggggaatgaaattgctgacacttagatacatttagataaagataagataacaatccagggaaaggagtactttctccacatttatttccccagagctctgtaaacagaaatctgagagacaattacaatttgaggagctggagtccctggaagtcatgcaaattctgtatttacagtagcttccgtgtcttcatttccaaatatttttcatctctacaatgttttcacctaatcaggtttttggggactatttgtgattctattattttacttgaaaaaatggtatgtcgggccctatgtgatgttgtttatcataaaatacctgaggaggaactctggtcctgtgatagtcatttaaaaccagccattaggctgggcgccgtggctcacgcctgtaatcccaactttttgggaggccaaggtgagcggatcacttgaggtcaggagttcaagatcagcctggccaacatggtgaaaccccatctctactaaaaatacaaaaattagccgggcatggtggtgcctgcctgtaatcccagctactcaggaggctgaggtacaataattgcttgaatccaggaggcggaggttgcagtgagccaagattgtgccactgcactccagcctgggtgacagaggaagactcccccttgaaagaaagaagaaagaaagaaagaaaagaaagaaagaaagagagagagagaaaggaagaaagaaagaaaggaagaaagaaagaaagaaagaaagaaaaagaaagaaagaaagaaagaaagaaagaaagaaagaaagaaagaaagaaagaaagaaagaaagaaagaaaaaggaaggaagaggggaggggaggggaggggaggaaggaaggagaatggtagttatcaggcgctgagggaggggtaaatgggaagatgttcaatgagggtagagttttagttgtgcacaatgtgaaaaagtttcagagatctgttgtacagcaatgtgaatatattcaatatatttaatgccactaaactgtacatttaaaagtggttaagatggtaaattttatgttatatgttttttactgtaataaaaaataagtaggaatatattgagttgcacattttaaacgggtgagcattatggcatgtaaattatatctcaataaagatgctaaaaattaaaagaaaaataaatattgtgaattccagaaagtgttatggtctacttaagagaatctcatgttttgcctttacatgtatgtgtacaaatgtgtacgtatatatagattttggcaattatcattcttttcttttcttttcttttcttttcttttcttttgtgtgtgtggcagggggatggtgtctctctctgtcagtcaggttggaatgcagtggtacaatctcagctcattacagccttggcctccaggactcaaacgaccctcccacctcagcgtctcgagtagctgctacacctggctgatttctttagtttttgtagagataggttttgccctgttgcccagtctgatctcaaactcctgggcccaagccatcctcccacctcagcctcccagactgctgggattacagatgtgtgccactgcatctagcctcattatttcttttagaagacatttatcaattgttttcaatacacatcagcattaaaaccttcattttcatgtagccatgcagaaataaaacaagtcattgtcttctctgtggctcatgttgaggaggaaaaacttttcctgtccccgcttaagtcctaaaattgagaatatgtaaactaaactgacaaaatacagatttgcaagagaaaaagcagatcgttatttacttgtatgtgggaattaacagaaaaacatgactcaaggaaagagaatttagggcctatatactatcttagcaatggaaggggaaggggataaggttttgagacagggtcttgctctgttgcccaggctggagagcagtggcacaattatggctcactgcagccttgacctcttgggctccagcaaccttcctgccttagcctcccgagtagctgggaccacaggtgggcaccaccatacagagctgatttttaattttttaaatttttttggtagagacggggtcacactttttaaaaataatgacttttaggaaagacaagtgggcccttatagatacaacagttttgtgacaatgtctggtgttatgccaacttcttgtctctagtgataagagttcatcttccctggttgctccaagaaaggagatttatgagaattgagtcgctcatctgaaaatcatatttatgcatattctggactccttcacttattctggctccccacttctgcctactccaaaactttttaaatttagtgggattcgaattgcctttacttagcaatcaagactttgcatttattggtgacctctgtcatagtctaaccttatcatagcgactatgtgcaaatagtgtccttttatccacatccacccagtggggaaatgaacaaggaaagacagatacagtattggagacagagttaaaggatcaggcccagagaaagcagctttggactaagtcttgaggggctagcaaaccacagcccaacaaaggattgggaaaagggttttaagcagagggaagcttgcgtacaagagtagaaaagccaaaacaggcaggaatctcttaccaactgtcagtatctgacggagccctaggatttgtgtagaaatttctctggattggtagtaatttatggaatctcaatttcctcctctgggcaataaagagctcataagaaatatgagcacagcggtggtgatatgaatatacttgaatataagaaatggcatgctaatggcactctcctatgcctaatttctctcctaaggtccccaagtttgtaaacttatttacttctcctatgctacctccaagttttcccacatacagactctctgtaccttttgtcagtgtacagcgagcattagaatttctaattgcctttgcagaagaaaagaaatatgcagtgtacaattaaagagctgatttcattcaggtcattgcaacagggaaaatgttcattaatgaggagcatctcaaaggacaggattggagcctggggttttgtagagggaagtcgacagataatcatccttatcatctgctaatcttaaggatagaaggaggtgggccttatctggggatactcatttaaccctttcccggaactcaaaagtgtgggggcaatcatccttgtcatctgctggtctcaaggatggaaggaggtgggacttatctggggatactcagttaaccctttactggaattcaaaaatgtgggggcaatagcaaagtcatggaatcaatctaggtgcccatcaacagtgaattggatacagaaaatgtagtacatatacaccgtggaatactatgcagccatagaaatagaattaaatgcctttgcagcaacatggatgcagctggaggccattatcctaatcaaattaatacaggaacagaaaactaaataccgcatgttctcacttacaagtgggagctaaacactgggtactcatagacataaagatggcatcagtggacactggggactactaagagaggaagacagatgagcaagggttgaaaaattaactgttgggtactatgctcagtacctgggtgatgggatcatttgtactccaaacctcagcatcatgcagtatacccagataacaaacctgcacatgtaccctctgaatcttaaataaaagttgaaaaagaaaaaaagaaaaaaaaattgtgaggggaaattgttaactcttgctatgttctgggagcttagggctcaggtaatgttcaacattgtcaccctgctacccatgtgccatggtgatgggcttgacctctacttctaatagagagagagaaacagcacatgtactagggagatctctggtgttcacatagctatatgcacgttttattttagggtgagagggtttgattgcatattttcattaattataatttgaaaaatgtctttcactgttgcagctcattatagataacatcatgtagattttcaagatgggaccaaacatggaaactgcgatcgagtagttctcatatgcatgagctgttacaaatgcattggccatttgtagtcctactccagcggatttttgcccaacaaacacagtgattcaccaaattgaattacgtatttatcctttaatgtattgtatgatgtagtatatttctgacagaataaaacttctattttatcagacattggtgagaattgaatattcccctataatattataagtctgaaactggaagaggggagacctactgaatagctctgtctttacatatttgaaaggatattcctcctcctttacccacctgcttccactgctgggcactgaggatacattcatatacttgtcccttctcacaacgtcaggtgaatgaggcagcaggtgtatttctgaccaaaggcaataggtgtatttctggaagccaaccattataggccaggaaagctaggaaaatttagcattacaaagaagtgactgtgggcactcacatccaaactaaatgtattaccaactcatcttctgttttttgtgatccacagaatgctctggtcaccccaacatggcctggtacatggtccaaaatgtcttgtcagtcacaagcttggatagaatccatccgtatcaccatctgagaaactaagagaggagacgtgtatttcttccagaagaagacaggaagcttatctcaaaacatcagccatggtggagttaagcttgaagggggaaaattaattcaaagcaatcccagagaaatgcagttcaaagaagaaaagaaagttcaaaataaagagaaaggggagaagaaaaatgtaacactgtactccaccctctagaggattcttccttgacgttgggcaactttatgaagacgtatgtgagcaccagagggacagtgcctagaaaaaaggaaagttccctctagattattatatgcagctcacagctctgaggccatctcttggaaaatactaaatttttctttaataagtactgatgctatgtctttttccatgactaataatgcattgtgcttgaaattgttaaactcacaggagagtaaagtcatcacagccataataagatatcaaaatggatatattttaataactttattttttaaagcaactttacataactcgttgattgagggaactaagcagattgattggttccaaggaaaagctttttgaaaaatcacaaatatatagatcaggaaggctgaaatggatatacaaatggagtcttaactggtttctctatatggaatggggaaaaagtcaatcataccacataattcagccaatgtgggacagaaaagaatctgcaaatctctaagaattattttggcatactatctgttaaatacaatctacacagttataaaataattcagaaaaaaatcaaaggctaaaatcatgtaactcaggagcgtgtgctctatgttgaaaatgcatattcttaagcattttttttggccactgtatccccagctaattggacacctcactgtttgtggttgacttgtgataaatccaacactatgctatttccattctaaataccgtgtgactctaaagttaaagtaatttatttgttgtcaatgacacagaatgtaaacacacagatgtgcattatctccatcaagaagaaaatcattgtttgaagcacttaaacacactgtaaatggtcaagctaggttttcaagtctatgcttgggattatttttaaagcctgccacaaagtacaaataacctcattggttgcaaatttattttcttcatctcttttgagagagaaggactcaaaattccattgctgaagggggcttcccatggaaacactgagtggaaatgcaagcagcctctatgagcaaagaccagcctccggttgacagccagacaaggaaatgggcactgcagccatacaactgcaagggactaagtttgactaacaacctgaatgagctttgctgtggatctattaggccttccacaaattaatatatgttgaagtcctaattccccaatgagactgtatttggagatcgggtctttgaaaaagtcttttaattacagttaaattaggtcataagggtgggaccctgtttcaataaggcaggtgccttataggaggaggaagaaacactagagtactctctcatgtgttccctctctctctctctctctttctgccatgtgagaacacaccaagaaggcactattggcctggcacagtggctcacgcctgtaatcccagcactttcggaggctgaggcggatggatcagctgaggtcaggagttcaagaccagcctggccaacatggtgaaaccccatctctactaaaattacagaaattacccaggcatgatggcgagcacctgtaatcccagctactcgggaggctgaggcagagataattgcttaaaacccaggaggtggaggttgcagtgagctgagatcacaacactgcactccagcctgggcggtagagtgagattccatctcaaaaaaaaaaaaaaaaaggcaccatccacaaaccaggaaaagagtactcaccaagaacagaatctgccactgacttgaccttggacttcccagcctccagaactgtcagaaataaatgtctattgtgtaagaaactcagtctatggtattttgtcacagcagcccaagctaacaagtacaagcttggaaggagatttatccccagcattttctgtaaggcaggcagcctgacagacaccttgatttcagccttgcaagctctagaagagagctcagaggaccccacaagatttctgacgtgtagtaactctaaataatcaatgtgtattgttttaagcctcaatgtttgtggtcatatgttccagtatcaaaaggaaactaatacggttgcctcctaaatgttctttcccacagttaagaaagctgaaaactcccaagtgagtctcaaatttttctgcactatgagcaatggctctccttggaagaggtgaggaaatagctccagcaggaacctggggttgttgcccagttataaagatgtattatcttttcataaaatatggtatgagatgtcctcccagaacttctctcttatgacagcttcccactctatccatagcttcagcaaccagttcctactgataaaagaaaaacttcagcagaattaaatttaaaggagtttaattgagcaatgaacaatttgtgaataagttagccctcacaatcacagcagattcagaaagactccagcgtagctacgtggtggaagaagatttagaaacaaacaaaaaaaggaaatgacgtacagaaattaattggaagtgaggtacagaacggctggatcggttacagctcggcatatgccttatttgaacacagtttgaacactcagcggtgtatgaatggttgaagtatggccactgggattggtcaagacttagctattgttacgggtgcatactactaagttagattttcaattttatctgcctattaagctaggttacagttgatccacaaggactcaaatataatcacggagtccttctgaggccatatttagtttgccttaacactgtatagctccacacaggtgcacttggccaggtgtgttttgccaaatcaatgatacattccttttgtctcccacacagtggcttctccgtgaataccttaggaaatgtcccagagctccatcatgggcaggaagtaatcatggagggaacttctcactcttgggagaaagaaatggattgatctatgtgtctcattttttcctcctcctctttccttggatagactatcctgagatggctgtcacttgacttttcaggtggccaccagctgctcttgcaggtgaccaatgtattcttgccatggctaggtcttctctaattcactgccccagccctcttgctgcctgggatggcatgaccaagggaagcactgtcctctaagccactggccctggctctgctctcaggagaaagcaggtgaagatgggcagccctcagcctttgcattctagtctacaatgtatttgagtttgtgttgatgatgttgaactgtacccaagccctgtgatcctggaaacagcaacagttaaagaatttctcccacattttgagttctggaaaatggattactgcaaagaactatccttacccatatgacttagataatactcatgaatgttcccccagtttacataggaaaagaccagacccagaccctccaagtttccattctttgcatcacaattgataactgacgaggtgaacctcttgtccccactaatcaatgggaacaaaatgcttgtgaaccaaacattgggtcagttcttcttctccccaggacctcggactttagctcaccctcaacatacgccaacagaacacccctcctttagggcctcttctgaaaacagcctgctcttggggtaaaccattctctgaactactgtcctataatatcaccctttatccaacttcccctctcctgtttttctctagcctcatttcctcttgcccataaaagaaaaaccctctctgcctaactcttcagacacttgcagacctatagtcagagcattcttgctattgcaataattcatatttcccaattaaaataataggtgaacagtcctcctcaacccttgcaataattatttcaaagaagtcttttcttacttagtccagatttgttttttcattgacactattaatataaaagtaattattctatcccctattccctatgcctccagagacttttttttcctttttcttaagatatggagtctcactcagtcacccacgctggagtgcggagtgcagtggcaccatcatagctcactgcagcctcaacctcctgggctcaagtgaccctctcgcctcagactccagggtagctgggactataggcatgcaccaccacgtgcaactaattcttttttattatttgtagagacaaggtcccaccatgttgctcaggctagtctcaaactcttgggttcaagagatcctcccacttcagcctcccaaagtgctgggatttcaggtgtgagacaccacacctggcctgattatatacttttgaaccatattcataagtaatatttccccccaaaattggaggcctgcatagggttaccagtaaaacaaaaaattaaagggtaccaagtaattactgtaattcatagcataaaggatgtggagggcaaaattgtgtgcttctgcagaaaactgctcgttgtttctatcacacccctactggtattggattctgattctataaagctctgtgccacccatcgtctttgagttattttacaactctgtacgttgcaaatagccaagggtaatgcaaaataattcttgtctctagacatgcaaatttactcctgtggaagtgcaaatgactcccaccacccacaaaaataaaagtctgttttgcctctatttgcacatacatattgatatttttaaacctataaatatgattgttccttggattgttttttaaatgtgttataagaccttcctggtggttcgcacaccaataatgagttaaataacatctttaacactggtttatttttagctatctgagagtcataatttttccttctttggaaattatcctttaaaagatatttttcatggagtggacttagttttaggaaaggaaaaacttcccagggaagaaatattgacaaacttacacctatctattttcccctagatatgtatttgaaattttcatggagaaaacaattacaagataaaactctgttctatgatattgcactcttctatgaagtttgtcagtttcctgaccttctttgctttcttccaatgcaaactggaaatggagcttgaatgtcaagcttgttataaatcttttaaaaaattgataatgcttgtcatccaaacagtttttgtttttgttcttgactctcagtccttccttgctgtaataagaatattctgagaaatgaggcctctggctttcttctctctttcctttaaagaatcttgctatagtttggatgtttgacccctccaaatctcatattgaaatttgatcccgtagtgggaggtgtttgggtcatgggggcagatccttcatgaatgtctgggtgtcatcctcacaataataagtgagttctcactttattagttcctcagaggttgttaaaaagagcctggcacctcctcctctctctcttgcttcctctctctccatgtggtctctgcacatgccagctcccttccccttccatcctgagtggaagcagcctgaagccctcaccagatgcagacgctggtgccatgcttcctgtacagcctgcaaaaccatgaacaaattaatttcttttctctatagattgcccagcctcagctattcttttatagccacactaaacagactaagactaacccagtaagaaatttggcaatggcttgctggatgcaataaggaaaggggtttgcagatagaggaaaaccttgcctgtataaaggacaccagttaggaactgatctgaaggaagtgtcaaaacatgaagagaacacctcaacagtgagcactagcctgtttaatgacatttgggagccatagccttatactcctaacttttactggaggacaagctataattcaatggaggtcttcattttcttctttattccttcctactctgcaacaattactcaagatgattcttgtattgttggtgaagctgtcttttgtatgcaatcgtttgcacatttgtccattgtattaatcagctctcatgctaataatatagacatactcaagactgggtaatttataaagaaaatgaggtttaatggactcacagttccacatggctggggaggcctcacaatcatggcgaaaggcaaaggaagggaaaggcacattttacatggcggcaggcaagagagcatgtgcaggggaactcccccttagaaaaccatcagatcttgtgagacttattcactagcatgagaacagcatgggaaagatctgcccccataattcaagtacttcccaccaggtgcctcccaggacatgtgggtattatgggaggcacaattcaagatgagatttggatggggacacagccaaaccatatcatccattaattggatggttattaccagattaacaacagaatatgtaacacattatttttcaataatgacattcagtgagatcatctttcctttcttcagactgaatgaatgctgtcttctgtgcacttcttctaaatactctaaatgatccattttcccagtaaggaactacaagctaactgtattcattttctaatgcttcgtaacaaatcgctacaaacttggaggcttcaaatgatatatgtttatttccttggagttcccttaagccaagtgtccatgcatggcataggtgggtctttggctggcttttgaaggctgcagtgatcatctcatgtggagcccaggtcttctttccaactcagggctgttggttgaatttattttcttatgttgcagaatgcatgatgactaaagggatctgctgtttcagatctcttgctcctagactttctcttaaaaggctcatcaaattagtgaggtctcccaaatataatctccttaactcaaattcaactgattaggaaacttaatcacaggtacaaaatgacatctacaaaaatccccatagttatgctaaatattataacctagtctctgtcttgacatcaatcacagtgaaaggccctgactatactcaaaggttgggattatacaggacatgtagtctagtgggtgggaatcttagaggctgtgtgataattctgcccctcacacttagcatagaaccagatattctcttataaattctgtgccatgctgtaaaatgacacagcaagtcagttttgtctatgacttaagcaatgtcaattttatttcaaaggtcatctttcttttcaaaagacttaattaacctgcatatacctctaatgagagattttgctggtgtttgagaaatggggtttatgcaagaactgtgttcctctatccattttttaaaaaacttctgctagtagctgatttgatttagactctgaatttcagagtcaggtcagtcatgcagattcaggagagagctaccacataattctcagggttgggaattgtacttgttcaaaatggcaaaataaaagaacatcatgcacagttcagatttattgctgactcttaaccatgcatacagaatgttgagtgaagttcaggcgctaagtaggactcacgacttaggatggaaaccaatagattatagattgtggaacttgagatctagaaaggaccataaacattttttctcaaatatctttattctaagagctgaaagccctgacacattagaggcttcctacaggttgcagaggcagtggattcacacagaagaataacctaggtgtcagagtcccagccccctacatactccaatttgattctgtctactgttgtttgtgggtgacaaccccctacacgctgttgacgtcttgacagccaagaagtgctaagtcacaatgttggaaaccaaagagaaaacataatcctatctgtccgtacaactataatgtatcttcacttgtaattcccagagcacaatgctggccttcgagcctcaggacagacaggaaattaactgaaaaacaactcaaagtgaaaatatcaacagatgcacacaaacttaaaagaacattcagataaaccaattaacatccaaagggttgaggtggaaggaaggtgagtgggaggtatgatgagaataaactgaaaaaggtcagggtctctctgttctagaaaaaaaacgggaaagagaagaatgttggaatgatgattctgttctataaagtcagtccaggttgagcacggtggctcacacctgtaatcccaaaactttgggaggccaaggtgggaggataacttgaacccaggagttccagaccagcctgggcaacatagggatgtcccatctctacaataataataataatactagctgagcatggtggagcatgcttgtggtcccagctactcaggaggctgaggcaggaggattgctggagctccggaggtcgaggctgcagtgcaccatgatctcatgattgcactccagcctgggtgacagagtgaaatcctttgtcaaaaaaatacaaaataaaaaacaaattttaaaattaaaaaatataaagtcagtcctgccctaacatcagctctaggtacatctgattctgcacctgggttcagcttcaggtgaacttgcaacatgatctcttcatggctgtgtttcagcttgtcatggaaattctgagtcactaagcccaaattcctgccccaccttccaccatcttatatcccaggttaataacaaaagtcttgccttgctctccatgtctaaaatcttttcttgccaacctatcgagttctcctgtttcttcaagatttgggccttactttcttcttgttgatttttaccttgaccaaagtctttctaaagcaaactgaaatgtacatcagaagcctctggaggacttgttattaataaaacactgattgcagggccccacctcagagttcctgattcaggaggtctggcatgcaggggtggggttgaagtgagaatttgcaattctatttttgttaagagataggatcttgctctgtcacccaggctggagtgtagtggtgcaatcacagctcactgcagccttgaactcctgggctcgaaggaccctgctacctcagccccctgggtagctgggactactatgcctgcctggagaattcacacttctaacaagcttcctgtagatactgctgcagctggtctgggcaccacactgaatctgaagactaaagtagcaacattatttttttcctatactatctgcttccagcaccaccattgccaaactcaacctatgtggctaaacttcttcaagtgatctacagctggtcaccactatagtcctattatatgccttccccaagtgctgtaaggtaggcattactatccttgttcaacgtggaaactgagcttagacttggagagtaacttgctctttgcacagagattttaaaaggccaagttaggaagccaatccagtatctcctggcttctgtgtcttattatttctcaccatattgctgcaccaaaggttaaccatcttctttctgaaatctggattttgacaaatgctagtttcctttccttcttccatctctttctgatgcttttgaaaggaccagcttataaacagtccatgaggagggaagaacaacatggactgaaggtcaacaatttggaaagcagaaagttcagctgttcctcacctggccaagacatgctgcctgtttttggccggattttcttctccccaccttgtcacgactctaatgctttgttttctgatgtcagtgagcacctgtccttgtgagatggaaaagtgcagttgagagaatgatccaattttgcagctttctctgattggcaaattgagttacacagaggttaattagctttcctaatatctcaagttggccacggtattgaaattagcaaggcggagtgagtaattgacagccctgtgctgtgatggctcaccaattgtcctctatagaagagatcattgacattttccaggttgctcttaaactcattatctgcaaacattaaaatggaccctgtaaacttattatagattttgataaatatattcatttacagaaaatcaacaggcaaaccatctcaagttaattaggtcaatgacagtttagaaccttgaattcatagcagcagtgctctctaaatatgtaagtgcataaacaaaggctggcttgaaatgaggaaaagaatagaaaggaacaatgtgtatctcattgggagggtgttctggaactctgtgaatgaggtaatgcataggccaatgtagcaatccttacccaaactcccgaaccatccactcaaaaatacaaaaaatgaaaaaagaatttcaaactggttgattctcctaaaatgaataagagggaaaaatgaccagagagagaaactgaaaatggtctttttaaacttaattttatccttctggaaactggacctagctggaaaaggtcacacaaaccacatatctcattcaacaaaatgcggcactttgccattttccaatgccctgctgtgggtatttttccccctgaatgaacccaataagttgttcgagcaaaatgtcctatctaagtagggtagcacatctgtttcaatttcctacatttgatctattttagcagtatcctcattgtgtcatgagagctaactgagctatcgaagcctaataaaaatgttacccaactatcttgcattaaaaaactaaaaacttcagaatctatttatcttttggtttaacgtttatcatagcttctctctctccatatacatatagtaatatatacagtaacatatgctatattactataaaatataatttgtataaaatagtatattactatataacatatagtaatatattactgtactactggtaatataatgtatataatatttatatttataaagtagaaatatttatatataattcatatttgtataaaatatttttacatagtgtgtgtatacacagtatatttaacacacactatacatattatatacattatatacatatacactatatatacacacatttaaacatatacactgtattacattacatatgtaatacttacattatatataatacatatataatgtaatataattgatcttattatatatataatgtagatagaaaagagtaagaaaaaagagtgaagttgttttttaatgcaagatatttgggtaatatttttattagactttgatagcacagtggacttctcacatgtatgtgatatttatatatatgtatatgcacacatacatatatatgcacacacacatatatatgtatcttatgtccagtaaagaacatgtttcttgagattagtgtttgtatcacacttaagtttcgtattctatttcttccttttcagaaagtaagacttgatcacaattattttatcctaagcaccttaatacattatttgaaaatcagaggtatttaatagaatttgttgaatgaatgaatgatttaatagccctattgagttattaattgcggtattttcctctgtctccataaacaaagttatctttatatggaaattggtagtttactgaggatttttcaggttttgcaagtactgatttttgggatttgggggtactgaaagtctggcatcctgggagagacccagttttggacagaccaggaatggttagtcaccctgtttggagagattatactttcacttctttttgcattctttattgtcaattcttgctagtgtgttgctccctatgtaacttaatccttccatctttacatgtttccaatttgtcccacttcagaaatgagccatatgtttctctaactgaacaaaagccaccactaatggcccagtgtctaagctatttctccacagcctcctttaaagaactgtgtgttagttaattcaaggaacaaggggaggagaagatagactaccccagtcctcactgacagataaaagtttacattaaagcattaaacagaccgatagttattgggtacctatggggggaaactgcccccgatagtcacataagttcttttctattttccctaagagtcagccagtctgagaaataaagggacagagtactaaagagagaaattttaaagctgggtgtccaggggagataccacatgtcagcaggttccgtgatgccccctgagccgtaaaaccagcaagtttttattagtgattttcaaaaggggagggagtgtacgaatagggtgtgggtcacagagatcacgtgcttcacaaggtaatagaatatcacaaggcaaatggaggcagggcgagataacaggaccacaggacggggcgaaattaaaattgctaatgaagtttcgggcatgcattgtcattgataacatcttatcagcagacagggtttgagagcagacaaccggtctgaccaaaatttattaggcgggaatttcctcgtcctaataagcctgggagcgctatgggagactggggcttatttcatccctacagcttcgaccataaaagacggccgcccccgaagtggccatttcagaggcctaccctcagggatgcattctctttttcagggatgttccttgctgagaaaaagaattcagtgatatttctcccatttgcttttgaaagaagagaaatgtggctctgttccacctggctcaccagcggtcagaatttaaggttatctctcttgttccctgaacattgctgctatcctgttcttttttcaaggtgcccagatttcatattgttcaaacacacatgctctacaatttgtgcagttaacgcaatcatcacagggtcctgaggcagcagatatcctcctcagcttacaaaggtgatggaattaagagattaaagtaaagacaggcataggaaatcacaagggtattgattggggaagtgataagtgtccatgaaatcttcacaatttatgttcagagattgcagtaaagacaggcgtaaaaaaatataaaagtattaatttggggaactaataaatgtccatgaaatcttcacaatttatgttcttctgcgtggcttcagccggcccctccattcggggttcctgacttcccaccacaggtaccctaaggtatttcatcttcctaagtttttttttaatttaatttaaaaaaaatttttttaaatagagacaggatctcactatattgcacaggctggtctcgaactcctggactcaattgatcctactgcctcagcctcccaaagtgttgggattacaggtgggagccaccatgccgcccagccacttttcattttaaacttgtcatgtaacatcctctctgaagatgtacatgcctagtgatagatcctaagaaagattccgtataggtctcctgatgctgttacaaattcccacaaattcaatggcttagaacaacactaacttattattttacagttttggaggtcagaagtcaggagtgggtctcaatgggttagaattgaggtctcagcagggctgtgctcctgctgaaggctctaggggagattttgtctccatgtcttttccagcttctagaggccacttgtgtttcttggtttgtggtcctttcttcaattgtttaaaggcagcagtgtagtgtttcaaattactctttgcttccatcatcacacctttttctcagacccccttaccttcttatagggactctgaggctgaatgcagtggctcatgcctgtaatcccagtgctttgggaggctgacttggagaattccttgagtccaggagttcgagaccagcctggataacacagtaagacccagtctctacaattttttttaattagttgggcatgatggcactcacctgtagtcctagctacttgggaggctgacacaggaggatcacttgattccaagagtttaaggctgaagtgagctgtgatctcaccactgcacttcagcctgggtgacagagcaagactctatttaaacaattttttaaaaagtgtagaggcaaatcctgaccaaggtctaactctgctgtgcatactttacttgatcagatgatgctttgccacccaacaagagtgttggattctgcaatgagcaaaacactgaaccatttggactcagtcttggttaaatgaagggccaggggaatctatggtcagtcaaatagtgcccccccaaaatgtctacatcccaatcctagatggtgtgaacatgtgacataacctggcaaaaaggactatgcagatgtgattaagaatcttgggatatggagataatcctggattatctggtgctgatgtactcacaagagttcttttgttgttgttttgttttgttttgttttttgagacagggtctcactctgtcacccaggctggagtacagttgcacaaccacggctcattgcatcttcaaactcccatgctcaagccatcctcccccctcagcatcccaagtacctgggactacaggcatctgtcaccatactcagctaattttttattttttgcagagatggggtcttgctatgttgcgcaggcttgcttctactcttaaaacagacccatctccttcaaggctcctctatcaaagacaacactcattcttaactgactctttagctcctcaggctaagtcatcagaagaaggaacccactgctttgttgtcccaaatgcctcatcttgctgggtgaacattaaaagaaacatttaccaatgaccaaaacgtgttgtgtaatcaaaagagtgcacacccaaactgagcattttggcatcctttctgatttttgcttagctattttcccagaatgagatgctatttacatatctctaactcatcttaaggcacttttttctgatgttgctaaagaaaagaagaaattcccaaatatcagccaaagactgcaaatattagcatacagctgatattcaactgtttttgacctataaaccaaagtggcaatttcttgtagttcaatctagaaataattcattaactgagaactcactgcatgtttatgttttctttccttattagaatgggaattgaaagagatgagagatggagattttggtttcattgtctgaagtgctttgtattgaattcaggaagtaatggttcattgattcgctgactcactcattctgtgaggatttatggatattcattgtgggtccacaaatgtactgtattgtttggctacaaaacagaaggaagcagtttgtgccttaagggaaaatttgatgtggactggttctagcatgttctagaagaggtggtaaaatcagaaaacttagcacagcatctgtattggtctgttctcacactgctaataaagacgttatctgagactgggtaacttataaaggaaagaggtttaattaactcacggttcagatggctgaggaggcctcaggaaacttgcattcatggcggaaggggaagcaagcatatcctttttcacatggcagcagaaaggagaagtgctgaacaacagggtgaaaaaccccttataaaaccatgagagctcatgagaactcactcactatcatgagaacagcagcatgagggtaaccgtccccatgattcaattatctcccattgggttcctcccaggatacatggggattatgggaattcaagatgagatttgggtggagacacagccaaaccatatcagcaccattcttcactactttgccatttgtgttgtgatgtttttactacagtctcatagtattttaaagagcccatagaacacattgcccagtgtttattcatttttaaaaaatttttagttaaggattggaaggctagtacagcatgaagaagtcaggctggatataaagaagaatgtcctaactataaagcatgctgtccccaaaagaagcaatagacgttcattttccaggaaagggttaatctctacgtgtattctcataaagtacacacaggtgacaatgacatctcaaggtttatttgttgagtcctgtgattctcctccaatgcatcacatttttattcccctgtccctgtggggaaaaataaagatacggaataaagcacttttacaactttcattaactttacacagaaggacgagatcatgtatttggaaggtgaacttgggatttgtaagatgatgagtatatttagtagcatcataaagaataatgacctgctatggaaaatggttaagcaacggcataatgtctccaactctttattttctgggagaaaaaaaaaaagctctaataatgattattatattttataatgggatttagtggttgtctgtgtttagattttctgggattagtgctcggtgccataattgtaatttcttctgattgcagactgctttgcagtctccaaccactcagtttcttctgagcaccagcctctgtgttctttccagtctgatttgaaggcaatgaagcaatctatatttaggcattttgcagaggtttttatttttggctaaatgttaagtatacattttcctgtagtaaatgctgctaacagcaaaggagtaaaatggattttcaggagaaagtatttgaaatctgacttgcctttaatcagtatcatctcatctctgtagcgcaaagccctttaaatgcagataaagaagaaattagaagatggactacatttgctaaagtctatccaaatgccagcaaacatttgatgtggagtacagtaaataacttaaaagattcctccatttagactctaagcagtagaaagtttggtacagatacgggctaccttgggagcacaaacaactcaacatcctaacatactgaatgtctggccctcataggtcaggcatatggaatgcatacttgcctaaatcaaacccctggtcctactttatgtccttattctagttctctcctttccattcttacctgagtttagtgtttggtttgttcatattttactcatttattattcattttctatatttattttatatgtctttctacaccactttttcctttgtggaaaaagatagaggacagatggatggatgagaggatgggtggatagatggatgaattagtggatgagtggtgaatgggtagatgaatggatagattgatgatggatggatgtatgaatggaaagatggatgtatagaagggtgggatagatgaattgatgaagccaaggatgaagtgatgagtgtatagatggacagatggaagtaaacaggtagacacatgtgtggatcgatggatgaacgtatgtaaggttgggatggatgggagaattgatgaagagatggacaaataaataggtagatggatctatagagggaagcaggtagatggatgtgagaataaatggatggaaggaaggatagatggatgaatgaatggatggagagtgggtggatgaatctaggaacagactagtggacgaatggattaatggatggatggatggaagagtgggatggattaattgatgaagagatgacaaataaataggtagatggattgacagaaggaaacaggtagattaatgtgtggatggatggatgcgtggatggatggatgcatggatggatgtatagaagggtgagatggattaactgatgaggagatggtcaaataaatagacagattaatggaaggaagcaggtagatgaatgtgtgaataaatggatggaaggatagaaggatggatggatggatggatggatggatggatggatggagagtgagtggatgaatgcaggaattgatgaatgaatgcatggacagatgtatagaagagtggaatgtaagaatcaatgaagacatgggtgaataaataggtagatggattgacagaggaaacaggtgtggatagatgatggatggatggaaagtgggtggatgaatgtggagatggacgaatgaatgggtgaataaacaagcaagtggagaaatgcctacttacataagtgaatcttttgaataaccatagcattctaccacatgatcatttatttccaggccttctcctcctctctgtcatcatcaacattgccattgctttagtttggttcttcattcctcagctcaaattatttctcttccttcaagtgtctttcctctgagaaacccttctttcttttgccctcctctctctttttcagactttagagactcctttttttctacagccaaatcgtcttgaatataactgtatgatagcacatctcacaccttttgtaatctttcaatctcctttaacaaacagtgagcctctttgagactcttgttttggtattatcttaaaattcctgatgctagacatagtgttctgcgcactgcagtaatagaagcttgcatttatggtgttcctacaatccactgtgtctgttatatatacttctggtatcttgtgtcctttaatcctcctaacagtagtaagaggtaggttctattgtgattctcattttgcagttaagaaagctgaggttcagaggtgttcagcgacttgcctatcacaaagctgataagtggtgggacagaaagaaacaaaggagtctgagtctatagcatgctccttcggcatttttaatggggataatatcttcccaaagggaatgaaaattggttcttggaaggtgaaaaagccattcatgtacgaagctcagagatacagacatacacagataaggagtatatctgttaaatttgcatggggggtgggttaaaaaatgtgtaaaatatttcttagtgggcaatgatgaagaaaggttgaagaacattgagtaacaccatttactctcaagcgctatagcgtacagtctgtcattagaagatgaaaagatggataaatggatgtgcagaagaatacaacttctggtatttgttctggtgcttaagaaatatggtgaacagacactaagatggcactcaaataacctcaatctggtgtgtgaactgccatagtgacttgattcaaacatatagaatatatcaaagatggcaggatgtcacttccacaatgagttacataagacaatggcttctgtctttctagtagagtttcttttgctggctttggctaaaataagctgtcctatagagaggtctacaagacaagaaaatgaggctgacctcttgccaatagccagcaaggaaatgagccattctctccaacaatctgcagggaactgaatcctgccaacattcacgtgaccttggaagaagatcccgccccacgcaagacttcagggaaacccacttgtggtcaacactttgactacagccttgggagaccctgaagcacaagacccatctaagctgcccctggagtcctgacccacagaaactgtcaaataacaaatatgtgttgttcaagctgagaatgtcgcagttatgtgttacacagcaataggtcatgaattcaaggagtttaaaatccttgatttagacccatgagaaaaacccaaggcagctacataaagtgtggattctgtgtgttggtttgctttcacatcacatgagatcaactaaataaagtttagccagacttaaaatttatgtttgcagttgtcttgacttcaaagtgtagggaggtcaccaacttttttactggttgaggggctagaactgtgcaccttaaaatcattgcccagaacagctacaggtaatggttgagctgatttgtttatgcacggatgtgtggcaaactccataataaatgtatttaatgatggttagctagttgcctggcaaggttgatgttttatgtgggtggccagcatcccctgctggactctggtcagcccccgaccagagatttatggatgtacagacagatgactagcagttaccaatggataggaaatagttgattacacactcagtaaatggcaagaggatttcccaaagagaagggctcagtttcactctagagtggaaccagagcaaggggtttgggggcagtggctctgagttttcttgtggttgggagatagggccagggtgaagcatcctgcctgaacatgcattaggatgtgcatggcttaaacttctcccactgctttccaagcgggtagctcccaggctttctcattggcttgtccagctgtgggacaaaaacaaaaggataaggcatagaatttgaaaactatcagtggtcagccattaaaaattgattcaggctgggcactatggctcatgcctgtaatcccagcactttggaagtctgaggcaaaaggatcgcttgaggccaggagatcaagaccagcctgggcaacacagtgagaccatatctctaaaaaaatttttttaattagccaaccatggtggtgcgcgcctgtagtcccagctacttggggggttgaggcaagaggactgctcaagcccagaaggtcaggactgcagggagctatgatcacactactactgcactccagcctgggtgacagagtgagacccagtctctaaataagaaaataatagattcagatcctttattacagttgttacttagagatagagtatattacaatgatcattaagacagagtacatatgatatgaccaatcaggaaaagactaaaatgatcaagtattggtctagcttgactgaggcaggagggtttcacccattctgaaggattcatagcatcacctgatatggtttggctgtatccccacccaaatctcttcttgaattgtagctcccataattctcacatgtcatgggagggacctggtgggaggtaattgagtcatgggggcgggccttggccatgctgttctcatgatagtgaagtctcatgagatctgatggttttataaaggggagatcccctgcacaagttctctcttgtctgctgccatggaatatgtgccttttactcaccttccaccatgattatgaggcttccccagccatgtggaactgtgagtccattaaacctcttttttttttttgttacaaattacccactctcgggtatgtctttatcagcaacatgaaaatggactaatatatcacctttgagatacgaagataaacacaagactagaatggagagaggagttaggacttagagtcccccaacctggatgcagtcatcatcatactatcggtttccaagttctatccttatagataaggtgaacgcatgtcctggtttgcctaggaaagtcttgatgtatacgttgccctcccaatggaattatcaagagtgtttccttttgctccccagaatgtctcagtttggtggatagagtacatgcttttccttctcccctacacatgcataggaactaccataatacacaccagaatctgtgggcttttttccaccattgtggaacttaatatttaagacaaagcaattcaatgttaatcataactaatatcaaaggatggtttaaatgcccactacgaagaactgttttattcatgaagacctgggcacaaagtctcaggtgttcaatctctgaaccgatgctagcttactgtcatacagggctctgtggtctcatgaggctctttcatctttttgtcttcctaaatccagaaaaagagtctgtgaggtagagcaggtattaatatactcaatattgagataaggaaattgaggtttggaagcatagattaatgagtttacgcacatttgtacaaaagagagtttattctaggttgctggaatctataatagtctagtgggctttccattcccacagttagtctgagctgccctgctaacctgtgtatccaatctgggtgtatggaagaaagatagattctacacactagagactggaaacttgtggcacactttgagaaatcttattaatcatttagagaattcataggagaattaactgttagaagatctaataaaaggacagaaaatttgcaatgtgactgccctcctccattacccaccaaagatactcaacgcagagaaagaaatagccttaccttagtttgactgtctccattctgtagccctacataattgctttagaataacattattccctatatccctatggcaacaacaagttctgatgataaaagtcacttgttttgaatttgcttttcaagtctcaatgctaaacttttcagaaatgctacaaccattgaattatcaaagtagaagacagttctcagccaggataagacagaaatttctcttgcaccagttatgtgctttgccgaggaaaaagatgagtcaaagggaaatagagacagtggaaactggaggtgttatctctaatatgtttgctaaccttgttttatataagatttctgaaaatgttctatctcttggtggtgtttcaaaaaggacattgcctgtttcgcattgcatattggatattggacctactgtgttaaacaaaagtcacctacaattttgccagccaaatattctttctatatattttatctcattgttattataattctgaggatcctggaaagttttatgaccacaaaaatagaagaggagtgcttcttctttctttttctttttctttttttgaaacagtgtctcgctgtttcccaggatgatgggtggtggcaccatcagctcactgcagcctcaacctcttggctcccacctcagcctcccaagtagctaggaacacaggcacacgccaccttgcccagctaattttttttttcatagagatgaagtctcagtatctttccccggctgatctcaaactcctgggctcaagcaatcctcccacttcagcttcccaaaatgctgggattacaggccaccgaacctggctgaggcatgcttattagtagctataaatgacacagagccactgtgtggttgaatcagatagccacaccttttattctaatctcttctgacatgggatgtacgtaataaattgcatgtgtcaaacagactaacagttctcccatgaatgtaaactccaagggaaactcagtaggcaacagaaaggagaagtggagctcaataagtttatctgaagctaattgcatgatatactcaagggctggccagctgcaaacgcctgtggagcagctttgagagcatgtgctgaactttaatctttacttacggaaactcccatgattccacaggaattttgcctctgtaaagaccataacatatggtccatttgcagagacatatgtttgagtaatgggccctggagcaaaacattcacaaattcttctcttgctcattttgaaatttctagcatgctgatagtcggtggatagttactctctatctccttggcctctaaaggtagggcatgagtgggtacctttcagatcattgtctctgatgatctgtctccataggaaagaggaaggaaagacaggtcatcaggaactttactcacactgagaatactgttttgctgttaatctgtaaagagcatgaacaactttctcattgccttcggccctagaagatcaaccatctgtcgtatgagaacacatggctactcggtgtaaagtagagtcaaggagattcaggcaaaactattgagtatggaggggctctggcaaagaaagaactcaccctcaccagcaacgtcaacatctggccccaagggggtaccttccctctgctccccaagtagagagtgttgaatgaacatgccattttctactggggatagaagagcccctctgtctctctattagtgatctctgaagatatgtttaattatctctctttgctccaacttcaccaatgctgacgcttcttcagcaacaccaagacagaatacagccaggtacagtggctcaggcctgtaatcccagcactttgggaggccgaggccagaggattgcttgagagcaggagtttgaggccagcctgggcaatatagtaaagaccccctgcccccatctctacaaaacaatttataaaatcagccaggtgtggtagcaagtggctgtagtcccagctactctggagccttagcaggtggaattgcttgagcccaggaaatcaagcagtgagacgtgattgcaccactgcactccagcatgggcaatagagtgagaccctgtctcaaaaagaaacaacaaaaaattaaaattgaaaagacagaatagataagacagatgtctcttaagcttgtcaattccccgtaggggttatgaaccaaaggaggtgaaatggcattgagagagtcagcaacagtacatagggaagccagtgtgcacaccctacctaacacaagaggcttccatactgagggtgactgaattgcagctttttcacagcagggagtctttttttttctcctctgaaaccaaaagtatctatgtagtatccaccacttggatcagtcattggagagactgcacccaacaggatagatgtggctcctgccttcagggaactagaaatgaaaagcatgggttatctacacaattgagcctagtcaaaggaaaactatgggatcttaggagaacacatagaaagaaaattttaccacagtgacagaaattataatgtttttcatgagaaatgggcattctgtagctcttgaaccaccctgcacaacatgatttctgctatgatcagaatgtctgctttcccccaaaattcttatgttgaactctaacccacagggtgatggtgttaggaggtggggccttttggaggtgatgaggtcatgtgatggttaatattgagtgtcaacttgattggattgaaggacgcaaagtattgttcctgggtgtgtctgtgagggtgttgtcaaaggagattaacatttgagccagtggactgggagaggcagacccaccctcaatctgggtgggcaccgtctcatcagctgccagcatggccagaataaaagcaggcggaagaacgtggaaagactagactggtttagtcttctggcctacatctttctcccatgctgggtgcttcctgccctcgaacatcagactccaagttcttcagctttgggactcagactggcttcttcactcctcaacttgcagacggtctattgtgggacctcaccttgtgatcatgtaggtccatattccttagtaaactcccctttatgtatacatctatcctattcgttctgttcccctacagaaccctgactaatacaggttataagggtggagcctcatgaatgggattagtgctcttataaaagggaccccagagagctcccttgcccctttcaccgtgtgaggacacagcaagaagaagcttgtctataaactgggaatgggtcctcaccagacgctgaatctgccacacctagatcttgaacttccagcaactaaaactttaaaaaaaaataagtgtcttgtttataagccacttgatctagggtcgtttctaataggagctcgaatgaactgagatcgtctctttttcacatgctatcttgcaagattaatccattaaatctaccctcacacttacacgactctctgcacttaaggacaaatttgtccactagccatagctactaggaagagaattgtaaagtgttgctctgttttgtgttgtttttaattggggtgggatgagaagaaattatgagagcaacaggcaattttaaagctgtggggtgggcaagcaaagaacgttacaacagaggactggtgagaattaaggaagcagagccggtactgacaacgaattttctgtcttcctagtctgcctaggatgaggacttggctgccacattttagctaacctgccttctggacaaatccccagctgggacctcgcacaatccatcccactctctttattctctcccttgaatcagagcttctccttactagcagggtaaacagaatcttattaaaacatctggctaacgtcaacagcttatctgcatggaaatgcgactgtaaatccatccaccaacaaaatgaatgtgtacaaagtgcaagcagctctccacgccaaaaaaaaaaaaaagaaacaaatttaaaaaatagttcatgggaaacaactgcaagggattgaaaataattttcaagctctacttacagatatttacatcagggcgtgagtgtggtagacaggccatattctatcaactcacctatgcatttatgcaaagaaagtaaacagaactgatattgggagaggtgcctaaactgtggcaccatgtgcgttttccaccttgcatttgtcattttcatgaatcgaggagccctagttttaagactgaagctcttttccttttattgcagctccttgaactccacattttattattattattattattattattactatgacttcctaaatactgtgctttggcactcttcacttacttcctttatccctgtgatagcaatgccagcaacggctgcctactcctcttacaaatcccttgataaaactcacatattacactgagcctcgaaacactgtttgcattgcggctcctatctgctcacttgagtgttttgccaaagtggcgtgctgtcgagaagagtatttactgctggcggtgaggatgtcgtctgcttaagttgggtaaactactcacagagctacactgggagacacacagggatcttccttgcacactacctgttcagagtgaaagggtacagtgtgtggcagatgacaaagacccatcacctccaagttatcagctgcaaggagggtgcttagaaaattgttccctttctctctctctctttctctctctctctctctctctctctttcagtatgaattgagaatgaattgtctctgggtttccttggtcacccattggctggtccagttggaaggggaagcaaagctgaacctcaaaatgatgcacagagagggagatttgccaggtacagtaactgagaagaagaaaacccagcctggactcccctatccaaactctcttttctcccatgctccctgaaggaggatagaggggatgagggaagaatgatcctagagccagatccatagctctgaggttttttcctaaaaggaggttgggatttttgtgggaacaaataaaagaggaaatgctctcctgagagatctgaatctaaagatagaagaagcactaagggtttgtttcggtttgatttgggtttgtttgcttgctttttgaatttaagaaaacaacataggaagcttgaagtttgaaaacattctcctatttttatagttccctgtatttaactctaacataagcaacaacctcaaattattagtaagaacaaatttaatcacacatatagcaacaattcaacaaatactgttaatgattactgactggcaggtaagtaaactgcttacaaagatagccttgctatgcacgatcataattatttgcaaacaccagtttgaccttgacagtgaggagtacaaattatagggttggcactgacctctcatagtcacctgtttctgttgcttatgtggaaggagaatatcttctccaggggtactaggaaccaggcagtttaggtaatgattagcaacaagacaagctatgaatgatccaagtcagagctagaagaaacaacataaacattatatttacatcctgggcaatatagtgagactctgtctctacaaaaacaaaaaaaaaaaaaaaaaaaaaggagacgttagccagaagtagtggtgcgtacctgctgttccagctacttctgaagctgaggcggaaggattgcttgagcccaggaggttaaaggtgcaatgagctgtcattacaccactgcactctagtctgggtgacatagcaagaccctgtctcgaaaaaaaattaaaaataaaaatagacactacatataggaagcaatggtagagtggacaggatggtgatgggcgtaagagaaacctccatctccccctaacagctagacagaagtaatctatgggggtgctgaggatggtattttggctaatgtatagcaattactttccatgcctgtaatggttataacttctactttccagataaagaaatgaagcctcaaaggacatgtaactttttcaaaagatacacagtagccttgctcctagtgtaagttccatgccttcattcctagcctaagtcagaagagagctggcatttcctacagatgactgacttctgctggtttaaggtgttgaccaatttttttttccttatcaagtgattcttggcactttgatttaacaataccttaaccggtaaaacattatccaaagctgtttgaaaatctcgtcataaagcatccagtgaactgccattgtctccagtggcaacaatatctttgaacatcccttgtaatggtgctttaacaaaaacctctgcctcctaaatccttgctggctatttctaacaaaatagccctttctgaggtggtctctcaatatgttttacaaaattgactacaatatttcccccacaatggtggaagttataaagctaaccattgaccttcttattgaaaaatggcattatacatgtcactttggaggtttgaataaatcaacagaaatgcagggatagaactcaggttatagaaaggtgaaggtagtagatttcctgtttttttttttaaaaaaaactaattcatcttttaagaccatttttcagtcttttctcctacatggtttctaatccattgtgaaaattaaggttaattctaagctctatctggtgagataaagagaatgggggacatgggttttttttgtgtgtgtgaacaaccatttcagtaagaactagtctgatgaactaaaagagagagatcagaatgtggccatagagagaactggctcagtccatttagtgatgttcactttagctatgtgcatcagaaaagcgaataccgcatacctgtccagataagtgagtgatcacaggcaaacacacccaaagaacaaccaccaaagtccaaaaattaagcactgcatgcatctccaagcactcatgtatttgttcattctcacaatgctataagtacttatccgacaccaggtaatctataaagcaaagaggcttaatggactcagagttctacagggcttaggaggcctcaggaaacttacaatcatggcagaaagggaagcaagcacatccttcttcacatggcggcagcaacgagaagtgcagtttgaaggggggttaatccccttataaaaccataagattttgtgaaaactcattcactatcatgaggaaagtgtggcgataaccgcccccatgattaaattacctcccactgggtccctcccacgacatatggggattatgggaactacaattcaagatgagatttgggtggggacacagccaaaccaggtcaacccacctccatattcccttccaataattaccactacccagagccaaaataattacattttaataccatagattgggtttctctgtttcaaactctatataaatgaaataatacaatatttattattctaaatgtcttcttttacttaaccttatgtttctgagacgtagccacattgttgtataaactgggtagtttattcattttttacctctatatactattctgctgtatgaagaacacggccttacagagaactgactcagtcgatttactgataaatgtcaacgtcagcattatattggctcttcagagggaaataatcgcattagtcactgtgaatagacacaaatactagcctttcttatttgctttttccctttagtggtcagactaagaaaagagttagtgagtgtcaatgattctattcaactaaccatccaaaaaaatgtaccacattataaacaaacaagcatctccattatggaaatctgatgagagaaaacagatagcatttatatcctccttagcctcttgccccacctagtttcaaatcactgggcacatcaagtttcagaactctccatatgaataggaatgggttgaaaatcaggccacgtgtaaagctgcagtttctggggaaaaaaaaagtgcattgttgtacctttgtagtgctgcctaaagctaaaagggaaaagaatattccattcaggccagaaaggggaagagagggagaaaataaatttcctagaaaactcgtaaaacttctggtttaccttaggtttgaaatgcaagtgagattttatttcctgcaaaaatcagcccttaggtccataaagtatatggggacaggtgattggtttaatcaagtggcattaaaaagttatgtttctgttgatgtgtgacattgaagaaaagtgcacacagcatacctacacaggtaagtgagtgatcacaaggtaaacacacccacagaaccaccaccaaagtcaaaaaatgaagcactgcatgcatctcaaagcacacccccatagtcccttccaataattaccactccccatgccaaaatacttacatcctgggtttgtttgttttcaaactctatataatggaataacacagtatttattattctgtctagcatctttcacttaacattatgtgaatgagacctagtcacattgttgtatagactgggtagttcattcatttttatctctatatactattctgttgtatgacgacacctcaatttatttattcattctactgttgacaaatctttaggtttttttcctgttcttggcttttatgtatagtgattatattaggccattcttgcattgctatgaggaaatattaaaaagtaatttataaagactggataatttgtaaagaaaaatgaaatattaaaaataatttataaacactggtaatttataaagaaaagaggtttaattggctcacagttcttcaggttgtacaggacgcatggtgccggcatctgctcggctgctggggaggcctcaggaaacttacaatcatggcagaaggtgaaggggaagctggcagaagatgaaggggaagctggcatgtcacatggctggagtaacaataaagagagagagaggaggtgctacacacttttaaacagtcaaatctcctaagaactcactcactatcatgagaacaacaccaagaggatggtgctaaaccgtttatgagaagtctgcccccgtaatccagtcacttcccacctggccccttctccaatattaggattacaatttgacatgggatttgagcagggacacagatccaaaccatagcactgatgctatgaacattttgaaccaatcttttggcacacataaacacacatttctatctggtatatactgaggagtggaatctttgaaaaatggtcagcttcttcaagcttcttctatggccagcttttaaagacacagccaaccaattttccaaagcatatgctccctttctggtaactcccaccccccagcaatgtacgtgaagtccgatttttctgtttctttgctaacacttgatgatgtcagtctttctcattttagccatttcggtggtggtgtagatgtctccccccttgtggttttaatgcaaatttctccaacgcttgatgagtttcagtaccattttcatgtgttgtattagaccattcttgcgttgctataaagaaatatctgagactgggtaaagtcactgcatccttgatgtcctgggcttaagcaatcctcccacctctagagtaagtaactaggactacaggcgtgtgccaccacatctagctaatttttgtattctttttgtggaggcaagttctcgctattttgtccaggctggtcttgaaatctggactcaagtgatcctcccacttcagcctcccaaaatgctgggattacaggtgtgagccaccacacctggcttaattaattcctttctctgaagacttttccctctaataaaatacactaatacttttcaaacagaaccagtatcagtcacttataacttagtacaattaagctataaaattcatcttatttatatgatgttaggaatataaacactatgaaacaaaaatttactgtgtacctattaagggaagaaaagcggaccaaaagtcaagttggagaaaataaaagataatttcagcctacttcaataatgggcaaattgctaaatcttgcaatatattactgggtaaaagacattaaatcattcattctatagcagttgaaataatacgagtaagaactattagaataatgaagacagcaacaattcaataagcactgttcactgttaaatactgacaggtgagaattcatcgccttcagaactcatctgactatagctcataactttgcttccacagaggaacaaaaatctcacacaacttttcacactagcatagattgtcatatataaaataagaatggcattataaagtggggtatagaggtaatataggagtaattagttggatttattttaaactgtatgtcttcaccaatttatatgattcttatgaaaaataaatcatgattctatgtaaacttcctgataattttcagtttggacccctattacactacattttcttagcccaattattttcataaatgcttcatttaaataaaatatgattctttaatgaagaaaatctgagtaaactattatatttttatatgaacaaaatgaataagcatcggcaaagaaagcataaattattaattcaaggttacacatacttttcagggctacattcactaatacataaagtctttcaaaaaatatttttattgttctgttaaaaaataaaccctttggttttttgaataattttttgaccagattaaaaattgatcaacttttgctctggaaaataataaaatctgtagcaaggctaaaagattgatttgtggagactgttacaatgaatgtagagatgaaatgagatgttttttctttcttcatctatattcaaatctaccctttatgtgaaagttgagtgaggtccattagtgttatatttacaggtgctggactttatgaattatatacgcctgccaagaatttcccatttagggcttgcatttgcacctggagacttttatctaatttttaaattaagccaaaaatgcatttcactctcaacctcaccagtgaattttttaaaagggatattggcagaggaggaatagcaggggtgatagagattaattcaaatgacagaataggctttaaataaacagaaaatagtaatgtgaggaaatatacaaacaccatcttatttgctgtatcccactctggagaaattccttttttatcaatacatgttgctgtaaaataatcttgcagacttaaatttcacaagacagggagtttttgtgcatccacccaattcaaaattgctttcaagggagctggcatactgagacaattttccaggcaataagttggaatttcccaatttcacctaaaggagaaaatagaaatacttgaaatctattatgtcttgctcaagttggtgatggagtgatctctctgatttacaaagtcccctctctggaaactctagtcgtgccgttctattttttacttcaggaatttttaacccaatgactatttttaagaactatcattggaaatagagaaagacggaaatacatttgggaaaagaacaaggaagggaggcattggcagacatgaagaaaagtgttcacagtttagaaaagattaacaggaatgaggcaaagtccatttctaaggagttaacttccagctgtggccaggaagatcgctgggtgcctgcagaatgccctgcagtgttctgatgaaaaactgtataaggctatcttgtgggagccacataaccatggccatcagggaggagtggtgaataacacgttttttaatgagttttgcggattaaataaatgaaagatgtcagacattttcgtcttcaatcaatcaagtagtctctttcagggaccatgtttagtcctgagagatggaaaagataataattcctagtggtaaaatgagaaggatgtggaatatgacaaagtaagagtagcctaataaaacaatgcatcatacaacacaaaaataattaaaaatagacatgttgttcattcagtaaagagtaattaaatgcttacttgaaacaggtgccttgtatgataggagacacctggaaaacgatcagttaagacctgtatcgctacaagctcattttccttgagtcctgttaaaagagttttctgtaatgttagaagttgaaaaggaaatacagcatttccctccatgtctgagtgcttttctacatatataatgttgccatgaatatttttttcaagtctagactcagttccagtaggtcagttcctggtatgtcacactctcctagagtctccagataatgaaaataatcttttaaaactgaaatgatgaccttgtttctaaaacacctactatatgccaggaaatgtgttacggactttaggtataatctgttttattcatttaaccttcaaaataatcctgcatggtgtggatcatttattgtgtctttacagaaggggaatctgaatggaaaataatttgatatatctaaacttccaagaaagggctgaagaatctgaactcagtccatcttaggcaaaaactgaagctcttttaacttgtctgcctctaatggattcacaatcaggtacccagtgatatgacctggctctgtgttcccacccaaatttcatcttgaattgcattctgaattttaatccccacgtgttgagggagggaccttgtgagaggtgattagatcatgggggcagtttccccatgctcttcttgtgatagtgaatgagttctcatgagatctgatggttttacaagggacttttccccacttcgctctgcacttctccttcctgccaccaagtgaaaaggacatgttttcttccctttccgccatgattataagtttcctgaggcctcccagctcaggggaactgtgagtcgatgaaacctctttcctttataaattacccagcctcggaagttcttcacagcagtgtgagaacagacaaatacaccaaggaagactgaaaacaatttttcttcttcccttttccatttcaacacagccatgacattatattgcaatgatgggagagaaggcatgatttaaaacaatggttctcaagcttaaacatgcatcagaatcagtgagaatgggagtccacaagctttttctgtaaaaacccagataataaatatttctcattttgcagttcatatagtctctatcacagttattcaaccgtgctcttgtagcacgagagcagtcacagataatacaaagtgaatgagtgattgcattccaataaacctttattcacgggcatgaaatctgaatttcatataatttccatgtgttgtgaattattcttcttctttgtaattttccctaatcatttaaaactgtgaaagttattcttagttcagaggcatgaaaaagcaagtggttgttctgctactggaaaggggtccggatccagaccccaagagagggttcttggacctcatgtaagaaagaatttggggtgagtccataaagtgaaaacaagtttttaagaaagtaaaggaataaagaatggatactccataggcagagcagtggcttgagctgctggactgagtatacttatagttatttcttgattatatgctgaacaaggtttggattattcatgagttttccaggaaaggtgtgggcaattcctggaattggaggttcctcccctatttaaaccatatagggtaacttcctgctgttgccgtggcatccgcaaactgtcgtggcgctggtgggggtgtcatttaacatgctaatccattataattagcatataatgagcagtggggatgatcagaggtcacttttgtcaccatcttggttttggtgggttttggcagccttctttactacaacagttcaggtttggcccccaggtgagaaccattcatctacatggtggatgaagaaaacagttcaaaaatgagcttatgggccggttcttcttcaataaagtgctgatgtttctattattttcatattattttcaaatgtgcttgtgctacacgtactttcttctttaatcaaatcagttgccaacatttgaaaatttggatatttacataaaatctgaagttttgggactgttcttgaaaaatgcagagaacaagcaatataaaagctgcattcctgcctggtaatccttgctccactcaggaagagctgatgccccatatgaagagccatggtcttttcctagttggtcattgtattacttcattcttatactgataaaaagaacttacctgagacagggtaattttgaacaaaagagtttaattgactcacagttctgcaggctgagcaggaagcataactggtaggcctcaggaaacttacaataatggcagaggcaaaggaaaagcaagcacgtctcaccatggcacaggaggggagagagcgaagggagtcagtgtgacacaattttaaacaaccagacctcctgagaactcactcactattatgagaacagcaaggcagaaatccacacccatgatccaatcacctcccagcaggtccctcccccaacactggggattacaattcaacatgagatttgggtggggacacagagccaaaccgtatgtcattttcgtcctttatttatctggcctctgtggtttgccttcaccattcctaaagtacactaatagaaaaggaacactctaccttacatcagagaacttattaaataacacatcatttgtgccaggcatggagccatatatcatatagatgtacacagatgaccctagaacaatctaggtttgagctacatgggtctgcttatacaaaattttttttttaataaatatgttggaatttttttttattgagattgtgacaatttttaaaaactcacagataaactgcatggcctagaaatattgaaaaaaataggaaaaaggcatgtcattaattcacaaaatatattcatgtcacgaatgcataaatcacacacatttgttaacacatatgtataacatgtacatatgataaacagttggctaacacatacgtgtgtgtataacataaacagttggttaatacatacatatgtgttaacttatgtatgtgttaaccaacagtttagttataaacatacatgataaacagtcagttaacacatatgtatgtgttatacataaacacataagtatgtgttcatgttatcaggaaggctggccaacaggaggctgtaagtagttaagtttttgggggaagtcagaagttatatgcagattttgaactgtgcagaaggtcagcacccctaacaattgcattgttcatgggtcaattgtatataaatgtattcatttatccattggccagctatgtaggcatagtgtcttagtctgttgttgctgctataacaaaatatcttaggctgggtaatgtataaaaacagaaacttatttcttacagttctggaagctgcgcagtccaaggtcaaggcacctgcatgtggtgtctactgagagccttcttgctgcaccctcttgtgtccggaattggtgggttcttggtctcactgacttcaagaatgaagccgggaccctcgcggtgagtgttacagctcttaaggtggcgcgtctggaatctgttccttctgatgttcggatgtgttaggagtttcttccttctggtgggttcgtggtctcgctggctcaggagtgaagctgcagacctttgcggtgagtgttacagctcttaaggcggcacggctggagttgttcgttcttccctgtgggctcatggtctcgctggcttcaggagtgaagctgcagactttcacggtgagtgttacagctcataaaagcagtgtggacccaaagagtgagcagcagcaagatttattgcaaagagcgaaagaacaacgcttccatggtgtggaaggggacccaagccggttgccactgctggctccagcagcctgcttttattctcttatctggccccacccacatcctgctgattggtagagcccagtggcctgttttgacagggcgctgattggtgcgtttacaatccatgagctagatacaaaggttctccgcgtccccatcagattagttagatacagagtttcgacacacaggttctccaaggccccaccagagcagctagatacagagtgtcgattggtgcactcacaaaccttgagctaaacacagggtgctgactggtgtgtttacaatccctgagctagacataaaggttctccaaggccccaccagagcagctagatacagagtgtcgattggtgcactcacaaaccctgagctagatacagggtgctgattggtgtatttacaatccctgagctacatataaagactctccatgtccccaccagactcaggagcccagctggcttcacccagtggatcccgcaccggggctgcaggtggagctgcctgccagtcccgcgccatgcgctggcactcctcagcccttgggcagtcgatgggactgggcgccgtggagcagggcgtggcgctcatcgggaaggctcgggctgcacaggaacccacggaggcgggggaaggctcaggcatggcgggctgcagtcccgagccctgccccgtgggaaggcagctaaggcccggtgagaaatcgagtgcagcaccagtgggctggcactgctgggggacccagtacaccctccacagccgctggcccgggcgctaagcccctcactgcccggggccggcagggccggccggccgctccaagtgcggggccagccaagcccacgcccacccggaactccagctgacccgcaagcgctgcgcgcagccctggttcccgctcgcgcctctccctccacacctccctgcaagctgagggagtgggctccagccttggccagcccagaaaagggctcccacagtgcagcggcgggccgaagggctcctcaagtgctgccaaagtgggaacccaggcagaggaggcgccgagagcaagtgagggctctgaggactaccagcacgctgtcacctctcactctcatagcaagacagaatacactcactccctcaagccattttataagggtcatggtcccatccgtgacactccaccctcatcacctaaggctccaccccttaatactatcacatgaccaattaaatttcaacatgtgaatttggagggacacatgaagaccctcgtacatttgctacctccatttactaggtacaaaaagagaattacaaggttaaataaattgcctaagattacacagctgacatgtaggaaagacaattgaatgccagatctgtcttactctacattgcatggcctcttctctacatattaagcctctaacctctcaagcacagagcaaaggaaatatctcccacagcaactgctaaatcaaaacatgaaaagttcgctttgtagatgtgcaataaaatatacggcagcaggttgtttaccagaaatgaatatcgaattttatacattttgtatcacttatagtttcatggctttttaaaaatgcagcagtagcgtttcttaaaaaatgcgttcctttgcaaaccttgcataatattttattccccaacacataattgcataccaatcagttttattttttattcttcaacaggcaatatttctttaaaatatctctgatttgggtcttcaaaaaacaagctacgtcttgaataggagaatcagaattgatgttgttaaagactggctatgctatttggaattgccatgggagactggtactgcttcaaaggttatatgtcaaaaccacttcagaaatttataaacttcaggaatactatatatttatggaaaaatcagcatgattaatagttgttttaatctatgtgatgttataaaagtacacgtaacataccctacattgcaatatatatagatgacaaagcaatatatgctaggggaagtttttgtaagtatataagctaatatattttatgaaatataaaataatactgctataatttttatattaaatattgtatttatatatttttatattataattttatatattaatatataaaatatattatatattaaaacttgtgatatatattacaacttgtgatataaattaaaacttattttttaatccatacagtgtcataaaagtgtatctaaagcatgctctttgtagtacatataaatatatataaatataagtatatataaaaatgagtacatatatacatatatacagttactatatatggtataaatatatactgtgtaagtaaatatatatgcatacagtaactatatatgtatatatagcaatgcattgcttaacaatgggactacattctgagaaatgggtcattagatttcatcattgtgcacatcacaatgtccttacataaacccagaaggtgtagttactacacacctagactgtatggtacagcctactgctcctagactgcaaaccttcacagcatattactgtactgaatattgtaggcaattgtaacacaatggtatttatgtatctaaacatatctaaacccagaaaaagtatagtgaaaacatgatattataaccttatggggccacgatcatctatacagtctattgttgactgaaatattatatgttgcatgactgtatatttatatttacatgtatatagacataaaacaaagagtacattttagatttatttttatgacataggaatttaaactgtttatgaagagagtcaaactctgtaaaatatttgaagagatttactctgagccaaatacgagtgacatggcctgtgacacagccttcaggaggacctgagaacatgtgaccaagactgtcggggcacatcttcgttttacgtttcagggagacatgagatatcaatcaagtacatttaagatatacattcctttggtccagaaaggtgagacaactcaaagttgtaggggtgggggatgggaggggtggaggccttccaggttataggtagatttaaaagttttattatgaatagaaaggaaggaatgtctgggttaggataacagattgtggagaacaaagtttcattatgcagatgaagcctccaggtagcaggcttcagagagaatagacggtaaatgtttcttgtcggacttaaggtctcttgatgttaaatgctggtcggctgttcctgaattccacaagggaggaaggcataatgaggtatgtccgaccccccacttccggtcatttaactggaaccagtctttcaggttaaattttggagtgctctggcccagaggaggaagttcatgccatggttggggagagggggcttaattttgatgtaaaccacaattgttcacaattgtttttaacaagtgaatttcgggtaacacatgaagaccctagtacatttgctatctccattttctaggcacaaaaggagaattacaaaggttaaacaaattgcctaaaattacacagctcatatgtaggaaagacaattgaataccagatcacacatatcaggtattcaattttaatctacaatatgcatacaatatataaatatatataatataaatatgtatttgtatctaaatagatattttatattatatatatacgtatatgtgtgtgtatagacatgtatgtatatatatatatttcacacacgtaagacattcttatcagaactcgtattgattatgagaaccatgatccctggatgttactctatgtccagttatttaattaattttcaagagctatatttttccgttctgtgatcgcacagtgtgtgtgtgtgtgtgtttgtgggcgcacgtgcactatttctctggaaccctttcagcggttttcccacaagattcagagttacacagagttggggccgtgggatgttcattgttgcccctccagtattgatcccagcccctaaaatatattctgtactccttgcatgctcagtaaatgcacaataatgtcacccctctaaggcacagccagcagttttgcagctattgtgtgcaatgaacacaccaaaacctgcagaaaagccttttaacccgaaacaactgttatttggattagaaacaaaaagagaaaatcctgtctatgaacactaacactaagattatcatctggaagaaactgaagagctgaattcacatttaatgtattttccagtataatttatatataataagaacattttaatgtgtatgaaacttttctttttattcttttctttcttctttttttttttttttcagtagcttttgcccctttcaagtggagtcctgcctttgaccacattgcgggagctcaatctcttcactgaattgacagatcaaaagacctaggaattttttccagaaatcctggcattgttaactacactccggcctgccatgtttgtctgtgaaagtacaggaaactgctttgaggagatgcaaaaggagataaatgtgagtgacaccgttaacatttaaaataaagggaaatgccagtagagaccaggaatggaaatgattgtctttttctctgctggttaaatgaagaaccctgtccacgctccttctgtgatttaaatgtaatttctcttttatttaatctttggagggattttcgtttgtctacatggaaagcataagttctctcttcagttttcagggctgtagatggacttaggagtggcaataaatgattgcaaatagatgcttagtgggtaaagtcttattagcgcaatggctcagaagtgctgaaaacaaagatttttaaaattcaaacaggccgaagtggagaaaaatatacttaatcaaattcacaatgtctaagtagtacataataatgctatatttttagagaacaaaagcactatctttttaaaaggaaagttaaaacttttgctctgaacacatatataaatactgaaaataactgtcatttaatccaaaccttggttaacataggcccgacattttcctgcatcacgaacccaaagcccttcagtgaaaacgctacattgttttgttttgtttctcttggtgcattgaaacatgctttgcagttttccctgaacatgttcttctgtcagatttgccctgaagtgttcaaccaactcatttcatgcttacccagcgtttcctgtttggataagtattagaagaaactaacacaagtgctcaatttagcatgcaaaaaatcaccttggtaatttgagcctgagatggcaagaacaaagcagttgcctggctgaatttattacatttaaactcattttttatattactttacatttttctttaagactagagaacataggttgtacaattctgattctttagaaaatgttgacacttcttgcatgcctaggacatcgttaatttttctaaaatgtaatatcttaaaaagattgtggatggaaaattcagtgtatatctcatgacgcatccttattaatcgcattgttcaaaatgtaacatctctacttctgaaaccacctttgcaaaattataactgaggaaattttgacactaaaagaaatcacacctaaccgactccatcttgcttctaacctgtaagctgcccttgtttattcctgggcatacgccaaactaactttgggaaggaattcagttcatggtttgattctgaaacaaaattgacaatagccctttcccaaaaagacccccttcttgtctggggaccagtctacctttgtagaactaacaaattagctgtgagattagaaattacagtttagggatcatgcagcctctggctctaagagtctgaacctccccaaattgctcctgggaataacatcactgttgtaaaacctaagatcagtgctctgctccccgaatgctcagggagactgatttgagtaataatagaactccggtctcccacatagccagctctgcgtgaattactctttctccattgcatttccactgtcttgatagatcggctctgtctaggcagtgggcaaggcgaacccattgcatagttgaacttctttatttattattatttgacagtttgatctcttcaatttccaaacttaaattacttatagacaaaatttttcctgaagctttgtcagtcatacttgacagggtttgatgctatattgtttgattccacatgttttcaaatgggcaaactttcttattctataattttcttatctagaatatagcatcttccttgaacctttaattataaattgttcatctaaattctatatagtcagacaataaaattgctaccccaaagcagacatttcttagaaatacagaaagaattaaacataaaagaaaaaaagacatattagactttgtcaaaggtaaattgtttacttatcaaagcttactgttagtaaacagttataaacagtttattataaaaagttataaaaataagccaaagactgagaggaaaatagctgcaatacatatctatgataaaagatttcaatgtagaagatttaagaaactaaaatatcaataataaaaagaaaagcaatccactgaaaaatgagaaaattttagtaaagaaaatagagaaatggccaataaatacaaaaaaagatgctcaacatgattagtcatcagagtatacaaattaaaaccatgaaaacatcacttcccaccaactgcaagaattgaaattttaaaaaatggtagttgcataaattggtactttcccatattgctgatggaaaccagcattttcttataaaaccacacatactgaccctatagtctatacttccatgcttagtattgacccaagataaataatatttttatgtccacaaaaatacttcagcaagaatattcataaaaactttatttctaataaccaaagactgtaaataatgcagaggccatcaacagaagaatggtggtatactcatacaatggaatattactcagcactgaaaatgagcaaaccactgatgtatggaacaatatagaaggtgaaatatggtcctactgggtgcatatgaacttcaaggaaaagagtctaatctatggtgatgaaaatgagaaaacttgatgcctatattgggtggtggagatacactggaagtatccataagggaactttcttatggtcatggaaatgttctacattttatttaaaatgctggttacatgagagtaagcatttatcaaaatgcatcaaattgtacacttaagatttgtgcatttcatagcatgtaaattttaatatatttagacacaaaaaatgtgaaatgtgaggaaaacatataaaataaacttcttatataaaataaaaacgtttctcaaatgcatgaaagctaattatctcattgaagttattaactatctattttaagaataaaggacaaaaatctacttatgttttgtttcaaaatctcttaggtaattaaagggctaaaaaatcaagaacaaaacaagataatcattatcatcattattatttgacatcattttgccattttatcccaaaacaaaatttttctccaaccaggccaggcctagtggctcaaacctgtaatcccagcactttgagaagctgaggcaggaggatcgcctgagcccaggagtttaagaccagcctgagaccccatctctacaaaaaaaaaaaaaaaaaaaaaaaaaaaaaaaaaatcccccatctataaatctattatgattaaaaaaacatgattgacagtgatgaagctgactaacttgtttattcaaaaccaggaatacaaatttatctagaaatttccctccagaccaaaaaaacaaatgcagttttcccattgaagagtgatgattatttttgtttcaggatatcagtgagtcatgcacactataaaagaagtattatcagagtagttttaggttgtagatgtaaaatatggagttatcatttaacctgtgttcccttggactgaatcgtgggactgatggagaaagactgcaaagattccctttatggaatcagcataagcatgttcccctgttcaggattatctacaacttatttcttctgcaccaaaaaggatagcttcagttgggagaaataacaatgagcccctgcaccctcttgacttacataatccaccaaaaacaaactcagccgaaggtacagagagcaagtggaggcaaccttgaataaggaggcttccaggattcaggaggattaacataccagcactcagatcttctttgagttctatgctacttctaagctggttagaaatggtttgcaaattctgtcatttccttggtctacacagttacagaacaaattatgttttatatatgtaaaaagtgtgcacctctttctttttctctgtatctctgttcttttcccctttggagaggggagattttggcctggaaacaaattaaagatacaaagtctaaatggattatttctttgaagttcagttaagcctgagaaagcacttttttccactctaaaaattcaagatacaggtataatacaaacacattgcactggaagttagagaataaaaattgggggttttgtttgcttttatgttttttaactctatttgctattgggtaagttcttgactctgcagacactcatgataataagcctcactgtatttattgagaatcatgttgcaaacattctgaaaatttttttctttttttcttttcttttttttttcgagacggagtctcgctctgtcgcccaggctggagtgcagtggcgcgatctcggctcactgcaagttccgcctcctgtgtttacgccattctcctgcctcagcctcccgagtagctgggactacaggcgcccgccaccgtacagttttttgtatttttagtgagacggagtttcaccgtgttagccaggatggtctccatctcctgacctcgtgatccgcccgcctcggcctcccaaagtgctgggattacaggcgtgagccaccgcgcccggcctgaaaatatttttacatatatggatgtgaaagtatattgtggagagctgaagttttggtattagatagatagatagatagatagatagatagatagatagatgataggatggagagatagatacatgattgatagatagagatgttagatgatagatgaatgatagagataggtgatagagagatagagatacatgattgatagatgatagagataaatgattgatagaaacagatgataagtagatagagatagatattgatagagagatataggtgatagatagctaatagatgatacatagataatagatgatagatatagatgactgatataaatgataagtaatagattatacagatagatagatgatagatagatagatagatagatagatagatagatagtgaaggggattagaatatgctaccccaaatgtgccattttggcataaggattattttttagctgaatgtacctgacaagcaacagatagggaaagaaatctctgctctccctcttaaaatcatgacataaatttcactttttaaagttgatgtaaatttctatttgtaaagggttcccctttcccataagtggtttagtaaggtgtaataaaccttactaaacgattcttaactaccatatatttcctaatcaccttcccacaatttattgtcccaagaagcccaaatcccctccccacctcttttttttttttttttttgtcttgtcatttcttcacaattcatcacctcttgtgaaagtggtagataagccctggggtctaactgcctctttcagtttttgacctcttttctgtgggggtctcatgcacatagaaaaattaacattaataaagaaacatatgcctttttaaatctatattttgtctatttagatcacaggccccagtcacagaaccaacgagatacaagaaaagttttttgccttccttaacattagtatgtagatagatagatagatagatagatagataaatggatagataaatggataggcagaaaaggtagaaacaaaaaaggatggatagatataaggatggatagatggatggatggatggatggatggatgaatggatggatggatggatggttaggcagatagatatgtagagaaaggtgatatgtaaaaagattccaagttctgtcttcaccagagtgttatttagaggactaaataagataatctatatcaatatctattattgtctgctgtataaattttattactatttttcatattctcctacattattatttctgaatgaacatttccacttattgaagcacttccttttttaagcaataaattgtgtgtagtgaatgcagtaaaaaagcactgggaagagaacacatttttaaaactttgaattccccataactcttatcaataaagttgccttctttggggtcttcagtccactctgcttcctacagagtttagattccaatggctattgtctttaagaatactctcagttcaactaatcagccatctccaagaaccctcattgcaagcactgctggggtaaaaacaggcactaaacttatctgtcattactgccatcaatataaaatccaacaggaatgagtccttggagctggcgatgatggctcacgcctgtaatcccaacactttgggaggctaaggcaggcagatctcttgagcttaggagttcaagaccagtcttggcaagaccctgtctctacaaaaaatacaaaaattagccaggcatggtggtgcatacctgtagtcccagctactagggaggctgaggtgggaggatcacatgagcccaggagatcaaagttgcagcaagttatgatcacaccactgcactccagcctgggtgacagagtgagaccctgtcaaaaaaaaaaaaaaaaaaaaaaaatgggggtggggtggggagggaaatgagtccttggaccagatgttaagatatctgggctatagcctgtagttctcttttgggcccaccattgactagcaattactttgggaaaatctctttacattgtttgtatctcagtcttctctataccaaatcttgttaccttgcccccactgctaatggagacagaataaacctcgtgagattaaattacagcatgttatgttttctaaaagcaagagagataaacatcggcctggagatatgtagtggctccctattcttggctgcctgactatgttctatcccaggataccattatgcaccaactctggtaatcccatctcttctgccatgcatggcagaaagacatttacgggatggggctcctgggaaacaggccagtcaactctcctatcaagatgcagatgaggaaggcctggttgctgtcagcaactgcctgtggctatgatgacgctgatgctataaaaggcaatgtgaggggacagctgagttattgaagcaagcttttctgagttctgccctacacctgaatttagtggtttaagtagcgctgtctgtgctttacagcctatcacctctccactcatgtttattattaaagtatcttcacttattggccaggcatggtggctcacacctgtaattccagcactttgagaggcccaggcaggcagatcacttaaggtcaggagtttgagactaacctggccaacatggtgaaacccgtctctactaaaaatacaaaaattaggcaggcgtggtggtgcatgcctgtagtcccagctactcaggaggctgaagcaggagaattgcttgaacccaggaggcagatgttgcagtgagccaagatcgtgccactgcactccagcctgggtgacagagagagactctaactcaaaaaaataaaaataaagtatcttcacttattaatcatctgctgcaggactggaactgaagagtaaaagctatgcacaaagcacagcctctcctctgtgagatcttacaatattttctttctaagtttgtttgttgaaactgcgaactgatcgtcaaaaaagtcactcctttgtaattcaaatatctctccaaagaggtgaattatttttcttctttattcaactgaaaatgtacatgttattttgtgtccaatatagttaactgtcaaaaacctaaggtgattttccaagtatcttttctgaaaatgttttgattcgtgtgcttactttttctttcatctcaagatggacccacaaagaataagatttcaaagtgttaatctgtataaatatctgtggtatattcttaatgaaataaacaaattccaagtataggataatcccatcctttaaacatatgtatcaagtatagaggtataaacttgttatgtgcaagtatctaagtatccagttatataactttgttcttaattgcatagaaaccactgtgctgcaagattatctggcaatgaaattggggactttaaacaaatcacttgattctttttttccatagaagtgaatctaacatttggaatagcttccaccaaattcttatgctgtatccaaaaacacatttaaaaagtactcagagaatgcaattactttttgtctctacaaacagaatataattaacgagataaatgtaatgccagattaatgaatcccaacaattttttattcacctgcgtctttagagaaccattgcttctgtgcctctacgttataactagaaatgaacaacagttacataattgtctcttgttctgtttatctgttttttacattgccagtctctgagatcttctctaaaatcacccaccaaaaaccttcaacagagaaatgagtgctcattagaaatatattgactgcttagctctgatcatgatgcattcaactctacagatgttccaaattccatagagtagatattatggattagtcagaaggggcctgccatttttgtaaataaatataatttttgtgagtaatctaatttgagaacatttgtgcagcaagcttactaaaataaagcatgttccataattaattgacttagatgaagaagtagaaactgtcatgcccatcattccccctcccttaacaaatgctttataaagtcaatcctctaaaaatcactgcaaaaaaagtttctattaatatttacaattggtcacatttgcaaatatattctctctttcatttggatttacagatttatattttatttatttattttggcctgtcacccaggccatcatgagttaccacactctcagtctttggggctcaagtgatcctcctgcctcagctccctgagtagctgggaccacagatgcatgacaccatgtctggccaacttttgaatttttttgtagaggtggggtcccaccatgttgcccaggctggtctcgtactcctgggctcaagcaatcctcctacctccgcctcccagagagctgggattagacatgagccactgtgcctggccccctttgttttaaatagcattagtttatttcttggtggatatgaagactaaccaaatggttttcatttattctgcaattagaattcaaaacacattgcttgtctaaccagtggttctcaacctagagcacatcagaattacctgaggagcttttaaaaatatggctggggtcattcccacattttggaatgctatcactgatgtttcagtttgacttgtttgttgacaaggttgttttcctctctcaataatatggacattcaccctgaaaagatcactacatagcttgcatctgcttgctttcttacttaactagccattcagtaatttagttttctgcttcatttttctgacggttacttcattaagcaatgtatgctcagctattggaaaattattgacaaatacaagatagggagccccagagggtctcactgaacctttcatgtgggaggcagtttgaacctgcagagagaggtttaatctaaaccatgctctgcctatattagcacgtgtgcccttgactatttccaaattagaagcatgtgtgacaactgggttataggatgatgaaggtataaagggaagggtggattagtcaggggtttccagagaggtagaaccaataggatggatggatggagatggagagagagagacagagagagagagaatgatagatgattgatagatagatagatagatacatacatacatacatacatacatacatacatacgacaggtgcagtggctcatgcctgtaatcccagcactttgggaggccaaggcgggtggatcacaaggtcaggagattgagatcatcctggctaacacggtgaaaccccgtctctactaaaaatacaaaaaattagtcgggcgtggtggcgggtgcctgtagtcccagctactcgggaggctgaggtaggagaatggagtgaacccgggaggcagagcttacagtgagccaagatcgcaccacagcactccagactgggcgacaaagcgagactccgtctaaaacaaacaaacaaaaaaacaaagatagataagatacattaaatagatagatgagatggctagagataaacagatgtgatagatagatgaagtagatgagagaaagatagatatatgagagatgaggtacatagatgaaatagattagatagattagagagatagataaatgagatagataagtagacagattagatcagtacataaatagattagacacattaaatagagagatgagatagatagggatagagagatgagatagctgaaatagatgagatcgagacagagatatgagagatgaggtacatagatgaaatagactagataggatagatagatgagataggtagattgataaaatggattagataaattagatagatgatagatgaaatagagatagatgagatagataagacagatgagatagacagatagatagataagataggtaggtacgtatgtagttagatagatgatagataggatagatagaggagatagagagatatatatagagagatgagataggtagattgacaaggtagatgagacagataaatgatagatgaaatagataagatagattagatacatgagagagatgagatacatagatgaaatagacaagatagctacatagatacatgagatagatagatagatagatagatagatagatagatagacagataaatagataggcagaggtagagatgtagaaggggatttattatgggaatgggttcacatgatgaaggaggctgacaagtctcatgagaggccttttccaacctgtagacccacaggaacctacagtgtggctcagttcaagtctgaaagcctcagagcaaagcaagctaatggtgtaattctcagtcccagactgaaggcctgagagaccggtggggcattaatgcaagtcctggggttaaaaagctggagaacctggagttctgaggtccaaaggcagaatcacaagggtgtgccagctctggaagtgagaagaattcacctgtcttctcactgttttccattcagggccgcagccaactggacagtggccacccacactgagggagaatttccaccactcagtccaccaactcctatgccaatctcctctggaaacaccctcacagacacacccgaaaacaatgcttaaccagccatgtaggtgtctcttaattcagtcgacacctaaaattaaccatcacaaaggactttggcttgttctgttatttccttaaattcacttaaatagaattgtgcctctgcaaaagaaattaataaacattcagttagaaagcaccaattactatttcaaggttaaccgtatattcacacatgaaatattggcaaaacaggatgagtgtcttctgcaattccattattttaattgtcagaggaatacaatatcagcatagaaagtttaaaacaaaacaaacaaacaaattcagattacttaaataataaacaaaatgtggtgtatgtacacaatggaatataatacagccttaaaaggggaatgaaattctgatacatactacaacatggatgaacctagaggacatcacaccatgtgaactaagcatcatgccaagttaaacaagccagacacaaaaggacaaatattgtatgattccacttccatgtggtacccaggatagtcaagttcatagaaacaaaaagtagattcgtggttaccaagggctggggaagtgggaaaggagtgatgaggagttattgctgaatagttatggagtttcactttggggaaaagaaaaaagctctggaagtgaatgggagtaccaattgcacaaggggaatgtacttaatgccactgaaccatgcacttttaaaaggttaaatgagccaggctctcacctgtagtcgcaaccattcaggaggctgaggcaggaagatctcttgaggccaggagttcaagactgcagtgagccacgattgtgccactgcactccagtctgggtgatagagagagatccagtccctaaaataagtaaataaataggttaaaatgataaattttatgttatgtatattttaccacaacttctaaaagattaccagagtagacatcagtcatcatatatgataatttcttaaaggatgggtggaattcaatacacaaaagaaaagtgaggtgccgtgaaggtggagaagatcagaatacgacacccaaaatatgccactgtgatgtaaggattattttgagaaaaggcagacacacaatgaggctctctgccctttgccagctgcctaaaagcaaaacaaattttgccttgcttcccttcttcccgaccaggggcaagatggcaccaaaaagaatctaataaacacaccttaccaaatgaccctcatcaaccatcagcatcccctttatattcaccttcccaccatttacagcccctaaaaagtccaaaaacccttgtcctttgttgtgtcacttgtctacaagtgtatcattctttgaatggtataaaagcgttcaagtctaggtgcttcttgggggatgaggagggatcttttctttgtgaagcaccccccaacaccaccaaccaacaatgtaacataaagcttagcatcaagtaaaatatctatgattttctcctgttaatttgtcttttgccagtttgtgttgcaagctcatccacacaacccaagaaagtagaggaaattttttctcccatgcaaagaggaagaaatcctactagagggtccttcactagtaaaaaattctactagaggattccaagcagtgcaccacactcagacctgtggctgggtgcatccttctacagcagtagttcccaacctttatgccaccagagactggttttgtggaagacaatttttccatggactgcagtggggatacaggggcatgatttcaggatgattcaagtgcattatatttattgtacactttatttatattattattacattgtaatatataatgaaatacaacttatcatcatgtataaccagtgggagccctaagcttgctttcctgcaaatagacggtcccatctgggggtgatgggagaaagtgacagatcatcaggcattagattctcataaggagcacacaacctagatcccttggatgtgcagttcacaacagggttcgcactcctatgagactctaatggcatcactgatctgacaggagacagaggtcaggtggtaatgtgagtgatggggagcggctgtaaatgcacaggaaacttccctcactagcccgccactcatctcctgctgtgcagcccggttcctaacaggccacagacccgtcagtggctggggcttgggcatccctgctttagagcacaggatggattgcaacagagtaacaagaaacatggttggaaacacaatttaatggcagcctatgaagttggcactttcttttataaccttgtagcaactgtggagaagcacctatcatcataatccatattattttccacggttgagccctgtttcacaatgtcactgttaattttcgacgaagctcctttaaagcaagaaacttgggtgggatttcctgcaatcctggctggattacccagaaaatgcacttcccaccctaaccccctcaaaaaacaagttgaattcttaaaatacttttagtaactcaaaacaaggaccaaccaaggagagatgccctaaagaaagaatagcctgtctgtttccacattcctgaatgggggagtcatctttttgtcaccctcatagaaagaattcttctgaaatgccaacagcctctggtagcatttgggaagcaaggatgccccaagcagtgtgagaagggctgtgttgagagaattttccaaaataagacttgtctctctgccagggtagaaaaagcctctgcagcccgaggtaggacacttggtgtctcccttttgcttccttaatctataaaccatggcccatggctgtcaggtagctccaaagaaatgctgaggagattaatgagattgtatctgtggaatccttggggcctctgggaaaatgtactgcatacaaaattagctgcattttgacattagcctgtatgctaataccgctcacatcaactagattatttagcaatgacagaaaatgtaactccttctcctggttctttatcatttcatcaaatgaaaatgacctttgcaaataaataatgtatcggtttctttggctgccgttgttttcatcatggtccatttattgccaggatctccatgaccaaggtcccaagacaaccctctgaggatgaatagcatcaaggaacaagctctggctgaggtcccagaaatcctcgtttctccgagaagaactgtcccttaaacgtctaaaggtatgaccagcctaatgctgtcttcctgccacaccctctaaactgtgctgcaattagtggtagtgactaatctactcagttttaaacacagcagagacctcaaggcaagagctaccctagatgaagccacctgtgctcacaggtatatatattgaacacacttctaagcaagacagtgcatgtagagtttgttctctgaaaacactgaacagatgagcatggctcagggaattggaagatctgaaaaagagcacatcactccaaggctttacggtaaagctgctagaatcatcctcttagaagatttagattaggaaatgtcactccccccacttcaaatccccattgagattgcattgcctgtgaaataaaacccaaggtatttagcatagcacacaggatcttccagggtctggtctctcacttgctgtttaatcttacctcccaacacgtggtgttattgtgccctgtgctctgatcacacttctgtttaattcatgattctcttgataaatcacacactctcaggcccttatacccatcctccagtcccaaatgtccttccactccactccccttctatcttcaagtccacttatccgttaaagtccagcttttagtccatctgctttggaaaatctttcttgatctcccagacaaaaggaatccctcactcaacaatggtgcctccatcacccgaagcgtttatcactgggtttagtacgagagtcattgacagtctctgaattcaaagtgacattggtgagaagtctcagccccctccttccttggacattcgacaaaagttgcttgagtggaattgagtatttctgactgatgttcttaaaatgatgtaattttatgctcagactatagggtgatgtatttccatcatctgttggacaattcgcttttaagtcagggacttagatacattttatttgtaaagtttccttattttctcaaacctaaggcacaaccagagaaactggacgttttaaaaactaaatttgggccaggtgtggtggctcacacctgtgatcccagcactttgggaggccaaggcaagtggatcacttgaagtcaggagttcgagaccagcctggccaacatagtgaaaccctatctctactaaaaatgcaaaaattagccgggcgtggtggtgggcacctgtaatctcagctactcacaaggttgaagcaggacaatcacttgaacccgggaggtggaggctgcagtgagccgagatagtgccactgcactccagcctgggcgatagagcaagaacctgtccaaaaacaacaacaacaaaacaaacaaacaaaaacaaacaaatgaaagctgaatttgggagcctagcacactctaagcacaaaatgttctaatcactcccaatcttcagtccacactaatgatataatcgtccatatcatctgaccaattcaagacagactcagctgcagctggaagcaggtaacacctcgaaacagggcagttgactttgacccatgcattaaaccactgcttggcaatgcagtgtaaactataaaactgtagctaagttgaagacctcgccacccttccactccattcccagagttaaatagaggtgagtcttgaaagcaagcctcactcactcttcatggactgcattgctgtgacctctcaggactcacatcccctaagtcagccgcctgttcccatcagtctagacccagcagaaatggttggcgtcaaatgttcaaggagcaacactttggcagtgtcattattattaaatgcaactaaatgaactattaacaccatctgttcattgtggtggatgtcagacgtgccattccaaatagtgcaggagctgctgacgctggatttcgcagaataaaatcaccttctgctcactcgaccaaacagtaggagcacataactgtgtgccaaaggtctggggtttttctgtgtgtttgtttcatttataattatttttgattatccaatttcctccgaagccaataagaaacactgtgtacgtcccagttttcctccatagctggaggttgtgacacacccaaagcctcattgttgtaaatctcttcaaagtacacagctcatcaattgaagactgggttccatggagaaaggggggaaaagtgtggagctgcactgatcacgtatgtaaattccgttttgtggaaatgtcccaactggaaggaaatatcactgagaatgtcagggacaagagaaaacatccccttccccctctgaagtttcactgaaaatcactgacaagaggcagattaataggagaaatggcgcaaacatttattttataacatttttatgtgacatgggagccttcagactgaagacccaaagatacgagggaaactgtgcattgttatgcttaggttcaagcaggtatgaacaaaatccatgtagaaatagcatcggaggaaaagggcctgatctaaagcaaatggactgagggtggaaaccccgccaggcctgtctgtgtagattcttcttgcttctctctctgagcagcgctccttccttccgggtgtgctgcgagaccctctctggaatgcgggtcttaggatctacagtcaaaccaggtagatcagaggatttctttacggccagttttgacactgagaggtgatggagggtaagttagagtcctattttaggttttatgtctggctttggggcaaaaggggctctggtttctatgaaccaccttggggaggagaaattctagtttttatgaggcctggagggagaatgggactgacagacaggagggcaggagaaggtgaggaagaaacttttccttccgaggcttcttctgaggccttcgttttggggtagtgttctctgagcacaacattagctaaggaagagatttaggctttgtctccttagtaaattctggtccacgtggggctgcacaaagccttcattgtgtccaattcaccgcagcttatgggaccttccctgctgtgctctcaaagccaggaagcactgcttctccactgtgtccagctcacagggcctgggtgcctcaggcacagccaatattctgcttttacatttgatcacctatagtcgcatcctcagactgtcaatctacagcatgtgcagcattcaatgtttctttcctggagtcagcatactcgggctctctggctggagttgactcatctctaaactgctctccacatccacaaaataactgcatgccacctattggtgcagggctagggaaccaaaggatgcaatgccctcaaggagccacattttattttattttaatatttatctatttatttattttgtgtgtgtgtgtgacagaatctcactctgtcgcccaggctgtagtgcagtggcgtaatgtcagctcactgcaacctctgcctgcgaggttcaagcaattctctagcctcagcctctggagcagctggaattacaggcatgtgccaccatgcctggctaatttttgtatttgtagtagagacgggtttttgccatgttggccagaatgtctccaactccggacctcaagtgatctgcccgcctcagtctcccaaaatgctgggattgcaggcatgagccaccacgcccagcctatgagccaaattctagtgggaattttggaaacagtgctttggaatatacaaatcatgagagcttaaagtcgggcaatgataaggagctcctcatctctctaggcaacaggcagtaagatgaagcggttcaatgattttggctagaagaacaagggtcctgcaccttcaccatgttcatcttggggattctggggagccatatactgtggaagcagccctcacaggatcaggactccaaaactcaagaaagtcaaaagccccatgctactaagtcttccctgggtccttgcaattctgcataagaaacaccaaaaggggcgggcacagtggctcatgcctgtaatcccagcactttaggaggctgaggcgggtggatcacttgaggccaggagttccagaccagcctggccaacatggtgtgaccctgtctctactaaatacacaaaaattacctgggcatgatggcgtgccctgtggccccagccactcgggaggctgaggcaggagaattgcttgaacccaggaagtggaagtttcggtgagccaagatcgtgccactgcactccagcttgggtgacaaagccagactgtctcaaaaaaacaaacaaaaagaaacaccaaaaggcttaatgttggggctcagaaaacaattcctggctcctcctcctctgagcctggaatcctgtcttttcatcttcacatcccccacaatttgcacaatggcaagtccatggagattcacaacttaatggaaaggatcactaattatttaactttgtttttttccatttgaagcacagtgtctagaaacaagatgccatttccaaaactttacatttatttacagatagtccttgtcttatgagggtttgagttacaatttttggacattatgacggtgcaacagtgatatgcattgagtagaactcatactttgagtactcatacaatttttttttcactttcagtataatactgaaataaatttcatgagatattcaacactgtattataaaataggctttgtgttagatgatttagcccaagcataggctaatgtatgtgttctgaacatgtttaaggcaggctgggcaaagatatgatatttgataggtgacgtgtattaaatacattttcaacttactatatttattatgggcttatcgggatgtaaccccatcgtaagtggaggaacatctatgtatctcccaggagaggccacagtgagcatttttctgttgggatatacctttctttcttggctgacacaaccaggccagggcatagggtgtggtctgggagcccgggaagggactgtcgggcactgtggatccatagattgaagccgtctccagatggaaaagtgaagagcacagcttaagagggaacaggtcccattttaaactaataatgttaacaacagagtctccaatggtttagaattattattattattattactacgaagaaagggtcttgctctgtcacccaggatcgagtgcaatgattttaccttactgcagtctcaacctcctgtgctcaagcgatcctctcacctagcttctcgagtaactgggactccaggcgcacaccaccatacccggctaatttttgtattttttgaagaaacagggttttactatgttgcccaggctagtctccaactccttgattcaagtgatcatctcatctcagcctcccaaagtgctgggattacaggtgtgagccatcatacccagcctcaactgatttattcattttacatgaaccatagtatgtatttattacagaaaatgcaaaagtttaggtcattcatctagattcaaccatcaagaaataatcattggaaaattgaggtagggagataaatcaatagctagatgatagatagctacatggataaataggtgatgagtggatagatagacagctagaaaggtagataacaaggtatgacagatacacacaaacgacggaggatacacatgtgtgtaaatgaaaggatagatgcatagatagatcagtctatatgtcttttgatgtatagatagatatgatagatgatgatagataaatggagatgatagatgatatatagatatgatagatagatacaatagctagatggagatgatagatagatatgatagatagatacatagatacgtagataaatggagatgatagaatgatagataaatggagatgattgatagatgtgataaatagagatgacagataaatggagatgatagatgattgatgatagatagatagatataggtagagatatagatgtatatatatagataaagatgtgtcttgtctattggatatattttgttgactcatgtattgcaagtgattcttcaaaccaaccttcatttattcctcctttaacacatcattgtcaccactcagaacttatgtgtcctaaattgactgcctgttccagttaatctagacccaataggatatgtatatatattctgcaggagatagatatagatatgtgtgtgtatgtgtgtgtgtatatatatatatgtgtgtgtgtgtgtgtgtgtgtacatattttataaggacatacatccttataaatcaaaatgtatatatacacataaaatgtaaaggaacataaatatgtatacacacatatttttataaaaatattttttaccaaaaggtagttcatattgatcatgttttattttaattttataaactgacatccttgacccatattattttttcatttaatgatagatcatgatcatttttccatcccaataaatatttgtacatcattttgtggcccccgcagcattccattgtgtggctatgcttttattatttaatcatccatgctctggatacttcttagttttgctaaatggccttaatctaataaaattgtgcacctgatctcacccccaaaatggtgtcaagtaacaggtaaagattttctccctgagagaaaaagatgcatagaagaaatgcaacattcagtagttagactaagctcagacactgtcaagtcatggctaatgatacatgccggtatattaccttactcatggaatgtattcaataaatgatgccttaatcagtgaaactatgtaattgcagataactagactttttttaaaagggctaaacaagcaaacatttgtaagaggctgaataaatagctctccttcacaacatgagttttgcatcagttgaggtagacagaggactcaggacgaagtgagttcaaaatgttggtattatcactggtgaattgaatactggaggccatgattaggtacgtagcagccctggggttccctggatagagatccagaagtgggcaggcttaccctcagaactgcaagaagcacagaaccacccactgccctatcttgcatggctaatagcagatctgaagtggggtgtgggagaagccaggctgagctgccaaaggcagggaacccaggtgagaggccaggggtagggaccagggaaatatcttccaacagaaacccaaggcatgtcagagaagggctcccacgaaactagatcatgttcttgattctatctaatatctattaatcaccaaaataaaagaaaggcttagaggttcttccaaaatgataaatacatacttgtgagcctaaatgaatatgttagctaaaaaaaaaaaaaaggtctccaattcgcttacatagctgtcttccccatttttgagaagatgctgattatttcagtgggaagcattatatgtaagctggtggaatggctctgggctgaacttacccagaatggtaaatcatcatcttacttgtgaagataatgtgtcagcagaattcatatctgtgctgattatttactttaatgctgataaaaagtgaaatgaactgcttgaagaaaaaatattcatggtagacagcagcgtgcagaggctggtactgacagctacaacgaatggcttggtggaccctgatagtaaatgcaattactatccaactctgtaattagacactctgaaaagaataaatatgcatgtcgaaaggaaagtccagaagcagataaactgagacgtgaaccatgtgctgatgggattacacatgatctttgttcccttctttaccaagtctctgaatttctgaaatttgcttttcctttaaatatatttctatgtatgtatgtatttttttttttgagacaaggtcttgctctgttgcccaggctggagtgcagtggcacaatcacagctcactgcaacctcaaactcctgggtccaagtgacccctgtgcctcagccttctgaataactgagagtagaggaagacatcaccatgcctagctattttttcaaaatttttgcagagctggagtcttgctatgttgtccaggctggtcttgaacttctggtctcaagtgatcctcccacttcagcctcccgagtagctgggaccacaggcacaaacaaccatgcccagctaattttttaattttttgtagagacagggtcttgtcatgttgcccaggcgtgtcttgaactcctggcctcaagtaatccttctaccttggcctcccaaagtgctgggaccatgggcatgagccactgtgcctggccagaatatattaaatcttataatcagaggaagtatatgttacttccagaagaagagtgactgattcatcctcaccttcggtaggagagaatgcaagtactgtgctattggctcatttttaaccatttttaggactcccatcttggctttaatatgcttccacctttgatggctagcacctggggcactttttcagaatgatacccttgggttgctggagcgattgcccctttatgcacagagagctgtaagtgtctgggattttgtatctccctttcactagtggctggcagctatggggcatcaaagcttgctgctctgggttggaacaatactgagtgtattgacaggatgaggctcctctctgctgtcagtacccgatacctggcctcacatctattcttggtttcttttccttctgtcctccttcctgcacttcctaccagactcctcctggaagcactttgtggtgaacacctgtggtccctgccctcttgtgctcacagcctacataatcctctccccttcagcagggacgagacctgtgacttgtttctggccaacagaacatggccacagcaaagaacttttgcagatgtcagtaaggttccaaattagttgactttgagttctctaaaaggggaattatcttcggtggatttgacttgattaggtgaggagcagtaaaaggcagatatggccttccctgaggtcaaagattttctctctaattaatttacattttcaccaacagcataaaatcattccctcttctctgcatcctcaccaacatctattgtttttcgactttttagtaatagccattctgactgatgtgagatggtatctcattgtggttttaatttgcatttctctgatatgattagtgatgttgagcattttttttacatgtttattggtcatttgtatgtcttcttttgacaaacgtcttttcatgtcttctgtctactttttaattttttttttcttgttgagttatttgagtttcttgtagattctggatattagcactgtgtcagatatatagttttgcaaatattttctcccgccttgtaggctgtgtggtcaccctgttgattttatggaaaacaatatggagatttctcagagaactaaaattaaaactaccattcgatccaacaatcctgctacagggtatatacccaaaggaataaaaataattgcatcaaaaagatgcttgcactcgtatgttcattgcgcactattcacaatagcaaagatatggaaccaacttaagtgtccatcaacagaggactgaataaagaaaatctggtatacatattccatggaatatttactacttagccatcaaaaagaatgaaattatgtattttgcagcaagatagatggaactgggggccattacctttagtgaaacaattcagaaacagaaagtcaaatattgcacaatgtcacttataagtgggagctaaataatgcgtacacttggacataaagagtggaataatagacactggagaccaggaaaggtggaagggtgggaggagagtgagggataagaaattacttaatgggtacaatgtacactattcaagcaatggctacactaaaagtccagacttctccatggaatttatccatgtaaaaaaactgcacttgtaccctgtaaacctataaaaactttaaaaatcaaaaaatgccttaaaaaacaaagactttctccctatttctggactagaagagacaaactcccatgctgtgagggggcttatgaagatagctacagggcaaagaacaaaccgtaggtggtttcttggagctgagagcaaccgctagctgacagccaaaagggaagtttcagtgctacagctgcaaggagatgaattctgccaacaacttgcagaagcacgagaggagatcttccccgagagaggcctgtgtggggacctcgaccctgactgacacctggattggagcctgtgagaccttgaagaagggaaaccagctctcttgcttgctgaggctgccatgacaaactaccacagacggggtgacttaaacaacagaaatttattctcttatgctctggaggctggaagtccaagatcaaggtgtgggcaaggctggttcctcctgagtcttctctccttggcttgtagacgctgtcttctccctgtgtcctcacacaagtctgtgtcccaaactcctcttcttatgaggacaccagattggattaggtcccaccttacaaactcatttgaacctaattacctctttaaggtccaaggcctcatctccaaatacagtcacattgcggggtagggcttcaacatatgaattttggggaaacacagctcagtccatagaaacatctaagctatgcctagggattcctgattcacagaaactgtgagatagcaaatgtatgttgttttaagttgctactttgcagtaacttgttatgcagcaattgaaaatcaatgaaacctgcttcaaatgaggtgaaggtgttaagattggtggatatccctgtcaatcatttctgccccagaggaggttacaaaagaacctagaacatctcactgccctgtcccattgatctgtatgtccacctctccaaaagtccagattttctgggagaaagaaatatgcttagcaaatcactagtgcatgagttgtctagtgtattaggtgcacgcccaatccacagtcaataattttctcaattaatattctttaagatgaattttgaagtggatgtttcacaacatggtaagcttcaaataagtcacattgataaactggcacagccactatggatgacagtacagaggttcctcaaaaagttaaaaatagaactatctgatgatccagcaatcccacttttgcatatatatccgagggaaacaagatcagcgtctcaaagagatatctgcaccctcatgttattgccacattattcacaatagccaagatatggaaccaacctaaacatccaccaatagatgaatagataaagaaaatgtttatacatacatatatacatttattcatatatatatatacgtgtgtatatatatgtgtgtatatatatgtgtatatatatgtgtgtatatacatatgtgtatatatatgtgtgtatatatatatgtgtatatatgtgtgtatatatgtatgtgtgtgtgtgtgtatatatatatatatatatatatatatatacacacacacacataaatatgaatagtatttggccattaatcagaagtaatttctgccatttgggacaatgtgaatgaacctggagggcattatgttaagcaaattaagccagacagagaaagacaaataccatatgatctcacttagatttggaatctaaagaagttgaattcccagaagcagagagtagaaaggtggttacgaggggctggggagtgggggacactggagagatgttggtcaaagggtacaaagtttcagttataaataagttctggggatgcaatctacagcatggtgactatagttaccaataccgtattgtttacttgaaattttttaagagagtggatctcaaatattcacactatccccaaataataataataataataataataactatgcacagtgatagataagttatttacctagtgcatagtaaaagtttcataacgtgctcgtttatcaaaacctcacacggtacacagtaagtatattccatttttacttgccgattatacctcaataaaggtgggggaataaaagaattcatatctctattctatggccctgtgttctctgattccctcagtgtctgtttctggaatccaaccaaagagactttcccttgcccatcagaagaaaaacatgctggggaaaatgtcacaagaacgaactgtttaggtacagctttgtgtcacactttgaggtacattattatttcatgatatcctgggtcaaattccttttcattagtttaaatttactttctttatttaattttatttttgaaagaaaagatgcaaatatcccatatgacctttaactacagtcctcaggtaagtgacagcaacaactgagagattttcttcaggctgataaatttaacatgatttaatgaaaaaaatgaagaaaaacacaagttaggcttgcaaagtttctgtgagaaatcctcctttagaaattacgccagcttttcatggaaagcaattgcaacacagcagaaagcaatctgctcatgcaacccatcccaagtgaggtgaaggtgttatgactgatagacatccctgccaaccatttctgtcctaaaagaggttataggagagcccagaatatctctcttacctttgcaattgacttcactcatctacttctccaaaggtttagatttgcccagaaaagaatgaaaaggaagaagtctcgccaaagctgagggctgaaaaccatgttggtaatctccaaatgttgtggttctaaaagaacagagggcaatggaaaaatacaaaacatttcagatataaagttatctaaaatatacttactataggacataaaagcccattatgaggagaaataactttatgtgttataggacataacagaagatgtaacaaatggataggtgcgtgatgttcactaaagggaaggttcaatatctttaagatgtttgtcatccttaaattaagctctatattccatggaaatcacctatcaaatcacaatacagcatatccttaaactggacaagttgattcttatttcatatggaatgtaagtggccaagaatcgctaataatatattgaagaatactaataaagatggggaaatctcctagtaaatatcaagacattagaaagattggtggaacactggatagactacacttagcagaataaggagacaggaaatagaggaatatataaaaagacattgacaatatggcagaaatttggtgtacaacggtgggaaaggaacaggctagtcaacaagcaattgtgtgtagaaatggggggagagggtggcagatcccttcatcgcactaccaaaaaaaaaaagaattaaaaatctggtggattaaaaatctaaatttgtgctgggcatggtggctcacgcctgtaattctagcacttttggaggccaaggcgggtggaccacttgaggtcagcagttcaagaccagcctggcaacatgatgaaaccccatttctactaaaaatacaaaaaatagccagaggtggtggcacgcgcctgtaatcccaggtactaaggaggctgaggcacaagaatcacttgaacccgggaggcagaggttacagtgaaccaagattacaccactgaactccagcctgggccacagagtgagactgtctcaaaaaaaaaaaaatctaaatttaaaagaaaaatgcccaaacaactagaagaaagtatattaaaatatttttatgatcttggactggagaaagtttcctgaagatactaaatgcataaattttaaaggagaatattggagtaccaaactgcaagaaagtcaaaagtttctgtataaaagaagacattggaaactacgctaaaagataagccatagacgaacagaggtttaaaaggaatcaaaccctaaatggattatttcctactcccgcaagaactcctgcaaatcaataaggaaacagaagacttagaaccaagtgatcaagtaatataagaaggtgattcagagtaaaggagattgaacaactaaaaatatgaaaatttgttcaaaccctaaaaattaagaaagtatgcctttaaacaacatttgataccaattagaatggttaaaagaattacaagataggatagcaccaagtgttttcaagatagtggaaaatgaaatttttcacactcttgataattctgtaaatctgttaaattattttggaaatacctagtaaagttgcaaatgtacctcattgtgatattacaaactagcaatttcatacacacaaacaaaaaaagctcataaataaccaacaatacacaaagtattgtttgcagttaaaataaaaaccacaataaccttaatgtcagggcatatgtacaacagtgaaaaataaatgaatagatgtacatatgtgaacctggatacatctcaaaaagtatacatgacagcctgggcaacacagtgagacctccatctctctaaaaacgaacaaaaaacaataaaaaaaaaaaaaattagccaggcatggtggcacatgcctgtattcccagttactcaggaggcagaggttggaggattgtttgagcccaggaggttgaggttgcaataaactatgaccgtgtcactgcagtccatcctgggtgacagagagaggctctgtcaaaaaaaaaaaaaaaaaaaaaaaaaaagagaagaaaaaaacaagtggcataaatatatagtttgatattatttatgcatttttgttaaaaagagaaagctatactacagattgtttttagagatgtatgcatattacataaaaatgtgattggctcaggagactaaggcaagaggagagaagatcacttgagcccaggagttcgagtccatcttgggcaacctaacaaaaccccaccaaaaaaacaaaacaaaacaaaacaaaacaaaacaaaacaaaacaaaaaaacgcctgattgatttggaaagatagattctccactacttgacactacttgaggacagtgggtatttctagggaagatgaaaaagtaaaatgtaagtgtggcttcaactgtatatattatattttatttctggggaaaattgaagcttcagtaaatacggcaaaaatgttagtatttgttaaacatgagtgttggatttatgaatgttccccatattactcaaaaagatttttttttaatttaagaagctcagttgattgggttcagcaaaatatgtcgatggcagatttaattcaaaattggaaagaaatctgttactgttttattccaagattagccttattttatcttgcattttaatcttttccccttacattttatttccgttaaacggcactgcctaaaatataacaattccaaataaaagcaacctcacgtataatgtaatttaatgtgcaataatgtcaaaagtcacatcccatggcagagatggaaaaaagcacaatttcagaatttcttacaaaaacatgttgcctgagttacaatatctcaaacaataaagtgaataaattcaaaccctgaaaggtcaaggaataataaaaccatctcattatgcatttactaaaatgagcaaacttatacttcataaaacttatgaattgctgctgtttgcaactgtatgctgtacagttttcatttctcttttctattcttcatgacattttcatgatatttggaaagaaaaatacaaaaacatgaattagaaaccactcattctctctccaaaaaaaaaaaaaaaaaaaaaggaaggaggaaagggtgggggaaccaacaaaagtaggaaaatcctgctagcatatgttcattgcaaggttaagtgaaatttgtgatttcaggacttatcttaaatgagctccatttgatctcccagtttttatattttaataatttgtgcattaagcagtgttctaaattaaagtaagaactgctcttgtatgcaggattgtttaaccagatggctttttgatctcactcggttaaatcttggagaaatatttgtaagagtgagggttcccaccccccatccaccatgagctgcggagaaactgcagcttatcaatatgggttgaaggagttagaagaccttttcacaagtctcttctaatcaacccaaccctgcagtctggcagcatggagcactcttaataccaggtacttgaaagaaaaagaaggagttctttttaaataaacaaactggcaatggaacaagaggcaactgctaaccgtcctttcccctaattttcatcacatgcccatggtctgtaaacgcttcctcttgggtcgagcacggttggtccccaatgacatggccatggatggtgatagaactggcacaggtgtgtttcctccccaaggatgccaccaggggagggcagagagaatggaactgattctcagaatatcatccctacaggatggatgaggaattcccaaggttatgataaagtggaggcatatattgtcttgtcttgcatatattagtggatacaagtgcagttatgttgcatgggtacattgtatagtggtgaagtctgggcttttagtgtatccatcacctgagaaatgtacattatacccattacataatttctcatccttcacccccttctcactttcctatccttcccagtctctaatatctattatttcacactctatgtccagctgtacacattatttagctccctcttataaatgagaatatgtgggatttgacttcttgtttctgagttatttctcttaagaccatggtgtatatataacacattttctttctccgatcatccactgatggactcttaggttgattccatatctttgttattgtgaatagtgcattgttcaaaagaagacataaaaatggccaaacaagcacatgaaaaaatgctcagcatcgctaatcatcagagacttgcaaattaaaacaatgatgagatattatcttactcctgcaagaatggccattattaaaaagccaaaaagattacaaatgttggtgaggatgcagagaaaagggaactcttatacactgttaatgggagtgtaagttagtacaacttctatggaaaacagtatggagagttcccaaagaactaaaaatagaacgaccattcgatccaacaatcccactactgggcatctacccaaaggaaaagaaatcattgtatcaaaaagacacctgcacctgtatgaaggtattttataatcctccctggagctcgtgaacacacaaagcaagcaggaacgtgtcctcttttcctcccttctcaaatctctcacctttcagaggatggtttatctctcattgccttacttctcctactttagagaagtagcaggtttgaacatcagtggcccttcttcttgatcatgctgaaggtgacacattataacaacacttaggaattaaaatgggcatggccgtgtgtcccaacatggcctctggtacatatgttaacagtatacattctactgtggttactaaaggctgggaagcacagagagcaggggagactagggagaggttggttaacggatatgaacttactactaaataggaggaataagtttctgtgtgctgtagcattgtagggtgaaccatgattatcaataatttagggtgtattttcagaaaactagaagagaggatttttaatgttcccaacacgaagaaatgataaacgtttgaggtgatagatatgctaattaacctgatttgatcatgacacattgtgtacatgtatcaaaatattcctctgcaccctataaatatgtacaattgttacctgtcaagtaaaaataaaaggaaaacatatatattctaaagcaaatcctggtatgatttaacattttcttcttctcaagttgagatggtcataaagcacacagttatagaaatgtcacacacatctaaaaccagccaagggagatttttttaatgtgtaaggacactgaaaacatattactcaggaagccttcctggaaatacataaacacttggagatgtgctccaataaaatgagagcccagtcaattgaagtcgattcatttaatcaattaaattatattaaataagagaccaatcaattaaaatcaatttcaatttttttacaatttactatgaaaggcagtaaggcatgagaggagaagtgctaaataaagggtctctttaaagtctaaataattccaagaaacaccattacaaaatggaatgtaaatgctatattcttgaaagaacttacaccagtgtgataaattacgattatgtagttttttaaaggtatatatatttgaaaattttttcttgggaaagaagaagaaataatgctaacacacaggtaaaatttaatggatgacaaaatgaaaaaatcataaaactgataaacagattcaggtataaatctgtgactccctcttaaaaatgttcaagaggaaaaaaagataaaaatagagatggagagaaagagagattgctaaagtagaaaacaatagaattgataaatgggctataattatatagataaggatgacatgacagaatcttagaagtacttaatagaacactatcctattaagttttaaaatctgtataaaatccatgcttaaaatataaatttataaattaagaaaatttagactaactaaaaagaccaattaccatggaagaaatctaacatgttgttaaggatcttgacttcaaagaaggcaaatttccccttcgaagaattttggagaatttattcctcagcactttttactactgggtgtgcactcctgtcttgttggatccaggtggcttaatgagtcgaccaatcatatttgagaaggaggaacatggtcgtaggtggagaagaaataattttaaaaccagctgtcttagtcagatggccaacctatttttatatccctgtggccagtgggtgtggctgtcatcccagcatgcacaccagctgtagaattatggggggctacctgcttcccagagctaggcaccctcagagaggtggtgcaacagcacaggtggcacaggatgacacaggtggtcttcagctgaacaaacagattcaagctatcgatgtcactgtgaaacctgagactgaatgcctgcaaatcaaagaaaatgactgagccaagtctcaatcaggaggttgaggtttattaggaggtttatttattaggaggtttatttgctgtattagtccattttcatgctgctaataaagacatacctgagactggggaatttataaagaaaaagaggtttaatggactcacagttccacctggctggggaggcctcacaatcatggcagaaggcaaaaggcatgtgttacatggtggcagacaagagagaatgagaaccaaggaaaaggggtttccccttataaaaccatcagctctcatgagacttattcactaccacaagaacaacatggaggaaaccgccccccatgattcaattatctcccaccaggtggctcaagtctgtagttccagcactttgggaggccgaggcaggaggatcacttgaggccaggtgtttgagtccagcctcggcaacatagagaaacataacacacacacacatacatgcacacacacacacacgcacactgttagacattagaattgcacaatcctaacataggaagcaatcacatcatgtttatgcttatttacagcaacatgcttatgcttatttactttatgttattggacaattttcccgaaactgttctaagccctttatgatgttaatactatccccattttgcagatgagaaaaccagggcacaaagggattatgtgacttgccgaaagtcacgtaggcagtgagatacaggcttaaacttttaattctggaatacttttatgttcacaaaatattgaaaaggctattaaagagagctcttggttaccccacatccctttccctccgttagcatcttggactgccatggcacatttgttgcaacgaagtcacccattacttttagtaaactccagacattattccaatgtccttggattttccctgatgtcccttttttattccaggatcgcacccaggataccacgctgcagtgagtcatcaagtctccttggactcctctggctgtgacagtttctcagaatttccttgctttttatgaccatgatggttctgagaagaactgcttaggtattttttagaatgccctgcaatttgggcttgtctggcgcctttctcatgattagactaaggttaggtgtttgggggaggaagatcacagaggcaaagtgccgtgttcctcacatcacattaagggtacaactctcaacacgacttatgtgaaggaaaatatcttgggcccttaaaatgactacgctaaagggaaaagtccagctgggaactgcttagggccaaactgcctcccattctgttcaaagtcacccctctgctcactgagataaatgcatatctgattgcctcctttggagaggctcatcagaaacccaacagaatgcagccatttgtctcttatctacccatgacctgggagccctgtccccactttgagttgtcccgtctttccggaccaaaccaatgttcatcttacatacgttgactgatgtctcatgtctccctaaagtgtataaaaccaagctgtgctctgaccaccttgggcacatgttgtcaggacctcctgaggctgtgtcacggacacgtgtcctcaacattgacaaaataaactttctaaattaactcagacctgtctcaaatatccggggttcacatttttgtaaccatggagggattctgagttgtgggatatgatgaggtttctcttcaaatagcctgatcaatcctttattctttaattcatagtacctccccacacatacacacacactcctttttcctttttctcttttttcctttctgccttcgttacacgcccggacacgccacagtaccaggcttatcagtaccagctcacattcctttccttatttggaagcaagactagctctctagctcattgcagacagcccttccccttttaccctctctctcttacgtgcccaccttatctaaagaaagttcaaatgtttagccaacccggattagtccaaattgtgccacccgaccccagccaatgggaaaaggataccggggcaggacttgcatcaggaataaaggctttcatgccccttagttcaggtgtgctctcatggtgactggccaaggagaagcaccctctgcgcagaagtaaaattgctttgctaagactcctttgtttcagtgttcaatttccttagggttttgagtgttattcccaacatgagtggaggtgcccctgacctttgacaaatctcctgttggtgcttggtaacagtttgaggtaactttatggctcaaaccaataggacaatttggtgaggtctggaagcacccactccagagaatccctgacctcccactgatgatgctgacatgatcgcctggctgaggccatgactgtcaggtttatccactgtaaaatgacttcttcctctcctttgcacattgtactccttggaaataagtctcgaagcacagcctacactcaagggaggagtggagcatggattttcacacaagatgtgtgttcttagccattacacaatcacaaaactgggaatcactaaatgatgggaaaaacaaattgagttccaatcctgtcttcccatcctcttttagttggttttgtgtgcttctgagaagcacactccctcatgggaaacctttggtctaggagcgagacccacaagtcaatagaacaaaggttacagtatgaggttatgaatagaaatagcaaagaatatcgctgctgggtgttcagagaaggtctggctgagggggtgacctttctgctgaatcttgttgaataagtaagagttatccaacataaaggtaaattattgccaactaagaaaccacccatgctaagagctgaagacttgagtagagacctaagttcactattcttggagcccacagtgctagaagtgaggcaccaagtgacagacctgaaaagaaactcacaaagcacatcacaaagaactgtgaagttcaagactcaagacttgaacagaaacatctggcagctagtgggatttgagagctgacgttggatctttaatttccaatagagaacatcaatatatcagggtaccaactcacttggtttctaaagccatggcttactcaactgtagaacatctatagtccaaacccttgccaagggatgtagtctttttatttttattttattttattttttttagacacagggtctcacactgttgcccaggccagagtgcagtggtgctatcatatttcactgcagccttgaacttcctgggctcaagctatcctcctgtctcagccccctgagtagttgagaatgcaggtgtgtgccaccatacccagctaatttcttttaactttttgtagagacaaggtcttgctatgttgctcaggctgatcttgacctactggcctcaaacaatcctctcaccacagcctcccaaagcactgggattacagtcatgagccactgcatccagcccaggggatacagtcttaagctacgagctgtctgagtcttaacaaaatctcagtggactaaaaactggtgaaaaaccaactaaaataatgggatacccattgtcactcatcccattagcaaagattaacacatttcaaatacccttgaaaatatggttcttggctgttcctgttcaacattcaaaatgtatatgccctttcaaataacaatgtcattttcatagtataacctgcaaaataagctacagctacactcaaccaaatgtacaaacaggttcatataattatatttcacagcgtttttgtttctagtagcagaagctggaaacgaagtcaatgtccaccaaaggaaagaagaaaagaaggagggaaggaaggaagggagggagggagggagggagggagggaaaagggaaggagggaagggacggcggaaggaaggaaggaaggaaggccattaaaacctccggtacttcatactgagttcctgtacatttcagtgtgatgataatttaaaatgccaatagataatgttaaatgcaggagaagttacaatataacgactgtagacaggtcccatttgtactccatcatatttcatatataaatacatatatgcaaagcccagaacacttatgaagagatacacaactaattgtcaaaagttatttctggagagcaggatgggaatagtttgatccctttatattcttttatttaaaaatcactttctcaacagttcagtttatgatagtaatttttgggggaaattgtaggaggctgttccaggcatctctcctccccagtattttgcatcattagatgaaaggcacctttcagaatgctgtcagcttaaaaattattattctgggctcccaaagatagatttgccctctctgctttgcattttcgtgtcctggggttggctcactgaggaggcctcatttgtctgtaggtttagaactgttttcctttatcaaccacaggaaaaccactgttttccctgacaaacttgtgtgggcttatatgtgcatactctcatacacacacacacacattctttattaaaatgtaaaatctcactaaaagcttttgaacaaagtaaaaactcattaatttatattttctttttagcttaaattagaggcacacgtgaggtaagtgaaagaaagagagagaaagagggagggaggtagggagggagagagggagggagggaggaaggagaagggaagggaaggagggagggagggaggaagagaggaaggaggggaggaaggaaggtaaaagtaagggaggaaggaaggaaaagaaaaggagaggagagaaatcagtgagggagtaactgtaaataagatggttgagactataactggataaatgaattaataaagttgtatgtaatctgaggtctctgataaatttcttccacttaattttcatatattttttatgaaaccagtctaaccactgagtaccatttttctttcctgcactgtaggttaactttaaagatacattagtggtccacagccaggaaaggatgctaatgtcagcggcccgcacggaccataaataaacatttcaaaggagcaatggtgcattcaggaacggtctctcaaattgcacgcgcaaaggtggcatgtggagccaacaccaggtaaaagactgcagggtgatgagaaggggcatggattgagccactgggcctgtgctgactccagcctttgcatggagctcatccacttacgcttgaagccttgtcttctacagggaaaaggaacaggaatgctgggtatggggagtggacaccaggtgacgggattaagtaaggcttttaagggagacggtatgggggaaaggagcaagacttgaggcagaggagggagccagccagtctgctcgggagaggcacgcttcgtcccggtgaagaccagaccagagcagccaatccagggggatctgactccttccaggaatgggaaggaggagctaggggcatcggcaggaggaaataaagtcacaggggtgaagtagaggtggaggaggcctgatgggggcggcgcctcagaacctcatggggactctggccttgactctagagaaatggtagccactgcagcgttttgagtcaagggctgacatcatcagatgaacagggtttcccagtcaaaggctcccttcggctgctgtgctgagggtatttggtatgggggaggcttctgcaggaatccagagagagatggtccatagcggctcagaccagaagggtgaaggaaaggtttggctgcggatctgattggaacacactgagatttagaaaggtgagagattgggccaaattcatgatgagaagcgggatccacagtttaaactcggagctgccctaaagcaaagcctttttttttttttttttttttttttgagatggaatctcgctctgttgcccaggctggagtgcagtgacaggatctcgactcactgcagcctccacctcccggattcaagtgattctcctgcctcagcctctggagtagctggaattacaggtgcctgccaccatgcccagctaattttcatatttttactagagacagggtttcaccatattggtcagtctggtctcgaactcctgacctcaaatgatctgcccaccttggcctcccaaagtgttgggattacaggcatgagccaccacgcctggccaagcaaagatcgtttctgggacagctgtttccgccttgacagggatccagactgcttccacctttgcaaagctcaacaaaaaaatctcatttcaagaatgttgccttgttgagtagtggagggaagaaacagggaggtgttatccaaagggtatgaagtttcagctagacaggaggaataagtttttaagatctcttatgcagcaaggtgactatagttaataaaaatttattgcatatttcaaaataggtaagagattaaatttcaaacgtcttatcaccaaaaatgataagtaaatgagatgatggatatgttaatagtttaatcattctacaatgcatacatacagcaaaacatcacattgtgcctcataaacatatacaattatgatttgtctattaaaaatattattaggcccggtgggctggctcacgcctgtaatcccagtgctttgggaggccgaggaggaaggatcgcttgagcccaggagttgaagatgagtctgggcaatgtagcaagaccctatttctacaaaatgaaaaaaattagtggtgtgcgcctgtagtcccagctactcagcaggctgaggtgggaggattgcttgagcctagaattttgaagctgcagtgagccatggtcacaccctgctacacagtgagaccatcctgggctacacagtgagaccctgtctctaataataataataattaaacaaaaattaaagaatgttgccttagattttgcagcagtggagtgctagcaaaggccatgtgtttgggggcttctcttggatttacgagaatcaggtgcacagacaaattacgtataggaggcctgatgcttgcggtttatcaatacaaagctggaatatgcattgcaagcaatttacaaatgaatgaatcatattaatacagaatgcctgctggatccgactggttacatagtattcaagtgctcccaaccacaatctgttctacatcaaaataattcatttaacctcttgcttatcaatgactttgctatgtgagccagtgatattcaggaagctggtgcatatcatgaacttttcctgtactcctcacaacacttcatggttctcagaggcccagttttactcagggcaggctggtttctttttaaccaagttaagattgcattctgttaaagagataaaaatatgtttccatggttcaggtagtgttgggctgagaccatctacacttgggacacagatctgtccacactgccctcttctccagatgttttcagtgaccaaccacctcggacactgcaaagtgaaggaaaacgttttgcctcaacataaaaaaaaaaatgttatgaggtcattaaaaatgctgaggaaagcagaaaagataaaacctccatagaaacaaaatatacttatttttgcatacctttctctctttgtgtatttacttattttacataagtatcacatagaaataaattcagacatagaagctacaatgtttcacataatgatctacccacttaagtgaagaaataaaatattactaacaactgcagtctcctgtgtatacttttgcaaccaaccttcactcccctccaccttgtagtaattcatccctctcttgaattaatcttttaatctgttccatgcactgctttatacttttacaatagtgttgttcacactccatttacacacttgatgtgtacagctttccaaatagggaggccaaatagggaggattgcttgagcttaggaatttgagaccagcctcggcaacatagtaggacctcatctctactaaaaattaaaaaaaaaaattagttgggcagggtggcatgcacctgttttcccagatactcagggtgttgaggtgggagaatgacttgagcctgggagattgaggctgcagtaagccatgatcatgccactgcactgaagcaactgatcaagactttgtctcaaaaaaaaaaaaaagaagcaagaaaaggaaaaaaaatctactccattaaggtatttctaaaccaataacgacacacttcatttgtaaatgttcattccttcattcaagaaaaaaaaacattgaaaactttattgagcttctagtatattctagatgagaaatatagtgaaagaataagaaaaaatttaaactcgtatcctcagtgaattttgtattatactgagggaagatacaatgaacaatcaatatgaaaaataaataagtggtctagtagactgaataatgccctcctatccccaaagatatcaggtcctaatacctggaaccaggaaaggttactttatatgaaacaggctctttcatactttatatgaaaaatgcaattatggattttgaggtaatggaattatccaggtgggccctaatataatcatgtgtatccttacaagaagaaagcagatattattgcacatatagccaaagaaaataaatcattctaccataaagacatatgcacacatatgttcattgcagcgcagttcacaatagcaaagacatggaatcaacctacatatccatcactggtagactggataaagaaagcatggttcatatgcaccctggaatactatgcgtccataaaaaaggatgagatcatgtccattgcaccaacatggatggagctggaggccatgatcctaagtgaagtaacacaggaacagaaaaccaataactgtacattctcagttataagtggagctaaacattgaggacagatagacacaaaaaaaaggagaaatagacactggggcctacttgagggtggacagtgggaggagggtgaagattcaaaaaccacttatcaggtactatgctgattacttgcatgatgaaataatctgtatacaaaacacctgaaactcacaattttcctaaacatacctgcacctgtaaccctgaacctaaaataacagtttttttaaaaaagaggaggcagagagacatctgtcacacacagaggacgagacaatgtagagaaaaaagatctgtgtgctgtgctgatcttcaagatgggattcaggctaaaggaagatttagattcaagcaaaggaaggccagctaccaccaaaagctgcacgagataaggaaggatcctcccctagaggcttcgaaggcagctcatctgttcttgatttcagactctggcctccagacctatgaagaaatacatttctgttggttttaaaccatgcagtttgtgctgatttgctaaagcagcccgagaaagcaaatacagttggcaagaaatattatgaagaacattagaggggagtagctagtgcttggggtagggagttgcaatttagataaagtggtgagagaagactgctctgagaaggcaacgtttgagcaaagacctcaagaagggaggggaggggattgtttctagaacctggtaataactctgggagagctttgcagtgagagtgagcagcaggtattaggaccctgaaggaggagcattcctggaatgccctaggcacccagagtggccatggatgagggagggagggagggagagtagtaggaggtggggccacagaagtgatggcggggacccatctttgcatgtcactgcaaggttctcaaattttaggatgcaggagaggggtatcgtaggatattgagaagtatccctggtctctgcccaaaaatgccagcagcaccacccaccccatttcctgtttccaggttgggaggttggcacaactttgtctcctattttaaaaggattactccatcaactgggtttagaataaccttgagggctttgtgctgtcgatgcgagcactgaagcaaaaaatacaaatagtattactattatcctgaaagacccaatggtagcagtttctagaaggtcatgatgagattaatgagaagaggtcatattctggatatgtttttaaagttcaacaggcaggacttaatgaactggatatgaaaaaaaaggagtagatgaagatgccatcatggcaccctagaaaaccttggacaatgctagcagatgcaggtgcaggcagtgcttgatgcaactcttggtttctcatatcccagggggtgtggttggtcccccagtccacatcatctaatttagtccatgtacaagagttcttagacactcagaaacacacacagtttctagaactgaggacaattctacagcttacaaaaccatcatggatgatgggcaacaatgtaatggaatctgttggtgccatgcgtgtcgatttctgagaagtgttgtgaagctttattggaactctggtcattattgtcttcttttctagatgagtagttcccaactctgtctgcaccttagaaccacctggggaggcttaaagaatcctgtaccccagctgaatcccacaccaatgacttctaagtctccaagcgtggaatccaggcatatgtatttttgaaagttacccttagatttttcctaaatgttttgagcaactgtccattttctcttcatctttatcccataaactagtgatactctacagggattattctttccctagggacatttggccatgtctggagacattttgggttgcaataacccagttagcatctgttgggtagagaccagggatgttactcagtacccgacaatgcacagcacagcccctaccacagagaatgacttcaccctcaaatgtcaaagttgagaaaacctaccccaaaccctcaaatgtcaaagttgagaatgagaaaacctgcctcaaacccagggaatttgattactgcattgatgggttcattaatcattgccagacatttttaaatgcctttcctctttttttcggtgcttttgaatttaattgacaaattgaaggtcgcatgggaagacagcaaagaaatagaggaagagagagatagagtacaaacacctgcgttgagtcaccatttcctgcagccctgagtgcctctagtagctagtgagggggacaattagcagtttttgagagtgatgagaacaactatttgcatgttcttttccttcctgaattgtgtttgtgagagctaagttaatcatctgatagagccacattcacacgccaggtgttgcggttgaacaccaatgtctgtttcttcaaggtttcgaaaatggttcacggaagggcctgctttttgctgaaatcgtgcacatggatgataggaacacttccactctcaacagtcacatggcatcccttaggaagctgcagtgacctagaagccatcaaggacaatttcctgaaaggggtttgcttttctgagtaaccgcttcctgagcttgcttctctgtttgtgggaccttatttttcagactggctcaaataggttatcaattcggagtaacattgctcctctccagggacatttggccatgtctgaggacatttttggttgtcgcaactggaaatggcagagtgtgtgtgtcgggggtgctgctagcatttgttgggcagaggccagagatgccacttaacatcctacaaagtataggactgccctccacaataatggtccagcccctgatgtcaatagtgtcaaggctgagaagccctagaaagagaacagtaggataaagaaaaaatgaatgaacttacaaataatttccactatgtgatttagatagaggcacaaatattccctctcttctccaaatatttcctccttcatctgttgatcttcaagggagttttactgtaaaactttgagcttgtcttcatgttccaagagggatggaacctgagctaaaatttaatacctggctatttttggagtagtattttagtttctagaacctgggaataggcagtgcccaactgatgctcttctcatttatttattagcctactaagattttgtgaatggttacagtaaagacaatggtcaaattttatttatcgcagaatgtctctgtcatgtttgatcatagacacctttagcagggtaatttttactattccctattcctttagggtgatcaactcatcctggtttgcccaatactgtcacaatttcaggagtgaaagtcctatatcctggcaactttccgtattgtggggtgggtggtcaccctgcattccatggaattggttttccaagtaataatttttgtgaaatgcagcactggtgtttgttattttattttatttatctggtattttatttggtatttggtattttcccaaaggataacttggtaattagcattctcccattgggaaaataattgatcaaaaatctgttgtcatggaatagacacttctttgtacacatggttggacctttaactagggagacaaaagattatatttttaacaattaaggatacctattttatagagttgtttctgaattattccagatttttcacttcaatattaaatttatttttatcagattttataaagctcaaggaccattagagatgtccctaagagtaaggtttttgcaaatttaaagaatctgtttttgcgtgcctgtcagtattgtaatcactttttccttttccaacataagatcatacattaaatttaaataatagccttattaataattggaacccactgcagagatccctgagaaggcccagaggccacatgttgagcccaagtgagtgcattcattgaaatgtcatgtcagtaataccaagagggctgataatgatacaccctctcgtgctcctcatcccacactttcacgacatcttatcaacgagttctaatacaataaacttacatgcacttgatagaataattgccattttaatttaaaaacttggcagaggccaggtgcggtggctcacgcctgtaatcccagcagtttgggaggctgaggtgggcagatcacctgacgtcaggagttcgagaccaacctggccaacatggtgaaaccccatctctactaataatacaaaaactacccgggcgtggtggggcacacctgtaatctcagttactctggaggctgaggcagcagaattgcttgaacctgggaggtagatgttgcagtgagccaagatcgcaccactgcactctagcctgggcgacagagttaagactccatctccaaaaaaaaaaaaaaaactcggcagagactgaaattgtttgtacctccaagtcttagttttcctctgcagctctaagccagtggaaaattgacaaattccaacacagtttttgagaattatctatgtgacttcaaacgtgttagtttacattcccacaatggattcacacatgcatacatatggcaactgttgcatatgtaaatgaatgcatctataggaagtcaataggaattcaatatatctttgtatgtgaatttaatcgaaactgatgtgtctgtatatgcatatatacatatatacacacatttatacatatagacatacataggcacacatgaatatacatagataagatagatatagatatatagagggatatatagagatagatggtggatgaatagataggtaaaaacagatatagacatatgtagagagatacataggtatacataggtaggtaggtagatagggagggagggaggtagataggtataggtaggtagataagttgattgactgatttcatgatacatcctggaaagttacatacaagtaaattcctaatatcaactcatttttatgccattttttctcctcaaagtagaatactacatgcttgtataaagatttctctctttttaaatctctctctctctctctctctctctttctttctttctttctttctttttctttctttctttctttctttgatggagtctcactctgtcgcccaggctggagtgcagtggtgcaatctcggttcactgtaacctccatctcccaggttcaagctactctcatgcctcagcctcccgagtagctgggattacaggcacatggcaccacgcctggctaatttgctacttttgtagagacagggtttcaccatactggccaggctgctcttgaactcctgacctcaagtgatctgcccgcctcggactctcaaagtgctgggatgtgagccaccaggcccggccttccctcttttttaatgtgtatagttggaggattctggataaataacagggaaatgatataactggatttactgaattaactctcaaaacccttttctggattcagacattgagtgggttgatttaggccaaggtccccaaatcactgcccacaggccaaatctggcccactgcctgtttttatgaatacagttttattggaacagtcacattaatttattcaggtattgtctgtggctgcttttgctgtacaatggcagagttgcctatttatggcagagactgtgtggttcacaaagccaaaacatttgctatctggccctttgtaaaaaaatctttgggctgagtgtggtggctcatacctgtaatcccatcactttgggaagccaaagagggaggctcacttgagcctaggagttctagaccagcctgggcaagatattttttagagacactctctacaaaaataaaaattagccgggcagttgtggtggagcacacgcctgtagtcccagctactcaggaggctgaggtgggaggatcgtgtaagaccaggcgttcaaggctgcagtgaaccatgcttatgctactgcactccagcctgagcgatagagcaagaccctgcctcaaaacaaacaaacaaacaaaaaaccaaaaacaaacacaaaaaaattttgcttatccttaagtcagattaaagagaaccaggtacagttatttttaagaacacatggtttgagaaagtgaaatacatagcttccgctcaggttacaaagtcacatatattcaaatatagtgttttcaaaaattaggaaaataaaaagcccccttttaaaatgctggacttctttgtttggaaaaatgggaaccattctgtgttgaccttgccctattctccttcaagatgctttcagtaggggaaactggatgaagaatacacaacggcttcctgtacatcatgctgcaacttcttgtaaatctgtatttgttttaaaataggtaaacttaaaaaaataaataagctcaagcctgctttgctctgttcttattgcagtgactgtctctatcattattgcatggttcccataagacgtggttgtctgagggcagccccaccagccagtcaacaagtttcatcacgaataaaattccaaattttgttttggatacaacacaagccactgtggcttccattgctacaggctaacattgacttagtgtttcccatttaccaagattgtaccagctaatgtaaagggtttggggtggtgggttcttccacatttcaccctctaaagaactcaatgaggacttgcatgattattaatacgtacaacctggttttatcttcacttccatgctttccattgcttttgtgtttcacatctcatttcctttgttccatatgttgaatttatatctgaagccatattcaatggacatggggacatgagagcatgcaagttaatcaataggtcagcatcgcaatagtttgcagctgtaacaggatgcccaggagtccagatttccaggtctgtcaacgtcagctccaccacacatttgccatgtgacttaaatcatccaaacacaaaccacagtttccccaggtgtgccatgacagggcgccagcaaagctggagtacccccaagttccaaaatgccaatttgttatttggcatacagggaagttataataaggggaagtaaaatgatccagaatcttgaattcataattcccaccttattttttggtgtcatttataatgaccacatctatgtagtaatcggaacgaccacagtgtcttcatgatgtaatatcctaaggcattttagggaacctcacccagtggcatctcttagctaccccatggaggtcaaaagttgttggtcacacatccagcaattgaatggcttgaggggaatgaggtctagacttggtgtcaggtatttgtctacatgctatttggaagaattagtaacacacaaggtttgaaggaggacaattttgtcaattatacaaacactgctgtgccccttaaaacattcctaaaaagtgttttctacttcatattatttccaaaaaagcaaattggcaagatagagcaagaatgttaaaaatgttggatgctttacaggtaattctgtttctgagtttttatgcctagggatggaatcatcaatgtgcagaattctttatgcacaaaaatcttcataattgaacaatatataacagcataaaactggacccaatggattcaaagatagaagaagtgttacggctacaatggaaggtatgcttgatggaaccttttgcaactatttaaaattatgatggaaagtgtatatattaccctggtaaaacatttcttataattctgataatcattgagtctgtatcttagatcaggcactgtaatgggttactttatttaaatatttattatagccctaatatactattaaagctattgtgttacacctgacaaaactggggcagggaggagataagaatcctatccgaggtctcacaggtatttcccaggggggcgaaagacatcactgaccctaacagctatgcgatgacccactagtcaagactacttcttcaggcaatatgcatgatacaatagtatctcttgaggccatatgcacaatgcaaaattattcatattataacattggtgcaatattttaaaacctagatagatggaagcaacaataataaaaacgatctcaatagaaaaatattaaacgaaatattaatcatcataataaatagtaaaaagacaatatcatcaacgagttagattggcgaaaagaatcaagaaaataaaaaccagtttctgccaccagtcagcaactactgtgacaatccttggtgcatatatttttatatccttttctctgctttttgcctgtttacatagtcctgctcgaaaattgcagcatgatggcagtatcaaggactgtgtcaacactctgtaaagaggatgagttgaatggggccataagtacaaatgtgactgtacttgggtgaaattaaaactctaccatgcagctgcgcactaactgaattctctctggcactgatactttacttcctcctcaccgctgattatagagacttccacgaataaacaaactctcttaactcacatatggggtcttctatctgcagaattcatgcaggaatctatgattccatttcatgatagtcccatgccagtactttctttgaggtaaattgtttagtagtcttggccactgcactgtgaccattgctcccaatggaaatgaatcaaggtgtcaagagaaagcttggagtaaacaacaaagatcacaccacagaaactcattattatgcattgttcaagaccagtactacctctaaatgaaaattggacacaggatcctcttttctggaagtggccagtgggtttttttcaaaatatgttatacaacagtatcctggatgtcacatgctgtttgtttgtttgtttgtttgtttttgtagagagatggggtcttgctctgttacccaggctggagtacagtggcacaattatagctcactgcagcctggaattcctgggcatgagcaatcttcccacctcagcttcccaagtagctggaactacaggcatgtgctgccatgcctggctaattttattaatttttgtagagatgggatcttgctatgttccacaggctggtcacaagctcctgggctcaagcaatcctcctgctctggcctcctaaagtgctgaaattacaggcatgagtcactgccccctggctcccatgtcctctttcattgacccaatcttgactcctcagaacttttccatagagaggggcaagatccactgatcacaaagcccccctggggctgtggcttaggaattgaaacaactgaaatttcttgcttaaagaaatttcaacaagaagtgctctatcttataggctgtttaaattggaagaacacatagcacctccctgtgactatatgttcttcctatgcaactccaacagcatcgtgttcaataacctccaactctgaccttacccagcccagctctcaaatcagaatcaatggttaatgcttgtgaacctgaagaactctctgtcagtgcctcccttgagaaatttctcttatttttacttgtgccacaaacttatttttctatctcccctttgagaccttaagtgaccagagactgggcactatatttgatttgccattttcttttttacacaacattctttatttttatttttagttctggggcacatgtggaagtcgtgcaggtttgctacataagtaaacgtgtgccatggtggtttgctgcacctgtcaacccatcacctaggtattaagcccagcatgcgttagctatgtttcctaattctctctctccccccaccccatcccccaacaggccccagtgtgtgttgttcctttccctgtgtccatgtgttctcattgttcagctcccacttataagtgagaacatgtggtgtttggtttttctgttcctccgttagtttgctgaggataatggtttccagcttcatccatgtccccacaaaggtcatgatctcattctttttatggctatatagtattccatggtgtatatgtaccacattttctgtacccagtctatcgttgatgggcatttgggttgattccatgcctttgttattgtgaatagtgctgcaatgaacatacatgtacatgtatctttgtaacagaatgatttacattcctttgggtatatacctagtaatgggattgctgggtcaaagatatttctagttctagatctttgaggaatcgccacactgtcttccacaatggttgaactaatttacattcccaccaagagtgtaaaagtgttcctaattttccacaacctcaccaacatctattgtttcttgactttttaataattgccattttgacgggcatgattggccgtttttaagtagagtacactagtcaatacatacttttgtaaaggtataagtgaataaatacatgaattattgatgcccaaaggaagatattatgtttcccctctggtttcagtacacgggcagtgtctgtgcttgaatttgtcctgatttcatgagctgggaagcacacgagccatggtttttcacccttattctcagaaggtacaatgccatcctatgactcatcttgaccttttcaggtatatgcatatgcatgagacccttgtcaatattaaaaattctttcaatttggatagacattcctctgttgctgcccaattaactatacatatcattttagagaattttccaattagtgatgagtatattgatcattggctaatgttaattagacaacataatcatttttggaaatacaggaaataatatcccacattgctttggaaaggtatatttaaatatcagtttaatctttgaagtacttatgaaaatgccccagtgggaataattttacgggatcataatactcggtaaaaattctaactagtctctgactcattattaaaattcaaaatcgcaaagcaccatataccaagtgatgtattgtacataatgactttcttattcaatttttctaatctattttttatcccctaggggttttttctcagtaattgtccagagtttaaataaaagaatagtagtgattgaatcttcatgcgtctttatttttagactcacatcttgaagtctgcagaactagcagcagagaacgtaagagaaaaatgggtgtgaagatgttctatgaaaatcattctaagttactacatgtccttcagttcatcacaccaaaaaagaagagaaaaaccttggaggggaaaaataagtctcctctgttttgtataagagcaaattgtctttccatatcaggacttgtttatttgacacctgggggtctcatcagtaataggatacagacatacataaaccctgtcatcttcattgcagaataaagatgccattcatgggtcatgacctggtagaaactgtgcaaatgtgtgttgaatcagggagtccaaatcaccacacctgtaccagatccatttttagttgtctctgaaatacagagccctcgggcccagagtctgaataattgctggggttcctgcaggcttcttttatgttcaaccataaagatttaatacaaattcttattgcagaaccatggtcacattactgttgatgaaatcattccttccatcaaaatcagtcagatccaacgtactcaattctcaaatacggtgcaggcagcattgtagtaaacatcactgaatagactcgttgttcagtatgtctcaaagacctgaacaggctgttcagccaaagcttaaataaatgcaaaaatcctaggaggagagcatgctgtttgaacaactcaggttcagtttaacactttctactcctttgaaaaaattaagacaatcccttaaaaaaaataacgaacaccactttttcaatcttgacacatgcagagaccatgcaagaatatgaactaaaagaagagattaaggttgcatttaggaggtcattgacgagtgaccttgaagatacctatttttgaagagtagtaaattctgaaagtagaataagtaggaagtgaaaaagttgtgacagtaggtgtggacaaatttgtgaatgtttgcccagcaatggatgtgctaaaattggaaacatactgatggatgacatttggcaagtatgttgagaaccacagagagctaattcatctgcagatgtgccattcttagaaaggttggcgataaagaagagaaaggagatgaatgatggggaccatcatgtggatgagatagaatttacagagcagagagggagattcttatctcggatcctatgcaccccagaggcggcagtgaagaaagaatgcaggtatagatcattttgcaggagatgcaaaacaccaacgaaggttattcctgataatgtctatttctctgtgcattagaaagaaagattgtgtgctgaaagtgaggggtgaagtggaggacttgagacgaattggagtatgttggcaaaagccagtgtgagaaatgggagagggacttttatcaggcagcagcatcgggattgtgcacaacaccagttaattttggtgctcagagagcagtaaagtcatgaattttcactgttggatgtgcctggtgatagtacagagggagtatatggttcgattgatctgggattagtggttggtgggactgagctgatttgaagaaagaagaagagggaaaggaggtggccgttgtgtttaggctgcaattgtctggataggagaggacggtaactgaagctgaattgcagggtggatggagaattatccagagagaaagaactatgcctacgtcagggaagacactaaatgatttgcaatggagacttcagaaatgaatcttggcaggatgagtttcacattgctgctgaatgttaggtgcacattaaatattttgtttccatgatgcctttgcctaagatatgggaaatgatcatttatacaagatgtttctgtaaccacagatctcatttttcccaacaagccacttaaaaatcagtctcctgcaacctgaaggaaatgaacacgttgagtcactaacaacctctcttgcattggtgtcctctcatgcgaccgtgaaaatggcccttaaaatctgcccatgaaccacagagatggagtgcgttaattttttctcctccctttccttccagcaatgatttttgcctgaaggcatgagattcgattatgaaatgactattgactaacagcactggaggatgacagaaaccaaagagtcgagtataaaataactgaagttaaatggaacgtatttggggagatgagaatacaataaggggatggatggtacacactcgttgaacgtttgctgtgcagcttcttgcattaagagatgacacagtcaaggctacacccagggaactattacaggtgttgtttcagagtgtggagccgttcatgttcaaaaggctggatctgcatttcaaatatataaaatctcacagatttatatgaatgatttcatcagattgaaatcgtttcagcaattgcagcccactggagtcttgggtcaccccctgccattttcattcagcacctagtagcattttgttcttactacattgatttgtgcttgttgattggtacctttggaaataggactttggatgaattgtgtgtgtgtgtgtgtctgtgtgtgtgtgagcgtgcattactcccaaacgaagagagtaaacccctgaagaggcagttcactgttaccattacataaacgcacactgcttaaagattttctcacttcaggtgctcggtgtatgttgctgactggctaacttcaggtagatggggttttctgctggaaacattgacccctggtaggctttgttgaaaatggctgggggtttgcatttccctcaaagaaacagtttcagtaaaaattccaaagacctcatttaagagcttcattccaactataagatgcactatcggcttcacaaaaacacttgtttccatcagtggcagtttggttattaacccagtaactacttcaacaggaagacctgaaggatatacaaagatgatctctgaacactggacactatcaagaatatccaggaaatttctagttcagaaatacaattgcggccgggcttggtggctcacacctccaatcccagcactttgggaggccgaggcgggcagatcacaaggtcaggagatggagaccatcctggctaacacggtaaaaccccgtctctagcaaaaatacaaaaggaaattagccgggtgtggtggtgggcgcctgtagtcccagctactcgggaggctgaggcaggagaatggtgtgaaccggggaggcggagcttgcagtgagccaagattgtgccactgcactccagcctgggtgacagagtgagaatccgtctaaaaaaaaggaaagaaagaaaaaagaaagaaagaaagaaaaaaagaaagaaagaaagaaagaaaaagaaaattgcaactgtgtcatgatggttgcaattgtgacctcaaaaagaatactacgttctttatatgttgaaaggaaaagggaagatcagatgccaattctggtgcccttcatcattgctatagatggattcccttaggtaacttgcttgacaattcccttcgcaaagtctctggttttcaataaagaaatcacagtagctggaaatggagggacattttggcactaagttctcacaattgcctcttccatttctatgttctatgaatttatttagtaaacaccctgttcatcagtacttgagcaatgaaaaataccagatatttcctttgaaaagagaagaaaaagaaataaaatagcaggtagccacaatcctattaggtaaggagaatctcttggaaggagctttgagatcatttttcaagataaaaagtgcaacctttcatctcactttaagagacgtcagaaatataaaactcattatcggccacgcttaggtaaatatttctcctcacttctcacctcagaaatcctcatatttgtatgaatgatattttgagtgcaaaaacctataaattatgcaagatatttttacagcaggaggaatttagccgagcactcaagcagaagaacgattggtgtttttgcagcttcactgcagttttgagaagtcagaattatgaggcagcatcacctgtgcttcttataacccctctctgtcctgaatcctccctggccactttgttctctctcttccatcaggagtcccggtgggataatctatgtttcatctcatcatttcctaaattcctcttcttcagtccctagcaggcaggtggtgctttattcttctcaaattgtttccccaagggacctcccacctgctacacccaggggactataaatcctcattcattctgacctccttcggaagcatttaaaccccatatcacttcaaattctctctcctttggcctctgacagcactttcttcctggtttcctaaacttcactcgattgcttcttcttggtcttgatccatttaatcattcctcctttttctgatcaaccaggaggcagcacccccaaaggttctgagttagactctttgcacatacctggccattgctgtattttcatctgacaactcactgcacagattctatgtcctatggaagaggtggactttcacctgaaggtaggggccatgaaaagccactgaaatattctatgcaaaggtggcctgatccaggctgtccttttttaaaagccacactgtgctcagagtggaggatttattaataactaggaaactgtagagacaggataaagcaatttgaagaatattttccttaatacaaatgaagtaaaggtggcactaaggctgtggcagtacaggaaggagtttatagaacagagtgacgtcaggaaggcaaagtcaagaagccctcaatgatgctttggatataagaaataagaaggagggaaggataggaatgtttcctagattctgcctggatgatcatggtgccatttactgagataagaaactgaaggagaaactaggaagaagagggaaaagatattattaagcaatcaaggttgcttaatcatatggttggtcacctaatacaggagccacgcattttattttctcaggaatatgtgattatcccttagatgtgtacatataaacatatatatgtgtaattagttaaatatatgcatatagatagaaatacaatttatatacacaaaatttgtaactgatatggtttggctgtgtccccacccacatttttttttaagtgcctagacatttattacctctttagtggtgatttgtgagatttcggtgcctccattacccaagcagtatatgctgcaccctatttgtggtctttcatctctcacacccttcccatcctttccccctgagtccccaaagttgattgtgtcattcttatgcctttgcatccttatagcttgactcccacttatgagtgagaacatatggtttggttttccattcctgagttacttcacttagaataatagtctccaatttcatccaggtcactgcaaatgctattaattcaatcctttttatggctgagtagtattccatcatatacatacaccacagtttctttatccagtcgttgagtgatgggcatttgagttggttctacatttttgcaattgcaaattgtgctgctataaacatgtgtgtgcaagtatctttttcatataatgatttttttttcctctgggtggataaccaatagtgggattgcttgatcaaatggtagttctacttttagttctttaaggaatctccacactgttttccatagtgattgtactagtttacattcccaccagcagtgtggaagtgctcccttttcactgcatccacgccaatatctactattttttgtttttttgattgtgtccatccttgcaggagtaaggtgttatcgcattgtggttttgatttgcatttccctgatcattagtgatgttgagcattttttcatatgtttgtcagccatttgtatatcttcttttgagaattgtctattcttgtccttagcccactttttgatggaattgttcgtttttttccttgttgatttgtttgagttcattgtagattctagataataatcctttgtcagatgtatagattgtgaagatttttttcccactctgtgggttgtctgtttactctgctggcggttctttttgttgtgtaaaagctcttaaatttaattaagtcccagcaatttatctttgtttttattgcatgtgcttttgagttcttggtcataaaatccttgcctaacccaatgtctagaagggtttttccaacattatattctagaatttttatagtttcaggtccacatctcattttgaactgtagttcccataatccccacatgtcataggaaggacccaaaggaggtaattgaatcatgggggcggttacctccatgctattcttatgatagtgagtgagttctcatgagagctgatggttttataaaaggcttttccccaacttcactgtgcacttctcttgtctgctgccttgtaagacgtgcctttgctcctcctttgcctcccgccatgattgtgaggcctccccagccatgtggaactgtgagtccattaaacctctttttctttataaattatccagtcttaggtatgcctttattagcagcatgagaacagactaatacaatataaataattatatgtaaattggtgagatctgcttatatactataacatatataactcatatatgtcatacattataaattatatcattatatataccacatataaaatcacagactattataaaatattagaaattatgatattgaaattgtataatattataacatagtttataaaatattatatattatatttattatagctttatacataatttagcacattatatattatagatatatgaattatatatagtggatcctcatcatatgaagattctgtatttacctgtctgcctactcactaaaatgtacttctaactgcagcatcaatgcttagggtgtgttcacagtcatttacagacatgtgcagtgtggggaaacatctaaatcacctaacagacacattctcagctgagaatgaacaaggttacactgtgaattcttggctcagttcatcctgtaaacgtgtgtcctttgagcagtcaatttcatatcatgttttttgcatgtttgtgttttttcttgttggttttgctgtgaaaatggccccaaatcacagtgctggagtgctgtcttgtgtccctaagcacaagcagggacatctgatgtcccttctggagataatatggtattagagaagcttcattcaggcatgagttagagtgctgttggccatgagttcaaggtgaatgaataacaatatgtatgaagttagctgtctctatacagaaacacacagaaaacaaggtcacatattcatcagctgacaaaaatgttataaccagggggctcataagaacctagccaatggttcagctaatccagtgtttttggtgactttatagaacatactgtaatgaccacaaacaatgagagtcaactgtatatacaaattatagacatttatataacataaattaattcaaccaacaatcactgaatgtctatatttcagacaccttgccaggtactagggaaacagagatttaaaaaaataatagtcatgttttcttctctcaatgtattcatactataataaagtgattcccgaatttttaagaagtctccataccttgtatttacaacatgctctcatcaataatatatttcaatctttcatcatatagagttattctcatccagttggatgaaaatagctaacagggtggatgttggtcgcattcatggagaaatgagtcagaggaggtgataggcacagcactgttttcttgagggtaaaatgtatatggagcatctgtgtagggaacttcatcctatagctcagaagtgagatctggggtgatgttacagattttgagtcatttgtgcaccgaatatctgggaggagtatgctcagtgagaagataaagttgatggtaacacgagagaggcatccaagtgggattaaaggaacaaaaaaaaaaataatgagttacgactaaagagagctttcccaggagatgagaatgttgtcctgaaaaccaaaggggaacagagctttttatgagaagagattaggaaggtcaaagtcacagagatcaaagttaaagaagtattgtaaagcccttagtggatttggcaacatggaggttactggtaacccaagagaaagagattccccataaactaggaagtaagaccacaggttgaagcagactgcatatggagggaaaaaaggtggggaaaagagtttcagaaaacagtctagtagttcctgaaaagcttaaacatagagttcccataggacctagcaattccactcctaggtctatactcaatagaaatgaaaacgtatctatacaaaaaaaaagtatatggatgttcatagtagcactacttatagtagcttaaaagtgaaacaacctaaatgtccatcaactgataaatggataaattaaatgtggtcaatacatgcaatggaatactattcagccatacaaatggttgaatgaatgttaatgggcacagggttgaatgaatgctaatgggcacaggccttcttttgggaatgctgaaaatattctggaaatagatagtggggatggttgcacaactttgtgaacaaaagccactgaatcgcacactttaaatggattaatgatatgtggttcatatttcaatacagttgtcatttttaaaaggtggggaaaatatacattattattatgactctagatggctgaccatgaagagtagaggtcatagcagtagctagatgaagatacgtaacagatgaagagacagattcctttaaaaaatgattttgtttcctgtggttttatttggttgtttttattttggaatgagatatacataattatataatcagaggggaaaattcagaagacatggcaagaaagactgagaaaataaacgagagaacaaataagatcttaacagcagacggatatttctcttaggctacaggaacaacatttcatccatgagatcagaaggaaggagttcaagtgggaagatttgtagatcacgggatacggacaaggtatagtgagttgcaaaacacgaagtgtcctcacaccacatagatcctatgttccctccgaagtagagaatagattatcctgagagcagagcagagagaagacggaggaggtgagaatgccttgagcaaagtgataaggatttagaattactaccccaaggaacacaaaagtggatcattgtgggcaggattgctggtggcattgggttcatgtaaattggaagtagatagagccggatgatccctgacccctacaaacactgagcagttagagtctgagaagctaattggttctctagccattaatatagtgaacatattttcagccagggtcaagaaatttacgaggcagaggaaacagaaatgagggttaagggaatccatagtgctagggagaagaaagctgaaatgaaaaactttggatgaaaaatggaaggaaaagaagatagttttcatgggtgtgggggtgggaggttgaaacaagtagtaaggctgacttggatggggaaaaccatcaggaactagatatattgataaggtcaaattttatcaacaagagataaattatttttttcccctggaagaaaactcaaggagaaacgatgagtgtgataagtgtttttgcaagagatgcaatgggctatatatttttcattttgatttatgaattaaaaagtctgaacaaggttatgcagaaaatggtagccccttaaattcagacacattcatttgaatgtgaacaatagagagagatgtcactgggcaggaaaacaatggaagttgatttacatatgtctcttaatgccgaaattatgcatttcagttttcactaagcaatatgtcgtgaaatgttggtaggcagatcttgttttgaacagtaagtctgtgctgccaccttttctgtaagttctgtgtactagcattcaactcagtataatcactttccagtgagacccaatgcttcaacgtgtgatttgtcttagtgacacgagatgctgtcaattccctcaaatggatatcgtttcgatgtggatcattaagagttattttctatggggatgcactgagagacacatttcccatgaactgttgtggaaaataattgtgtaattttaaagatggttgggacaatatactcacttctcagagaaatatcttcaaaaaaatatatcagtgtcaagctaccttggttaagcagtaatgaaataaaagtaggctgggtgcagtggctcattcctgtaatcacagcactttgggaggctgaggcaggagaatcacttgagcccaggagttcaagaccagcctgggcaacaaggtgatacccggtctctacaaaaattttttttaattagctgggcatggtggcatgcacctctggtccctgatacttgggacactgagatgggaggatcgtttgagcccaggaggttgaggcttcagtgagctgtgacggcgtcactgcactccagcctaggtgacagagcgagactctgtctcaaaacaaacaaaaaagtgaaagtaagcattgaaaagaagctcatccttggctcagttagccgccagaacagacattttgcaaaacattcttaatgcaaccaaggtaatattagatgatgggctgtgtgattatgagacaaagacctgacatggattttctaccatctttctagtcaatcctagcacagaaaagggagacttacagacacatttctagagtagtgtccatccacctgtattaaggcagagccctcagaaccaactggctctgaatcagacaaatcatgtgcaagatggcagccaaatcactacagtcgctctgtgcgaagttgaagagacctgcctcatcaacgtgcggaaggcaagcagaaagacatgatgaaatgcagaatccagccgtgtggcacagccttcggccagagtgataaaattgctgcacatgtaggctatgattactggccaagtggcaggttccaaaaagaagcatcacacagagattctgggtggagagatgaaaccacaactagtccctggccctgcaaaaggtgttcacccctgctaatcagaggacagatcctatgaaatgacagcccgattcttggctgtgagcttccctacttagacagtctctgacaaacatagcattccatattataaaaggaaattttagaaatacatacatcttgtcatttcatgggagcccaaagagtcagctgttcccttgttttcctgggtcatcaatctgatttctgtgcaatcagcttcattacatttttcagcacctttaggaactgtagtgggagttgacacaagtgcgacattttcctttatttttcatttgttttcttgttgacactttccccagtcaagatttttgtgcttcatccattatgccatgaatttatagaaagtagattctaacatcaagcttcttacagctggttctcttgaaaggttctctgcagagagcagggtttttcaacttcaactctggtgacatttgggaccatataatctttggctgtagggagctgtcctgtgcattgtaagatgtttagcagcaccttgacctctacctaccagatgccagtagcacctctccccaagtagtgaaaaccaaaaatgattccagatatggtccgatgtcccccagaaggcaaaatcacccttggttgggaagcactggcattgagtatgttggcactttagtgtgtaggtaattttctcggttgctttcatggttttattctgatcttttcctttgcctcaggacgtgttccccagctctaggagagatgaatatgcaacatactctcatgaattctgttggcaaaagtactggccttatagtgtttgtttacaacgatgctgccaacaagctctgtggcattgtggacgcttctcattcgccatagcaacatggagcagtgctcgctagcagtctgcatgccctcgatatcatggcaccctagctgtcaattcagagggaagtggccaaaagcacattgccatggtgacagaaccttcccacttcttccctgtgtgttgctgaattttctttattgatctattatttatttaggttttttttctttaatgtgaattactggaggttggcagatccaactgcaaggcaatgccatctttctacaaagtattcaggagcagagtcaagacagcctccatgtcagttaacttgtatgtatgaagggagagtgctgaaatttgttcagctgtccctcttttctcaactgggagtgaatttgtcccactcccatctgtcagccattctctgggttgagcatcaagatttgatttttcttttgagccctggaggctctgtctagcctcagcccactgtagttttatggcctgaatatgatgttgatgtgaaaagcaagcctcagccctttggcaaggcaggatcacatgttaccagattgccaaaaagctggtgaagatattgctcttgttaaaccagacactccgctcacattcctcagggtggggttcatgggaatctacttttgcagatacagaatgcatcccatctgtactcaggtggtagttttacattcaagcaatcatgcattcctgtttattactttttatcaattaactacccaaagtcaggaaagacaccttctgcagagccacacgtcgaaaatcagtcccaattttcaaaatctggtaagtttcttcctggaggcaggcatacttcatggacaaaatgacattcttattcttttttcttcttaaacttattctcccttatttttaacgtggagatttttctacctgtggaatatttccttttaaaattagcatcaaattagtaagcatcactaccgtccacacttgtcatacggtaatgatttaggatcattagcagatcagacttacatacattttaatggaataataagattgaagctgtgtttgattcatattttaaggttgtggactacataattcttactgtgtgtggatgagaacagctatagtagacttgggtactggttccaccactgattagctgtatgatcaaagaaagttagtgtttgtttgtttgtttgtttgtttgttttttccaggacccagttccttcatctcaagatcaggttagagccagttctaaccccatagcattgtttagatgattcaatgagatagggcatgtcaagtgcctaggacggcacatggtatgggatggatttgtataagccctgtgtaattagcattattcctgtacggtcttatttcctcttccttcataatctctccccacgtggcataaaagacaagggacttacactctgtagagcatctaccccgcatggttttcatgacaaggaatgtgcaaagcatctagcagttacctggctccactaagaataggaccctggcattcttcctcatttgcaacctccttgacactattttctgacccctttgtgaacacttggactatttcctttacacatggccacaccccaatgcttaatgctgacagtactattgcctctctggcttgaagccctatcttccttcattaattatagctcatttgctcacatagtgctgccaccttgtcatttctagtctttaaaacagtgccctttgcaaaatacacactcagtgaagagcagccatgcaaattaatagatacagaatgttgaaaaaaagaatcctaataggatttttcttaaagaacaggattgagatgctgatgggtttgaaataaaagcaagccacccagcacagcagccgcattgccttctcttcatggctgtggtgacggttgggcatctgcagcagaagaggaacgattacattaatgagaatacctgggatataaggggagtccttgtacactctttatgagtcaaatgagaatatcgtcaagaaaaggcaagccacttaaagcattcttcctgcacctggccaggcgcagtggctcatgcctgtaatcccagcacaggtgtgggaggctgagaagggtggatggctttgaggccaggagtttgaaatcagcctgggcaacatggcaaaaccacatcgctccaaaaaaatacaaaaatcagctgggtgacgtggcatacgcctgtagtcccagttgctccaggggctgaggcgggaggatggattgagtcagggaggtcgaagctgcagtaagccgagatcataccactgcactccagcctgggccacagagcagatcttgtctcaaaataaaataaaataaagccatacttcctgcgcctctgatgagagaatcttgacccaatggtctatatagaattcagtgtacgttaaagataaacctatttttaattgtcttcagtctggttcagttttctgttgaaaacatcacagttacaacattgagggattgctcgatgcccaagatgttaaaattactatcagtggctttgaaaggaaagcacacttttctaccttcattttcagtataatgaatatgtttaatattttttctcctgttggctcagaatagaactttgaaaaatgtcatacgtgacaaagattgttccagggagtggagaaaagagaaagaatgagtgaggaaatgagtgaaggatttctgaaaataaatgacaaatatctctgaaggaaggaaacagatgacaggcagaagaaataaatttcaaaataaggaaaatgaatacttaaaatagcaggagaatgaaccagcttgagaatgattttttaaagaacagtatgttttaaagtaacgttccttattgtaaaaataatactccttgtaaagcatttagcaaacacagaaaagcacacagagggagtaaaaatcattcagaggccaccctggagagaaaaacattttaatgcttttggctatttctttctagttcttcttatattcctttcttcttttaaaataagggcatactctaaaaataatttcaggttctactttttttcattcaatattatattgtgagcatattaccaggtgaaatagcgtttgaaaatatgattttagtggctatgccagtattaataaaccacagcccatggccaaacagtgtccccctgcccatgagctaaatatggcttttacatgttgaaatagcttttaaaaataaaaatacaaaataatatttcagggaggcacgatgcctcctgcctgtaatcccagcactttgggaggccgaggtgggtggatcagttgaggccagttgttcgagaccagtctggccaacatggcgaaactccgtctccactaaaattacaaaaattagccgggtgtggtgatgtgtgcctgtggtcccagctacttgggaggctgaggtaggagaatcacttgaacccgggaggcggaggttgcagtgagcaaagattgcaccactgcactacagcctgggtgatggagtgagactgtcaaaaaaaaattcgtaacaccttaaaattatgaaattcaaatttaaaggaaattttattagaacacaaccacacctatttctttacatattattgactattgctgcttttgagacacaagggcagaactgagtaattgtcagagagaacgtcggtccctcaaagcctaaaatattcactatttggcctcttagagaaagtttcctgacccctagactatgtaaccacatgacctctgtttatatcaaaacttggttaaacgcttccctatcattgagcaccatggggtttttgttgtttttgctgttttaaataacattgttgtgaatgttcttgacctaaattgtggttgacatctgtgaatatttttctaagtaattaattatggatcaaaggtcatggacctttttatacctctggatatattatcctttagaaaagcagaaaaggcatagataccttgttcagcagcaagggtgtttataagaaccaggggttctgaactggcaccataatgttttcctacacagagatttatgttttcaaccaagaaacaactaaaaattattggctggtgtctttctctttctagaattgtttcaaccctttatcatagcattgggagctagaaaataatccatatctatttttctcactcatctagagtgcagcaaatttttcatcttcatatccagtagggattttaaccaggaaaataaccccttggtttgcttgaccttcagaaagtaatcaaaccatgctggcatcacgaaataggatggtaaaggcagagagatccctgctaagtcgacagagaatcagattgatgggactaactgctttgcaaagcaggaggcaaagcagaagacaccccatcgtggtcttggcagcccgggttataaagaattcaaatttcagtgcaaggcagctgttgaaatggaatatcagaaacaaaggccaccctggacataactgtggcctggtgaatttgctgagtgaaaatggcttattggccctgtgggtttcttctgtcagttccccatctttctattgtgggaatttatcatgttggtcctgctttgtaagatttctttacattttaagactataaacacttgtctacaagtgcagtgtatgtagggtttctatgtattttccatgggtttttgatatgtatggcttgcatgtcagaaacagtgggttaaacaaggctagttggacccttaaatgcaggacttctcaaagcctttagtacgatacgatgaatgtgaatcagcacatgatgaatttaaatgtaacattcatcaaaattattgactatgggcaagtttatttattaggcatatttcagaatatgcctgaatctgttttgtggctaaaatttgggcatctgtggtaggaggtaagaaatccacaaggaacatactgaaaaaatactgactactactgataaacaactagcaattaattacaaattttaataaatggctaaatgtaaaataaatataagaaagcaacaggatttccatatacacaataaaactagttttaaaatattatctgaaaaggacctatcccaatatcaattaaagctgaaaatatgggtaggtgtggtggcttacgtctgtaatcccagcaatttgggaggccgaggcacgaggatcgcttgagcccaggagtttgacaccagcctgggcaacgtggtgaaactgcacctctaccaaaaaaaaaaaaaaaatttacaaaaattatctgggtgtggtagtgtgcacctgtagtcccagctacttgggaggctgaggcgagaggatggcttgagcccaggaggcaaaggttgcagtgagccaacatcacgccactaccctccagcctagacaacagagccagaccctgtctcaaaaaacaaacaaacaaacaaacaaaccaacaacaacaacaaaaagaaagccctgaaaatacctagaactaaccttaacaagaaatatgtaaaacctgtctagaaaatcgtaaagccttaagttaaactgcttgaaactgagcaatataaaattagacttgcataaacaggataaacaaatcacgtcacaggattcaaattacaaatattttaattatgtccatttttcatactatcatgtcgatttctacaatgacaattagaaactttagtaaatattttcaggaacttgtcagattttctttctaaaattcatctgaaatcactaataagcaatgttatcaataaaccttaaaaacattagtgagaaatgactgagatgtgatagcaaaatattttatacagaaagatcatagaaagtccacccagccctagcctccctctttgggcatgcaatgtgagctgtaattaacaattagggataaaacaactagctaaatgcctgaaaaagaagagaaagaggttggggctgagaaagtactcaaggaaaaggtagccaaaaaattcccaagtttgccaagagacataaacaaacagattcaaaaaactgagtgaaggccaaacggggtaaatctcaagaaatccatgccaagacacttcttaatgaaactcctggaaaccaaacacacacaaaaaatttgaaagcagccacagaaagcaacaccttacctctagggaaaaatattattcaagtaatagcaaattcattaccagaattgatggaggacagatggaagtggcacaatatttttcagatgcttaaaaaaaaaactgtcaacccagaactttatatccagtaaaaatatcccttaggaatgaaagggaaatcaggacgttctccaatgaagaaaatctaagagaatttgtcaacagcagacctatcctagaacaaatggtttaaagaagttctttatatagaggaaaatgataacagaataaatcttggagtgccaggaaggaaaatcaatatgcaaaactatgggtaaataaatatgctctccttcttatctgggatactctaaaccatatttgagggttgaaccaaaaattagaacatttgtttgatgtggttctatgcatctgctggaaaaatacttaagataattataaatgggggaaggtaaagggaagtgatgtttttacattcactagaagtggtaaaatggtgacatcagtagactgtgatagttatgaatatattatatagcatctagagaaattactaaggaaggttacgcaaagacataaactaaaacactatagatatccaaaataggaatagtaccattttataaaattttagtacaacatgacaaccaagatactgtaattgatgtaatcatgatataggatatttctatccacacaaagatctctcatgttgtccttttaaagccatactcacttttctcctgccctcccctccttaattttcagcatgcactaatttgttctgcaattctatagtattgccatttcaagaacatcatgtaaatgtgtactaaaatacacaggatccctctgtattctttcttacaactacatgactttaattatctcaaaataaaatgtttaattaaaataaaagaataaagctaccagcaacaatagcaacccaaaaaggacctttaatgagatggacaaacacacatgtcacattaattaaaatggtccataccaattttttaaactgtaagaagtgatggcaagttgataagaatttacaaggtttttcttaactttgtattttccatattttaaaaggtgacattcgtaactagaaaaattgtaccctaatgcattgaataggcccagccttgtaaggcagtggaattatttagtggaattatttagcgtagctaagctaatgatacacaaagaatctggtcaaccatggcatgcgtttgggtccattgctaacaaaaggagagtcagttcccttactgtttgtaaagcacctgccagaggaagggcttatgggtgtcagtgctgccatttgtatatttctgctttattacagcactagttcattaatgaggccctgcaatgtcctgaatggacacctcacagaaggggagctgctttttattttatcttcctcattagtcgctggcgaatgtggaatacatggccatacagaaataaaaacacattttaatggtcttaccttgctcttaatgaagacttaggcttgatgccagttcgcccttcatagcaggtatcctttgcccacgatgggatatagcagcgcagtcattccacacaaatggactttaggaagagcttccacaatacaggtctggagtatgttagaactcagtgaagaaagattcaaatttgcttgaagttctttttcataatggagtgggctccttggagaatgaggaatgggattcgagttttattggtttaagcctttaagaaactttgcattgaacccctctccagctttccatgcccacctgcaactttctttgtcagcaattaacctgcacgtgtgctttaaagtgaagtaatttcaaactccatcagttccttggttctcatctcagtctattccgaatctggggtgtctctgtgactgctacacatactggagttttggggtttgcaaagcccttccagatctctcgtttcccatgtactcaacacccttctgaacccatctgaaaaactagtctatcagggaagcttgaccaggaacagacttcaattggacaaagttcaattgaaattgccacttttgcaggttaagaataatccaatgttggaattttaggtagctctacccagcggttctcaaccaggggcgattttgttctccctggggacatctggccattctagagccatttggggttgttacagtgaggggttgtggggatggcactggcagttgatgggttgaggccagggatgctgctgaatatcctacagtgcacgagacagccctagacaacaaggattcatccatcctcaaatgtcactggtgccaaggtggacaaaccacagttctgccaaatgtagcataggatttaagaacatgcagttgaagtacagtgcctgaactcaatggttttaccacttaatttctgtgtgtgcttgggtatgttagctacaatggttataatgataatttcggactcaggattgtagggaaaattaagtaagtaaatacatatcatgccctttgaatactgtggaggctattgatgttggctgttattatctatagaattcttttagatattaaaaattgcaagatccattctgtgaagagggagatttgaaaagaaaaaaaaattaaagtcttttaaaaattgtaagatccagaattcacagaaaacttacaggaaatatctagattgctggagttattttaacattctgatttctgtcattgtttgggggccccaatagatttcattccctttttatgaacatatatgcatattccaaaagtaaacagttttcagcaagaagttcacaacaggtagaacacacttttacgagttttatagagaaaacactagctcacacagtaaaacaatagctttccgtggtggtgtttactcaagccccagagaaaaggccgccataccattgaaactcacaaaggctgcactccaccaaaagtgatacagccacaacgaaagtagcacattttgtacatagagaaggcgctcactggcacagtgctcgaaatgtcacataaattatgctcacacttctaagaatggatcttgaacacagtgtgtaaatatttgctggtctcccattccatgtgtctcccagcgagtctgtgtgactcctccaacctgattccttgttgtctgccaaagataagccactcgaggggctttctgctcaatttcaacatggaagaagtgaaaaagattttgcagcaattgcttggattagaaacaaagaagacagctggtgaataaacaggtcaatttttctcattaagttgtggggaaaacagtctcctgcatcctgaaagccctcctcacctttggcggggaaggcagaacaatcttatcaggtaaggtcattccagatggcaggtctgccattcctgccttgctcttcattaatccacagaggcaggtgggaggaaacccatgactgttcatcacccagacatcagcagcatcaaggcaggctgtcagcagccacgggagcctccatttcaaatccacaattcagaacacaaaaaccaggattatgctttttctttcttgtttccttcttgtttgtgttgtcatggttcctccagtcactggtgtttcgagttcatctttttcgtgctttaaagctttgttgtatctgagaaaattgcaaaggtacgttatcattgctgcatcttcctattgcttagagagctgctttatagcacaatcacaagctcatcaagtctgttggactggattctgggtgagcctagcgcctgggctctcaatcgtacttaaataaatagcaattttgatggcgagaaaatattaatataaagaaactgtttacagtcatgtgctggggtctgtttgcactgtggggtctgaacaacctaaacgggggataaattgcaagcagtctgttctgcagatggtctgcaaagccctacagtctgtttcagtcatgacaagcttcaaggacaggtgactagggtgacttaaatgaaccccttcccacaatggagttccattttcattttgtttctggccccattcagagcctttccctctacaaaaaggagctctctcccattacagaaaatgaaaagctcaagcacattctgtgtttctttctactcttgacttcccatcatacaatcttcttggagccggaggagttatttagtccaggggtggatgcactgcattgtgctggccaaatctggccacacacattcatttgcatgcctgtctgtggctgcttttcttctacaatggcagagttgagtagatgcaacagagatgctgtggcctaaaaagctgaacccatttattatctggccctttgcagaaaatattttgctgaccccttgtttcagagttaagaaaccacagacccaatggggtaagataatttgtcaaaaccatgcaggcagatagggatggagccagaagccttggtttttttgtttgttttttgtttttgttttttgtttttttatggctttgtgatggatccatgacctgctgcctgggtatctacagaaagtcagcacacatcacacagctgcacattctctaatgcaaactaacctgtaagaaacacacctgtcctatgataggccagcaagaaaggagatacataggattgccggctttgggctggggctgtttcctcccaaacagcgtttcacaccaccaattcatccacatggtgcccatctgcattaagaatagaaagccaacaaattattcagaacctgaccgacagatatgcaatgctgggctgcctggtgaatttgaagagaagacccatctgaaagcaaatatctctcattacgtttcaaatgatgaggaaaagatgatgacaccctatcatctcatgacagaagtcatcatgagatggaaaatttccctgacagaagaagaagtcaacctctcccccttctaatccaactcagtcatatagaaaagttaaatcattccaaataagttgtagcttcactctctgaaactcttcctctgagttctatgcaaactcctcagtcaggaatgtaaaatctgcccccattcaagttcattcctatctgccttatttcccactgctctctgacacacataccaggctcagagccctggggaattgcacagtcacaggaaatgcacagagagatgaccccatggaaagaaacgtgccacctagaagtcttgttctgctccagaaacccatttaatagatctacttcaacacctgcacgtccatggccttctgacaagcttcctttctttgcacgctggaattatctcctttttatgcatttcatttttgaagactaccccaaacaccactgcccttaggaagtcttgtgcaactactggactgcttttggttatattcctctttaatccatcacccaatatagaactttgtgaatatctcttttggagcatgtccgcaactcaaattagtagtcatttgcctctcacccattagaccattttaaaggcaagaacagttttcctcatcttcctaaccctcaccttgccttccacataatagattctcagaattgggttgtaagagttaagaaaactcaatagttacttgttggcttatgtttattgacatcacagatggatctgatattgttcttctttggcattaaactctccggatcatgaaatgtgtacataaatgacttaatacacagaattactcaaggccagggattggcagacttttctgcaaagacccaggtattttaggcctttctggtctctgttgcaaacgttcaactctgccgttgtagcattaagggagccacagacaatctgtaaatgaatggctgtagctgtgtgtcaataaaactttatttataaaaccaggtggtataggttggattcagccctcaggctgtagttttctagtccctccaaaccctcaacaaaaagatcctgcaccattctggtgatgcagaaccaagtgaaatgtggatggaaactaccttgacatttgttttctattcaggaattaaaaccacagatgttatttttttccctcagtaaaatctttttaaaaaacgtttggggcaatgccttgtatcctaatcacagtgcacatcactcctcttgcattcatttgcttttgtctcctcatttattagcacaatttgcttgtgaatcacttgttttatgtagcagttaaatctagggaaattaactgaattcagaaatgtgggcttgggctggaaattcttttttttcctatattacaatgaaataaatttttcctcagttttccaaaataattatgttaatcaattcctgagtcttcagcagacgtgaaagctaagggcacctttggtttaaggggctacaagcagagtcagcagctcatctataaactcatattaacagattgagacacagaacagagaaaatcattctccatcacctcaacactataaccatattcatctttcaactctgaggtccccatctacctaactttttgaatagattgcaccagtttaaaaattatgttgatatttccagccattcccagaaaaacaaatttcagtatggattatctgactttcagagaaatacagacaaggaaaaaaaaaaaaaaagaaggtcaggcacagtggctcatgcctgtattcccagcgctttgggaggccgaggtgggtagatcacttgagccaaggagttcaagaccagcctgagcaataaagtgagaccccatctctacagcagaaaattaaaacaaacaaacaaacaacaacaacaaaaaacccaggacattaaggttgtagtgagctaagatcaagccactgcactccagctggggtgacagagtgggactctgtctcaaaaaaaacaaaaagacaaaaaaagacaagtctgttgatctgattagaagggcaatagttgaagctttttccacaagttcacaagctttctttttcatctggatagctttatttagtacagtagttaagtcatctcaggatatatttgaaaatcacatcttaaagtttttctcagacattagttgagacaaatgtaacctggaaaatttagatggaaaagttcacggtgtttggagatgagtggaaagttgggaatttctcaggaacatgctccatgttggttgtgctgtcttggcttttcaagttactctaactctgaggatgaaacttcaaaatctttttggtctacaatgaaaaagagccatgctatcaggggactctgcttcttttccacattttctcttgctttgtgatacaggtttcagtgaaatccactgcttcacactccatctttttgggtactgaaatttagggttgcccttaaagtttcaccaaattcaagataatttctaacatttagttgaggcttggtgggcccagaagatcctggagctgcgtttcccacattgtactttgcagatcactagagtccgtcagggtcatgaggtggtcctttaaaaggagtttcctttttcaaatagtttgggatgtgattgcacagcaaaccagacaatactcagtggagagttgctgggtccaggtcgggtatgagacagaactcaacaccagaggcaaagcttggtcatgggaccaagttgaggagtagctaaaacagggccaaggcagaagcaggtttccatcagacatgcccaccattgtgccatgtcagttaccattgtcacggcaacacccaggagtttccacccctttccatggcaatgacccgatgacccaaaagttactaccccttccctagaaatttctgcacaaactgccccttaatctgcaggaaattaaaagtgggtatatgccaggcactgtggctcacacgtgtaatcccagcactttgggaggctgaggtgggcagatcacctgaggtcaggaatttgagaccagcctggccaacatggtgaaaccctgtctctactaaaaatacaaaaattagccggatgtggtggtgggcacctgtaatcccatctactcagcaggctgaggcaggagaatcacttgaacccaggaggaagagttggcagtgagctgagactgccgctgcactccaacctaggccacagtgggagactccatctcagaaacaacagcaaaaaaagtgggcataaatgtgacactctctgcctacagtgttatcccgttctgcaggaaaagtcacagagctgtaacacagctggagctgtaacattgcttcttcaataaagctgttttcttctacctccagcttgcccttcaattatttcctagacacagccaagaaccctcagggattaaaccccactttgtggcttgcctgacctgcatcatgggaacttctcaaagatgcagagagatcctgaaatatatgactatgttttaactttcttccaaccaacattttctaaaccacttggacaatacaagccatttgtctcagggtgggcaatagtacctcagcaacataacgtttcctaaaacacaatgatggaaaggctacacaacctctccagtgctcctgaagctttgttgcctatgtcaacctcagggatcttatgaaaaggtaggtctcagttacgaggtcaagggtggggttggagagtctctgtttctgacaagctcccaggtagggttgctgtggctggttcatggacacacagttagcaaagtgctaagaatccagccattgcaattgatctttccatctttccaagctcccttgtgcttcactgaaccacaccaaataaacactcagtgttattcagcctttgcgactattgtttgaaatcctaccagatctggggttttaagtcaagcccagctgcacattagcatcatttgggaggctttttaaaaagatgaatgcctgttctccaaactatgatatcagaatctcttgagggtgctgtctggacattttaaaatattgagacaaaatgtacataacattcaattaactgttttagagtgtacaattcaatggcttctagtactttcacagtgttgtgcaactatcacttttttctttaccccaaaaggaaacccagtgcctgttagcagtcattcctcattccctgctcccatcctcagaccccagcaatcactaatttactttccgtgtctatggcttttcttattctgaatatttcatataaatagagtgatacaatatgtggtcttttgtgtctagcttatttcacttagtctaattttttaatctatattgtagtatacactagtagtttatttctctttatggctgaatactattcaactgtatagatataccacatttgtttatccattaatctgttgatatacattttgtttgtttccaagtgtgattattgttaagagccctgctattaacattcatttacatgtctttggatacctgtttttaatcttttggggcatggatggatagatagatatagatagatagatagatacacacatatacacacacatacacacacacacacacacacacatatatgtatataaaatatgcctaggagtgtaattgctggttcatatggtaccatagactgaatgtctctgtcctcccaaaagtcatacatacgttgagatctcaacccccaagatggagctataagaggtgacttagatctttgggacatgatctaggtgatgagggtggaggtgatgagcggtgatgagggtggagcccttatgaatggaattagtgtccttatgaaaaaggccccagagagctccctcacctcttccaccatgtgccttctccaccacacagcgagaaggccccgtctatgaaccaggaagcgggttctcaccaggcactggatctgctggtgccttgatctttgagcctccagaactgtgagatggaaatgtctactgtttataagccacccagcctatggcattttgttatggcagccagaaaggactaagacatatggtaactccgttttcaccttactgaggaaatgacaaaccctttctcacggtggctgtgccactttacattctcactggagaacgtcactggacatttatacctttttaaaggttccccattgagtgcgatcaccagcaagtgtggacagcactatcctgcaaccaaggacggccttattcacacacttaatacacatgtatttaattcaatggggtgcctgaacccatagcatcaacattacctaggaacttattagaaacacagtttctaggtccagcatggtggctcatgcctgtaaaccaagcaccttgggaggccaaggtgagcaaatcacttgagggcaggagtttgagaccagtcttgtcaacatggcaaaacccgatctccactaaaaatacaaaaattagccaggcatgcagtgggagcctgtagtcccagctacttgggaggctgagacaggagaattgcttgaacccgggatgcagagtttgcagtgagccaagattgcgccactacactccggcctgggtgacagagcaagagtccatcacaaaaaacaaacaaacaaacaaagccacagtttcttggtccccacactggactgactgaatcagaaactctggaggcagatggtggtcactacctattttatcaagccctccaggggattctaaagtttgagaactgatgctccacatataattttataatttgcaatagtttcacttcaccctatatcatacgcactttcccacatcctgtactattatttgaaaacacagtttaacatctacttgtaatcttttaatataaaacaagcccactatgcacttaatcattatatctggggccatttgatttttcccattttttatgaaatacaaataatactccatgaatactcttgacaataaatatttccacacatctcggaatatttccttgagttaaattcagaatcataattaccaaattacagcgtttagacatttttatctttatgctgtgttggccacttcattggatctgagctctttctgtggagggaaaaccaatactttcattcatcacaaacaaggaagacaatatgggttattggctatttttattctattgcaaatattgctggatcaccaattctgggttaatttttctctcaatccaggagaaatagatgctatatatttccagtctcactgcttccttgctatttatgatgctttgcccagctttttaatttatcagtcctcagtttctgtacctacaccttaagggtaaaaataccctacctacttagtggtatagataataatgatagaacttgtgcagaaagccctttgtaactgccgagcacaatacaacatgtgagatatttttataactaggctcagtgctttgaaaagttcactcccagaggactcccccaatagaaatatcctcatttgctttgagccgtggctttcatcagcctgacctaagctgtattatttgctctgaattctttagggatctgcagaagctttactattcacatatgcatattttgcaactgtatgaatgcactccttaaatttctgggagttggttcaccttaggcagaatttgtaaatagtatatttctggcttattttctatttcctttttattttaagccatgtgccgattccattgcatccatctttacagagcttgcctcaaatcctttttggggaagaggcaatagagaaacagaaaaacaagtcaacaagcaagcagatagatacagtagcacactgtaggatctatttgatacttcctcttcctttctgaacctttatagcaaggtctatacttacatggaaactttaaatagaaactatgacacctacccggaaacaggtaaggctatccattttcaccagttgactgtaaaaagcctcggttttctgtctgaattaggaaaatttgtagactttgagaggtgcaaatgagcaatagtctactatagtgctgctttaatagcttcgaaagatacctgtccccccgccacgaacccaggctacaagtactcttttttccagtaaagatgcattttgaaaagactattccgaggcagataagagaagctgttggcatgttttaatgagggaaaatgagaagggggctgtggaaacagctcgacagactgctcatcagagcagaaggaagcttctatgcctttttatagacacgctggcccccttacgtccctgaaatattctctctccaaagtttcaaaggtaggacttgctaagcgggcagtcccgaaagggaagtcttggaaacaccctctatctggaacaggacctacccacactctggtaaagaatagggtatctatacatccccaacgaagaaactgagctgaaaaaccaggatgacgaggcatgcaaatctatttgcaaccttgggccaagctcccaaggccagccaccctgagcattgctgctttgccctctttgatttccagggaattaacactcctcaagttcccctgcatgtcacctgcagcctgggagaaacatggtgacttggggctccctgcaagacacgggatgtgtgattcagccccttttgatgcagtacttgaggaaatgtcagggagcagagagtgaataatcatttgcatccagagtgccgcaggcagctctccaagagggagcccgcagaagttgaggcttccgaggaggccggggacccctgtttagttttgaactcagcatggggggagaaagagagatagagagagaaagaccatttcccacagagccgacaaatgcagggttaaataaaaacagtggtacccgtggaagaacggggagagcgtgccagctggagcctttatttcatgttaatcattcttgtagttgctgtagcctgagaaagacacatttgttatgcagacagtgttcgttgtcaaagactgatcaagaatgcaggagtgcggccacaaaatgaattagctctctggataccaaatgggaaagccaattcgaaccagagcatggcacaagggctccagcaggattgaaatatactaggtgcgcataagagcgagcattgtgaccactgctaattatttgctatttttagcacaggcaatgagaaagcaaagagcagggggaggggaatgcggcaatccaacaacagggttcattcagaacgccgccgggggttcacagacctccgtccatgtccacttcccatgctccagaatggcctttatttttaaactcaataatttttcattcatcctccttgtgaatgttaggaatgtctgcagttctgagcatgccacaaaagaagacctgtgctgtgccgagggtatgaaagcaaagcagtgtgaaagcaaagctttgctgtgccccagagagaaacagaacagaaggtcccaataaagacagagggtcttttctaagtgggcacccactgagcctgtcgaccaggagagatggtcattttctgtgcttgcgttgactcacttctacattcttggacttccaaccctaatctaaagctcagattccaagcgtttcaactgcccttggaccaggcttactgacaggtagattacattaggtttccccacttgacataacggcattgcagcttaaggcatgaccatggagctactctattgtcaagaaaaaggtagggtgcagtggctcatgcctttaatcccagcactttgggaggaccaagcgggtggatctcttgagcccaggagttcaagaccagcctgtgcaacatagtgagatccagcctttaccaaaaaaaataaaattagctgggtgtggtggcatgcatatagtcccagcttcttgggaggctgaggcagaagttcacttgagcccaggagtctgaggctgcagtgagctatgttcacgccactgcactctagcctgggcaacacagagagaccctatctcaaaaaattcaaaaatgaaaataaagtcaagggaaagaaaactctccctcttgaagttctatagcatgttcttgtacttgtatcaaaaatgccattaaaaagaaacaaatatagatagacacattcttctctttaaaacctcaaaaatattaggcatattcagaaaagcaaaggaaaaaatcctttgtttgtgtatatatgtatatatacatattgtatatatacacacatatatacacatacacacacatatacacatacacacattcttgatcagcgtcacatatgtatctatgaatatgtgtgtgtgtatgtgtatatacatatatacacacacaaaagactgtataatctatattatatatataattcttctgaattatccatttgaacttttaagatcccatcaaaccacaccatgtctacactacttaagacatgatttaggctcacagacttaaactacagagtgtttaagtgtatacacatatatttagatatagatataaacattttagtcagtcaagacactgtatcactgaaaatagctccatggattctcaccaaataaagaaggcagggataggctggtccaatacaggcttcatggtttgcatggaaaagacaaatgatcatccctcagaacagccaaaaagttgatttgcaattgagatgctttgcacctgagtgagtcctcatcctaggctttaaggcgtgtagcagcaggaactcattagatgcatgatggcgaatgaattccccaattatctcatctcaggatgagaggctggctggataaacatgtacacacacacacacaccccaccaccgccaccaccaccaaaaacaggccgggtgcagtgcctcacgcctacaatcccagcactttgggaggctgaggcaagcagatcacttgaggccaggagttcgagaccagcctcgccaacatggtgaaacctcgcctctactaaaaatacaaaaattagccaggtgtggtggcacacacctgtaatcccagctactcaggaggctgaggcaggataatcgcttgagcctaggaggtggcaccactgcactccagcctgggtgacagagcgagactctgtctccaaagaaagaaaaacaaaaacaacaaaaatgcaagtaagagggaggacagcattataatattacctattaggatgaaatactactcattggccaagctacacacacacacatgcacacacacacaacaacaataacaacagcaacagcaatcacatatcacaccagcaatcacatatcacaccatggcatgacttggtggtaaaagatattcattcatcaaacttttatgggtctgatattctaatatgtccaggtaatacaaacttgattcattctcaagggatacgcatctaaaaggccatgggtcacccattacggcactctttttttatgatcattctgacatgatcaatctgtgtcacatgatgacttcttgggataaagttacatgcaacttctccaaaacactttttccctcccaattttggacccagagatgaaagtaattcatggacaaacaaggaacaggtaggttcctgcctctcagaatcctctgaaggatcaaaggtatgtttttgagctgcctacacctgaaatcctgatttggcttttgattctgttttcagaacagaaagtgcatgtcatggactccatagaagtctctttctggggagtgctttaatgagcctaagtaaatcctttgcctcctttgtaaagttccaggagaaataattccactagggaagtagttctcagagaggggatccttagcaatgcctggcaatactttaggactttcagagttgttagattattggaggatggattcagggatgctactaaatatcttacaatgcacacaacagagaattatgcagcctaatgtattactaatgccaaggctgagaaactctgttcttttggtggttatgtacctgagcaggttgggtcatacctgacacagtgttgcctggatttggcaaacctggtgaagagaaacgcttatcagagtccttttctcaagaggatttttttttctgaattatccatatgaacgtttaagagcctataaaaccacatcgtgtctacactgcctaagacataatttaggctcatgggcttaaatcggagagtgctagaaatgtggacataactcctggaaacacggatagtattgggtgctcctgggttcatgccaggccgggaaattccggtgccctagtagttgattctcccttttcctttctaaatacaaaccccgcctgtgaacagtacagctccatccctggatacattttaaaacacatctaattgccgggcacagtggctcacgtctgtaatcccagcactttgggaggccaaggtgggttgatcacctgaggtcaggaatttgagaccagcctggccaacatagtgaaaccccatctctactaaaaatataaaaattagctgggcgtggtggcaggtgcctgtaatcccagctactcaggaggctgaggcaggagaatcacttgaagccaggaggtggaggttgcagcaagcagaaatcgcaccactgcactccaggctgggctacagagcaagactccatctcaaaataaaataataaaataaaataaaataaccacatctacgatttctgacaatactctgggcacatggagcaatggcctccaccatacgattggtctcccctgatgtccaatcttccaaaacccaacagcctgtctagaagatgtcagtcacttagacatctttaaaaatgtctgaaaagtaacacttgtaggaactttaattaatatattttctctgctttgtgtgcaatgaagtgagccagcattttcaaaggaagagattcagttggttcaccaggaagtctgagtttgccttatgagaatgagatcatttctccgtgatttctctcctgctgcaaagaacatgggcatcttttacaaacagattggcctaaggtcttgcacatattatcatactcccaccctcacgcagcaaaccggagcggctccatcttgagtgagggctaggaaaatgaggctggaacttgctgggctgcattcccagaaagttaggtgttcctagcctctagatgtttacagttaagggaacagatggataatgtttagtaaacagacccggaattgggagtgtccaatatccctatatcttgagaacagaagcactcctaattttgctttaaagataataatattgattcttgcagaatgtagtaataaagaaaattaatcctttatcacaaacccttgtagcagagcacttttccccatgatcttttttttattttatgtataaacaagttttgtacctaccggtggatgcgttcctcctctagctttcgggaacgccctgctctgtctatggagtagctgtactttcaccactttactctgttaataaacttgcttttgctttgcactgtggactcgccccgaattctttcttgtgtgacattcaacaagcctctcttggggtctggatcgagacttctttcctgtaatggaaggatttagtgaacactggatttcgtgagtcccgggaaggagtacacactaatcaccagtcaataattaggcaatgaacacgagtggtgatgttttcaatttgtgaaaaattaagtcatgaatggacttttaatttgtggaatattggagataactgtgcttttcccgttaggactcagaagtgaattgtattaatcagggttctccagagaaaacagctatttataaagagagagatatataagaagagatttattacagaatttggctcatgcagttgtagaggccaagaagtctcaaaattcgccatctgcaagctgaagaagcagaaaagccaatagtatgattcagcccaagttcgaaggcctgagaatgaagcgtgccagtgtccctgggcaagagaaaatgggtgtctcagctcaagaagtgtgagcagatttattcttcttcagcttttctattccacacgggccctcaatagattggatgatgcccatctacataagtgaggatggatcttctttcttcattctcctgatttaaatgctaatctcttctggaagcgcagacacaccccaaaatacatttcacagctgtctgggcatctcttagcccagtcaagttaacacataaaactaaccaccatgcaaattgtctctgttttttagtttagatgccctccagcagaagttttacaaatacattcacatcaacatcttctggtcactggatcatgtacacatcattcgagtctaattgaggcttgctgttcatttcttatatttgcaagcagggtgcaaatgttgtttgtgctttatgctgcttggttgtgtgcattggattatacaaacagacattatgggacacatattcattctcagcaacatagatcctggatgtcagggctggcatccctccagaattaggtcttactcctagaacatgtcaggaaactgatttactagatctgagagggtggagagtctaccgaagggaaaccagctttgaagcattggcaccatcagcaatctttacccaaggtgcaggaattacctgttcatcttcgttgtcctataaattctgtctcactcagcatctgaggggtatagccacttctttagtctctttgacttgagaaagctatttcttagtcaacaataatacagacttgcttcctgacgggttgtcaaaatcctccttaacatgttatctatccaaacattgtcctagttaccctgactccttggaacactgtttttgtcagatcaatgattaatcttcgcaagctgcagagtgaaaatgaatgtgcaacctgtgtagacaagcctttcattttcaacaggatcataaatacctaagaaggtctttgtagggtagcaattgcatacaccataatgcacatgcaaggatgggcaaggaacatgaagacaaattcagggaaagaattaaaggcaaaactcaaaacccccatccccacataacccagtgcaatcgctacacagcatcttcagcaagccctaaccagaaccctgaatctttccacgacgttatcttttacatgatttccatgaataactaaatttaattcccctctcagagacgcacgtgatcacattgactgtcatcctttgaacacatcaatgagtaattcattatttctgattcgatttgattctggtaattccctaaaatgtgttgtggcttatagtcaccaccagctagttttggaagtagttctttctatacagctgcctacttaaatttactgaatcaaactacattgcattatctgtgattttattttgtttttaagattcttctattctgcaaatgctttccatacaggtaagaaaatccattagctaatttccttactacccagggattcgtttccaagagatttcacatttcaatgtttgaacattcttcttcaaattatatttcttttttaatggttttcattttcatagaaattgacatttcttgcaccttaattgtgttatctccccggatggcattccaatcttacacatactttgcgcgttttctatttcttcccattaaaacataatcattaggtaagtttactataagaaaaaaaaaaacactttaattcccttttatataaactggtgctttaacttaatttttcctaaatatgttccaacaagcagtgagcagtatggcaaacatattatataatatgtcactctcatatcttctctatccctatcaccactaccaaaaaaatcccagcaactttataaggaagccatttgacatgtaaagacaaattgggcagcatttgttataaacagatatgggtttgatggcaaggcattggtagggccctggattcttgcccaatgtatgcttttctttttcaagttaatgagaggctttctcttccacttgcattgaggtcctgtatgatggaacctgaacataccatgctcattcttgtctgagaaatgactcaggtcatttctctctaaatttcaactattatgtaaggtctccaccaagcccaaccacctccagtaatactcaatgtgctgttctctctccttctaaaacctcatagcattgactctataggtcacttgtggactcatttatagtcaactcagtgccatttcactcttcattcacttcttcaataactatgaatcatccactaggtgcccaacagaatgcctggcaccaggaacacagaagtgggatagacatactcagtcctgggtcttggatttacaaaccctgaagcagaatcagaccttagcaaagaaacccacagggtatctgtttttttagtatcatgagtcccacatgaagaatagtagtatctcagttcaagagacctgtcttacacagattacagccctctgagtgaaattttcagcagtttctcaaaaaaataaaaataaaacaagaagaaaagaagaaaaagaaaccctctgaatgaatgttgtctgttattttgtatggaatccctcttctctgcaatagcatccactctttcggggcattgtgttggtaacacgtcttagctcagatgtcaggtattgcaaacattctatgctaccttgagtctttgtattttcaaactttcaaaagtttaggagtgcacatttcactcttctgagcatcagattaaactatccaatctgcttgaaaatttgggcatctctttttcacccatccatatgaactttcctgcctctttttgcttatagctggcattgaattacatccatcatacccctggtatttgttccacagtaccttataaaatattccatcaccacattctacatctttaaaagtcaatggaaactttttctatttctttcaaaacccatgtttatttgtttgtttgttttttcaatattttcctctttactgctctgggaggcatttccagagatccttcgatccttcatgttcagtcttgaacttctctttctcctctctctgtcactctctgtctctccccccaccccccgacctttgtctctgtctccggttgatttattaatacattggaagatttgaacaatggctcaccagcatgtcactggttaaatttcccatggttcatgaagtctgtgatttcatctcagtagacagagctccgaaatgatttgagggccactcaaaaatccattaaaaattaaccaaggaatagtcagaatcttgaatagcctaaaaaaaaccccacaatatcaattatgacaagagaacataaaattccttgcttctattaccctcaaaacatgtaccctttagaccttgggctagctgctaagtagaagctgaaacatctgtgtctctgctattggtagctgtgtgcattggtacagatcacctagcaaaatgcattgcatgccaatctctatttaggcagacacccagcgaagagggtcgttgctatgccattgctgaagacaattttcacatttctctgtctcttgtcatattgtgttttgcttttgtgctttctgtgctgtagaatattatttttaaaaaattcggtggcattactgctgaatccaatccaattgatacaatccttaatgcaactgtaggtaattatctttccctggcacatttttcacaatttcctgatgttttatagcacaattacttgggaccaaaatttggaacataatttcttatctgttgaggatgagacactgtggtcattaattactttcttttaaatactaattgacttttatacttgaacttattatatacatatgggtaaattgtttgcttttattttaagctttgaactcaaggattatctttgtagtcactgccaaaagcttagaaaaatatacattcatgactgctaaagcagacccatataatttctgacattttggctgtaattttgttcccaaagcctctgcttagtaaagaaaaatactaattaatatataacctcaaattttatgttcttctatttcataacaaaagatttccactgataattgttcaaagtgtcggggggagaagacaatggaaatgatagagaaagtctctctcttaggagacccccaaattactatggtttgacttaacaattgttcagtgttactgtggtgcaaaagcgagatgcattcagtagaagccataccttgagcacccacgcgaccagtctgtttttcactttcaggacagtattcaataagttacataaaatagtcaacactttattataaaataagctttgtgctagatgattatgtacaactgtaggcaaatgtaagtcttctgagcaagtttaaggtcagctaggctgagcaatgtttggtaggttagatggatccaatgcagtctcgactcatgatattttccactgatgatgacaggatataaccccatcataagttgagaaggggctggctgtagtggcttacacctacaatcccagtacttccagaggccgaggtgggcagatcccttgagcctaggagttccagaccagcctgggcaacatggcaagatcccatctctacaaaaaatacaaaaaaagtagccaggcatggtggcatgcacctgtagccccagctacttgggaggctgaggctggaggattacttgagcccgggaggcagaggttgcagtgagccgagatcgtgccactgcactgcagcctgggcaacagagccaggccctgtctcaaaaaataaaataaaaataagtcgaggagcatctgtacattgaagcagaagaagacaaaaaacaagtaaataggtatatttttaaaagttagttctatcactttgctatttctcttgaaggggaaaataaatccacaaaacgaaataaagggtcacagtgagtaaggagataaatgtggagggtatagtctcgacaaacgctcagggaaagtttctttgagagatgatacctaaaccatctgaatagtggaagagccatgcagatgcagagaaggtggatttgtcagttaattaaacagaagagaccgggcgcggtggctcacgcctgtaatcccagcacattgggaagctgaggcaggcggatcacttgaggtcaggagtttgagaccagtctggccaacatggcaaaaccccgtctctactaaaaatacaaaaattagcagggtgtggtggcaggcacctgtaatcccagctactagggaggctgaggcaggagaatcgcttgaacccaggaggtagaggttgcagtgagccgacattgcacgactgcactccagcctgggcaacagagcaagactctgtctctaaataaataaataaataaataaataaataaataaatagaagaagcaacagtgcagtccaaggctagtgagcaagaagagtagaaacagatgaggttcaagccataggcagggaatgtgggtcactcgggaccttggggtcttgagaaggaatttgcattgtgtcccaagtttaatgggaagctgttggagggttttttaaaaagcaggtgtttcttattgccaaaagtgactgagtctgcagtgtgaacaaataaagaagggaggatgagtggaagcagtgagagacaggccaggaataagagctcatggcccccaagctggagcgctgatggttagctagggagaaaataggtagggcagcacaacctgagcatcgattggatataggatgtgaagggaaggaaagaaggaggaaaaatcaaagaggtggggtagaagttttgtttatttaagatacctaggtaggcagatagataggtaggtagatagagagatagatagatagataagtagatagatatagatagagaagatagatcatagagatagatagattatagagaaaaaagacgattgatagatgatagatatatatcagcaaatagagacagaagatatatagacagatgatagatgatagatagagaagatagaacatagatagaaagagatagataaatagatcatagagatagatagagtagatagatcatagagataggtagagaaaaaaggtagatgattgatagatacaagatagatatatatcagcaaatagagacagaagatatatagacagatgatagatagatcatagagaaagacgatagatgatagatatatacagatgtagataggtagatagagaaggaagacagatgacagataatagacagataatgacatacaaacatacatagatggatagaatgatggatatgatatatagatggagaaggaaataaaaatatttcacctcaaaatacactcagaggaatttgtacaaaaatgtttacactgactttataagtataataatcctaaattgcaaacagtccaggtatccatcaattggagaatgatcaaataaaatgtgtgtcaatcctagaccagaatattatgcaaaaaataaaaatcaaaaactactggtatgcataacaatatgagttaatctcaatcatcttatgctcagacaaagagccttacacataggatggccagatttagtaaataaaaattcagagcacctgagtaatttggattttagacaggtaatacatacatttcaacatatgttctaaatatttcctggatcagacttatactaaaaatatgcattgattatctgaaatccacatttaactacacatagtgtattttatctgacactccttcaaataaagtgtataactccacttatgtgctaactcatggtggaaaatagttaaacaatattcacataacaggtggggcacaatgattgactaagagacggcatgacggacctttctagggtgcttttcatggtctacatctccatagggacctgagttacacacatgtgagcatttgtttagcagatgtagacttgagatttctgcattacattgtacgtaaatttacacacaaaaagacctgtaaacaaatgtaaaattctagttaaatataagcttggtggaaattttggggggagatttacaggtacttgcaatttatcttaaaatatgttaatgatggtcaatagataaagttgtggaggattgacacaagaatatatttgttggccagatgtggtggcacatgcctttaattccagcactttgggaggccaaagtggaaagattgcttgtttccaggagttcaagaacagcctgggcaacatggtgagaccctgtatctacaaaaaacaaaaaattgactgggcatgatggcacacatttgtagtcccagctacttgggaggctgggatgggaagcgtgcttgagccagggaggttgagtctaggtaacagagagagactctgtctcaaaaaaaaaaaaaagaagaaggaaaagaaaagaaaaataatatatatgtgaaaaagtataatgtgttaggcagaataatggtcccttaaagatgcccaagtctgaatccacagacctgcgaatctgcaaagagtaaccaaggttatgaaagaaatggaaattgctagtcatctgaccttgagatgaaaagattatcttggattatccaatgtaatcacatggtcactaaagtagaagagggagacgggagaggaattgagggtgggactctatcaacttttctgctttgtgggctttaaagtggaggaaggagcagtaagtcaaggaatgcgggatacttgtagaagctagaaaagcaaggaaatagattcttccttgagtctccaaaaaggaacacacagccctgctagagctgtatcagaattcagacttccaggactgtaagttaataaatgtgtgttgtttagccccaaagtttgtggtaacccaagacagcagcaatgagaaactaacacatttagtgaaacgctaacagtagaattcaggagacaggcacatagctgtttagtggacaattttttcaacttttctggatatttgaaaatttttataataaaatgttgagaaaaacatttgagtgggagtgggactcaagtcatcaaataaataatggagagaatgtcatgctgtggtacgtaggtggccagtgttgtgcacagaggtctcctactgcattggatgaatgagaagagtcagcaggctgatttcaagcctatgtgaagtcagcaaattcagagaaaggtatacgtgggtctaagaccttttggtgacatagaacaaaataacaaggagggggaaaataatgtgtacgttcttaagaccaatagagtgaggttggccaagcacatggttggagttacagcaagggaacagaggatcccactgaagctgaaacgtatgtaccccctacccaagttcccaggcagcagaatgccctcaccatccatgctaattttattttataatgagacagggttcaggacacacttcccccaaatatggaaacttggcacttgggaaaacagcagaagccggccatagatactagaaaaaacttcacccacccctcctcaaaagttgcctgaagtgggccataaaacctagttgaccttcctctgaaaagaggtcatgactcattccaaaggggtcctccctatacccagagtaaagaaatgtcctgtctgaagacacagggaggacaagatgaatgtcaacaaacaggctttcctacatttcctcctggtttactcctattagatcccaccgcctttgtccaattatacttctatacaactgttgctgcttaccaaacctaagcattaaaatggacagtttttcctgtttctttggggctttgtttctgaaggttcccatgtcatgtaaaacttacattaaacagatctgtctgattttttcttgctaatctgatttttgttataagtgcctcagccatgaaccttgcaatgggtgaaaagtcttttctctcttatacacacggatgtgaaaataggacttagaattacacgtggttaacttagcattgccagtggtaacagcctggggagaaagttgaggggcataggcccatttgacaggaatgtaactgtctcagtctgttcgtgcagctatagcactcactctggactgggtaatttataaagagtagaaatttattgctcacaattttggaggctggaagaccaagattaagcagccggcagacttggtgtctggtgagggctgctctctgctccctaaatggtgccctgtagctgtgtcctccagaggagacagactattaggttggtgcaaaattaattgcggtttctgtcattgaaagtagtgacaaaaatcgcaattgcttttgcaccaacctaatatgtcctcacatcgcagatgggacaggatgggagaaaagggataagcttgctctctcaagcctcataataagggttctaatccccgccatgaggatggagctcacatgacctaatcacctcctaaaggcccccatctcttaatactattgcttaatagtgtcactaattgggaattaactgaacgttaattgggaattaagttccaacattaatcttggaaagacacaaaaattcgaaccatagcaggagtcatgatggaatgcatttaaagtacacataaaaggattaaagagtctcaatgacatgatgcttctttcaatcaaccctggtcaagcaaagctgagcaatacagaatgtagtttcatgtccttgtcactttgcctgcatccctgcttggaaggaccaccatctacagtagaggcagcttgctgcttggatgcccactcccaaagctcttaaccccagccatggctaatgcctgttcagactgaggcaagaaaagacggtaaagattgctatgaggaatagaaaacaagttgataggaaaggataggctgggggcagtcttaaaccctggaaacctcagaagtatttaagaaaagacttgaaattggctggacgttaaatatatcatttgatgtaatgggaccccactgtgtatgtacttcctctccttctcctgatttcctactacctattatcctccttactcccatctctctccctccaccagtgaacttggggctatcaatggaaaagactatggaatactggagttattagctacaaccagcaaaaacctagctgttagaggaaatgtttctttctctacagaagctggcttaaaaagcatatgtatattcatataggattcataatacagtcatgtgttgcttaacgatggggacacactctgagaaaggcgtcattaggatgcaaacctggatgtgataacctacaacacaccgaggttgtgtgcgattagtctatttctcctaggctacaagcctctacaatacgttactgtactgaacactgcaggcaattgtaacacaatagtatttatgtatctaaacatatctaaacatagaaaaggtacagtaaacatatggtaagaaagataaaaacggttcccctatatagggcatttgccatgaatggagctcgcaggactggaagttattctgggtgagtcagtgagtaatgagtcaatgtgaaggcctaggacactactgtgaactactacagactttataaacactgtacactcaggttacatttaatttacttaaaaaacacttttctttctttaattttttttttttttttggagatggagtctcactctgacgcccaggccggagtgcagtggtgcaatctcgggtcactgcaacctctgcctcccgggctcaagcctcagcctcccgagtagctggaattacaggcacccaccatcatatccacctaatttttgtgtttttagtagagaaggagtttcgccatgttggtcaggctggtctcaaactgctgacctcaggtgatctgccaccttggcctcccaaagtgctgggattacaggtgtgagccaccacacccgacctctttctttaataataaaataaccttacttttctgcaatttttttactttataaactttttaggttttttttttttttagcttttgactgttttataaaaacatagcttgaaacacaatcacatcattcacatgtgtgaaaatcttttttatatctttattctataagctttttccatctttaatttttttttactttttaaactttaaaaaaaaaccctaaaacacaaacacataactttgtctaggcctacaaagggttgggattgtcactaggcgacaggaatttttcggctctattataatcttaggggatctgcatcgtatatgtggtctgtcactgacagaatgtcgtgacgtggctcatgactgtaattgtatttcattttgctctttagttgggatcctttgtaaagtactgtgaaggatctgaaatttcatcctagtttcaggctaacaagttagcctgctagagcttcattgatgttggcagaagacacaaatcctctgggtcagagacaaaagacagtttctacacacagtaatagcagtaggcagagcagccgtgtttgtgctgctttccttaactgcagttcctcccacccaccatcatgggggctgtgtaaagggctggatgatgcctgcctacagtggattgcattacaggagatgaaccctgtgcttagggacctgacctgaatacttatcatgaccagtaagcctacatggcctcttctctagggggagatattcattgaactggtaaataaggaaacctaccatttggcttaaaggacgacaccatttctatcttccaaggcttttacataaacacacatgcttgaaaaggatgtgcacaatacaggctgtcagcacctctggttgcaatacaggcagaaacgcaagagatacaggaaaaactgcttccttatatctactctattggactctttgaataaatgagaaaatgacttagaggtataaccaaccaagcccataccatgtcaaaagctgtgatataatgattctcagtccttccagagaacggggtgagaaacccctcatgggtgactcttcttccttgaaattaggcctgtagctatgcacatcagcagatttcactgcgagtttagagctttccagagcaatcccaaaagaaaattgatctccggacaactagcagctttccattatgaattgtcttggccatgtgaattgtgaacttaactccgaccataacctccctgaaaacaagtgaagcgcagtgattcaaaaccattagcaaccccaaacccatgtcttattcactgcactagtgtctgttttctggaccataagaaggccccaagtggacagccatgattgactatgcctatcaaatgtgacaccttgcatatcactagcgatgcatgaaggatggaaactgataatagtttgctttaattgggttctgtgcatgtgagtacaagtctttatgagcaagtgtttgtcggcaagcccctttattatgactgattatttggggctgaagttattgcttaaaggaaatcaaattacggctgaggaagcatgcataaaaggaaagatcaaagtttcccggccagtaaggtaaagcacaaacatcctaaagtgtttcctccgttgaatacttccacaaaactattatctcaacatccctactgatggcatatataatttggtaaagaattcactttgaaacaaattatattttttagtttatatctgctagaatcaccggatagtccaattctttctagattatatactcatgtgtgtgtatatttgtatatgtttgtaatctaaaatacaataagagagagaaagagaaagaaagagaaagagtgagaaacagagagagaaggctaagagagagacgtgtatgttaataaaaaacaggacaagaagccatatcacttgatcattttttaacattatttacctcatctgagttttaagaacaaaatacagcacttataaatggatgagatggggcctgaaaataaaaagtatgtatccagattgccggaaatgttcatcattgtagtctctgttgagtacatgccagatggtataatttctgatgcgtctgacagaaacaatttgaagtctactggtttagagaaataattttcaacctaagtgaggaattaacaatagaagagaaaaaaataaattgttaaatttaaaaaagaactatgttggaaaaaaagaaactgataaattaagaggctgctgttagggtacctgtgtaactgtgatcaccgtagaacattgaattgctcatgttggcagtggtatcaaattatggaagaaaatcattaggccatatggaattgaaaatttgaatacaaatgatctgtctttgtctctagcacaagaactgagagcatcagcttttaatcattatcatagctgcctctaaaatgccccccaacagtccctgacccttgctatgcatgtcctcatacagtcctctcctacattgcatcagggttggtttattggatcaataaaatattattatttgcatagtaatggtgcatgactcccgcagctaggtcataaaagagattatggtttctgtcttgctctctctcttgggtcattcatcctgaagaaagatggcagccatcttgtaaggacacttaagcagctctatggagaaggctgcatggtgaggaactgaggtcttcttccaatagacagtgaaaaactgagatctccagctaacagctacataagtgatccatcttacaagtggttcctcctgccctggtcaagccttcaaatgacatcagctccagatgacatcttcactgcaatctcatgagatgcctgagccagaaataccaagctcagccactccaggattgctgagtcacagaaaatgtgagaaaagaaatgtatgttgttgtaagccattacattttgagttgctgtgttccacagcattagataactaatataatccccaatgccatctttcacattgggaacaagatgaaattatgatgatgatagctgaggtgaaaaatttcaacatggtttaacattgatatcaatgaaattggtatcaataatgttgacctgactactttaataactaaactactttaatgattatgtataggaaacccaacagttggcacaatcccattcttccaaaatattatagccaatgtgttatgtgttcatctgttctcattgctgctaataaacacataccaaagactgggtaatttataaaggaaagagatttaatggactcacagttccacatggctggggaggcctcactgtcatgatggaaggcaaaggagaagcaaaggcacatcttacatggtgacaagaaacagagcttgtgcaggaaaactcctgtttgtaaaaccatcagatctcatgagacttatttactactatgagaatagtatgggggaaactgcccccatgatacaatcatatccacctggccgcacccttgacacatggggattattacaattcaaggtgagatttgggtggggacacagccaaaccatatcatgttacaatgcataatctcttccaaatgaaagtagtgcagtataaaatagttttgttttttcatcattctcagatgcccatgttcacatttggaaaaaagggtaaaagaaaggtaattaagggggaaaatgatgccccacagatattaaagtatattttaaagctattctaattaaaatagtttggttctgtctcatggagtataagaatatctgatatataactctttataataaagcagaaaaaattagaaataacttgtgtccactagtagaataatggttaagtaaattatgctttcaatcaaatatcttgcaagcatttaaaataataaatcatctcagcataattgtggagcagtctccaaatgatattttttttaaagacagggtctcactctgttgcccaggctggaatgcagtagcatgatcatagctcactgcagcctaaaacccctgggctcaagcagtcctcccacctcagcctccccagtagctgtaactgtaggttcacaccaccatgaccagctaatattttatttttttgtagagacaaggtcttgctatgctcccaggctggcctggaactcccagtctcaagtaatcctcccacctcagccccccaaagctctaggattacaggcatgagccaccatgcttagcccatgtaatctcttcatgtgactaaaataagatgcaaaatggatgagatatgatatgtggttaactgctaaactttaaccttcatcctttaaaacgagttcttaagttcacaatgatgtagtagaattttttctttactatggcatttgattctaatttacctgaaggatttagaggaagtgtggacccatgactcacttatgtagctgttagctggaagcctctgtttttcactgaaaaacttaagtattttagaaagaatttaaaatactcttggctaaacctgcaaaataagtacataaagaaaggtattttaagattaaatctcaatatttaaaacacagtttggagggctttaaaaaattctttatttctatatattcaaacatattaccaaactgaaagataaacagcatttttagctatcaatccaggcctgggaaaagcagagcaagactatttattttttgaaaaccttaatgggaagagagaaataaaagttgaatatacattagtaaaaaacaaaaccttatcactactctatcaaagttcgagaccagccagaccaacatggagaaacccagtctctactaaaaatacaaaattagccagacgtggtggtgcatgcctgtaatcccagctaccaggaggctgaggcaggagaatcacttgaaccccggaggcagaggttgcggtgagccgagaccacgccattgcactccagcctggacaacaagagcgaaactctgtctcaaaaaaaataataaaaaaaaaataacattgggctttaacactgtgatccacaaattgcatctagaccttcctgttactatgactttggtaactaacccagtataaaactcttttttcttcttgttagtttctcaggaaagatgaaattagtatctattttagcgagtactataacggaagactaggttttcttcactgaagtctccaaaatcctaacagacccgagctacttaactaaaatgttgcatcagtgataaattcgaatacaataggaagaattgtattttacacacatcacagatgcaaaaactggtctggcaattgacatcgccagataatggattacattttcctctttcagattccagtccacattgagactttgatatagtcctcctcagtcccgcctttcaaaatattaaataaggaatttcaaattctaatattcttatctccctcatgcaaccaaactgccataaatctgcatcccctgctatctttatctaatagaagaaatctctccattttcattagatgagaaaatgaaagaaaatgatacccaccaccaacagttcttaatattagttcctacagacgacagttattgcacttaaaaaggggctattggctctagatagaaatctaaagtgtttgttcctctgattggcccctgcaaactcttttaaaatccacttcttttgttctctgcaatgtttcggttctcaccagcactcccacttccaaccacttaaacttgattttccactgttaggtgaaggatgctcggacaacatcgcattaatttcagtggacactacattttatctaattcagcaagcaggcctctgttaattaggcctcccagcacgagtgatggcgaacatctcctctcactgtcactgatcgatattcacaactcaagccattctcgtggtcaatttcttgggcttctgagtaaaatagagggtcccattcttgttaacaacctagacttgcctaaaatcgcaatttgctcccgacttgcccgctgagtccaccagctgcatacaaatagcatctctcaatcccttcctctccatcttcgctgactacaagaactgccagaggggaaaaggattctccctgccaccacctcaaatgccactgctgccttccagctttgagtctgatggatggaggactcagcctgctgacagagcccgcgaagacttgctgtttgatcccagggatgcaagccttgtttggtgaagccccaggagaattaagtaccggagcctaatttaatgtaatactgctctgcagctacttaaaaagaaaaagaaaaagaaaaggatattgaaagcccacataattttgtttccttccagttggccacaaagagtgatccatccaataactttggggccaaatactacctgtgccaagggtttaaaaacccacacccctgggttatgtggcagaccccagtttctcctggaagatgggtaagtcgtcagagctgacatttctgtatagaaaacaatgcaaagaaacaccctcctaaactacgtgaaatacagtgttgctctgtcacttacagaaccaatgaccgccaactgagcaaaggagtagggttcggaaaaaatggagaaggtgaggggagaaaaggccaatgctggcagggtagaacgtgtcattgttcatttaaattgcttttattttcaaaacacaatataaccagtcagaggtcagtccccctcgccacacacacaccttccatgtgcctaagtgcattacaataggtgattttctttttaaggtctagcttgtattcctgtggccaccagcgttctgaatcttgccaaagggactcttttctaaaaagaagaaaccccagttagaataattccccattgctgcttaacatgtgtctctttgtaattaattttaaatatgcaaaggcccttttctgtgcactcctagctaaggtacgccctgttagtaggtgacagtgtgtgcctccggtggtaaattcggcttcaaagagagcgatgagcgaagatgtgttggctgcctgtcagacagcatgacataaaaggaaacaaatacaggaataaatggaaagttttatggtgagtgaaggcaacactgagtgttaccaacgcagtattttttttcccttttcctgagttcctatgatgagcaaaagaccagaaatgagttcttccaccaggatggttcttatgggtgtatatttactccaatagtaacatttattgctgtaacaataggaattagcctgtggttcataggcttaattttacaaagctcgattgcttctactatctgacttgagccttagggcgatcttatatagaaggtaaattatcccattcccattttacaggaggaaaaactgaggctcgaagaggatgggtgaatagacacacactcctaagatcatgaagagggagggaggaatgagccccaacctgagatcagacctttgaacctcattctgcttcaatttcctcctctgtaacatgagcatcgtaatgccggccaatgggaaagatgatcatcctcattttacagataggaaaactgagctatggagcatctaagaaaattgctccagactgcataagtgatgcagtacacgtaatttggctctagcctctaagctgctaacatctatcgtagagtcaatggaagtagatcctaggagagagaatagatgagggggtaaagtctgtgggaaaatggtaacataactagagctggagggctgggtgcggtggctcacatctgtaaacccagcactctgggaggccaaggtggggaggtctcctgaggtcaggagttcaagaccagcctgggccacatggtgaaaccccgtctctgctaaaaatacaaaaaattagccaggcctggtggcaggtacctgtaatcccagctaatccagaggctgaggtggcagaatcacttgaacctgggaggcggaagttgcagtgagccaagatggtgccactgcactccagactgggcaacaagagcgagactttttgtctcaaaaataacataacataacataacataacataacataacataaaataataaaataaaataaaataaaataaaataaaataaaataaaaatataaaataaaataaaataaaataaaataaaataaaataaaataaaatataaaataaaatataaaataaaatataaaataaaatataaaataaaataaaataaaataaaataaaataaaataaaataaaataaaataaaataaaacaaaataaaataaaataactagagctggagagccccaggcaggagccatgacagcatcagaggccacgacgagacccttgcattttgttcttcagccgatggaaacccatgcaacattcttgatgctaatcagaatctccctttgtaaccataagtatcacacggcaacaataatcaggcaatcaatgaggaaagctacattggaagaggagacaggttgatgagacatttacatccaattgcagtggaagtgcttaagaaatccttcaaaaaaaacaagtgaaaaatagggactaagacaaaactgagatgaaatacatttttcagcatttagctaataaatgtgtcacccctccaaccccatcaccacttctaaaacatgccctttgcatgtaagctagttttagcatgaaaagaaagatactttagtgactgcagaagaaaaaagtgtccaaaaaaaggactgccttacagggattcaaccttatctcaaattttgtctcttatgaatgtggtaattcctaaaattttgataagtgatgtacatatctccgagttcgacgcatttcctcagtagtgaagaaaatggcacaatcctattttacaccactgaggaatttacaacactgaaagataagaaaaatgggccagggtgtgtgaaactcacggattaacagtctgcatcgatcaattctccagatcattgcacaacccctcatgtcactttgtacagggatagctccaaggtaaagaatattgatgccttttcttttgtgctattttaattatagttgcaagaattttattcctaggccaacatatggtaatttaattcggggtgggggggatgtttctattagtttaatattaaagttcatattttttcattgatttttcatttgatgttatatgcaggacatatagacatttagaaaagcatggtattgtttgagatgatgagatctcaaaggctccaaaattaatggcacagcagagaaaagagcatgaagcaattctgtgagcagagagaaatgcacacacgcagacaccaggcacatgcatgtatctccacccacgctggaaattaactgaaaaatcctggtcatccaatgctgcctgcagaaccataacccctttgattcccgtttccactgtggttgatgccctctcatagctggaaggactttgggagcttctagtagagggagcacaaacctgaaacttgtagatacagttctactctgtgttttgctttgaggtctttgaaaattacttaacttcacagtagctgaatttccttacctatgacgtatcaatcatcctttctgactctccaaatttatagtgtctattgaatggtgaaaaaaaatgtgctttggaaagggaagaatctcactgacagtctaacaaaagtactggagatcctcaaggtcttgattctgcattctttatggtgccgtgtagaggggattgttttgagtgtcttaatttgcaggaagcccggagatgtggagtctgtgcaggtctacgcttcctcctggattcccagagagatcctcttctttaaaggatgcttggcctctgcatggttgttgatctctcccagccacagcctccttcactcattgaactcagaatttctcctgtgcatgcagtactgttagaggctgagtagacagagccaaactgaaccaattttgtttctgtcctcccagttcagagaggagaagggcatcaaactaaagaattgcagaggtttttattcatggcaaattagtataaggtctgtggacctaagtataggataccatggggaaaaattgagaggggtctcatggccggtgaaaaaacttttccaaggaaggctgggcacgggggctcatgcctgtaattccagcacttcaggaggttgaggcaggaggattgcttgaggccaggagctccagaccagcctgggcaacatggcgagacctcatctctacaaaaaatatcaaaaaaattagccaggtgtggtggcatgcacctgtagttccagctactctggaggctgaggcaggaggatggcttgagcctgggaggtcgaggctgcagtgagctgtgattatgccactgcactccagcctgagtgacacagcaagaccctgtctcttaaaaaaataaaaataaaaaatacaaagagctcctgaggaaatgatagtagtttactgaagggtaagtagaagttcctaaagaagaagaggtgaggggttaggtctagccagaagacagtccgcttgagggtcctaagggcagagagacccacatgtcacacaatgaaaaagcatcaaagtgcctgaggcccagagtacaaagaggggaagggcataagatgaagctggaaaggacgttgggaccaaaaccaaaaagtttttttttcttttggagacagagtctcagtctgtcattcaggctggagtggcgtgatcatggctcactgcagcctcgaccttccaggcacaagtaatcctctcacctcagcctcccaagtagctgggaccataagtgtgcacaactacacggggctaattttttttttttttagagatggggtcttgctatgttgcccaggctggtctcaaactcctgggctcaggcaatcctcccaccttggcctcccaaagtactggaattacaggcctgagtcactgtgcccagtctgggagaggagttttgcacagcaagataaatcatgttgtgaattttgtatttcatttcaagtgccacggtggaccaagggtgaagtttgagcagaggaatttcatgacaaacaggcacatttaaatgatcatttggaatgccaattaacacgcagattgtgaagggaaaataatggaagcagaaagccccaataggaaggtttctctagtaaaagtggtgagacaaattggcactttgcagtacagcacaagcagtgggaatggatggagataggacagagagacgtctactaccctctggcaagtgtggccatctcttcccaaaggtgtgatttgcttttttaacacttccaggtacttgcttctcatgaacttacaattgacattgtgtcatttatttggtgatcattttaatatttttttaccttttctaagcatcttccagcaacatcttcaatccaaaactggggggccttttgagagtagactcggtgaaatttattatttttatttattaatgtatttattgagacaatgtcttctctgtcacctaggctggagtgcagtggcattatcatagcacaccatagtcttgaactccctggctcaactgatccttccacctcagcccaagcagctgggactacaggtgcacatcaacacatctggctaatttttattttttattttttgtagagacagagtctcaccatgttgcccaggctggtctccaactcctgaactcaagcaatgtgcctgcctcagccttccaaagtgctgggattacaggcgtgtgccaccatgcatggcctaggtgagatttttatgatggcttttaggttggaaggggagcagttagagagaaaagggtatgaagactgacttccaggaagcatgagtgctagatccatgaccctgtatttcctgagagagaacatgcagaaggctcatgttggagcaatgcatcctgagaggagagaagcccaggaattatggttggcaatagttaagactgaaattccactaaggcatcaaaatagctgtgctagtgaggcaataaaatgtagaaatctggaattctcaagagagatatgaatatagaattccattagcacacagagggtatgaaggtcacagaatgcaaccaggaaacacagaggcaggtggaggaaactccactacctactggacaggtggaggaagaagagcaggaaatgagccctctgaaaggttgcctattggaagtttgtatttttctccttcatcaatctagagaacctttatacagccatgtttacaaaatgtgttcacttaagagccattaaagaaggttgttgttattttttgactgtttgtttgcttttgggttgctttcattccttttgctgcctttgtcattcctcacggaggtcactccatgaacgtttaacagtgcacaggtggagtaatccgatatccagggacctgcacagatgtcttaccctgtgttggctctttgtaattcctttctcaggcattaggtagctccaacataatagaactattgccaacattttactctctttccctgataaccaaagtaccgacctaaattaaattgctgaccgcattatttgtgagtccaaatttagcttcccctctcgtaccattaatggtctgttgcagagtttctctacttccatttgcgagtgtaactatgtccctgcctatccaggtgtcgcaatggaagcagaagtttggacatcagtgagtttttagcgtgtgtgatattggtagagaaggcacggtgtgcaaggacctggcttgccgtcggagggtggcgatgaagacagcacatgatgtctcttttcaggacagctgaagcaagtcagccccatcctggaggaagcccagctgccggcccaaagatcaaaggtgtctcccaaggccggctgtcactagactgtgctcaacgtttgccctcatctctatgtatgaggacagatattcagaatgatactccagttggctgaaatctccctttgccataagcagatagatggaaatatatgcatctctattatagataccaggaagcatttgtcaacgaggatagacaagtgaaagtggctaaatttgactgtagaaaatatgttcatggagtgaatagccaaaatgagggtaccagttccatttaggaaaaggaagtctgaaaaaatatctaaagacaaaagaagggcagcatctaaatgaggagcagaacctagcagagaaaatgattttagagttaggcaaacctagcttccaacatagccattgtttattagtagcatgaccacatctctgggtcccagccttcttgtattaaaaaaaaaatgatgagcattacatagagtgatacatatctaagttcctaatggcatgcatggcatatgattcatgtccagaatactttagtctttccttggaaaacatttcaacaacttgtatttttgctctcacatcttaagaatatccacgttcccatccattctctataaaatatttttcacaccttggcaaaactttaggcttcatctctattagaaaacctataaaaaattcataaatatgaaattagagcctgcaggaatgtaaattttattctgtggttatgatgtgtgcctccaggaaatgaccctttatatgcataaagctgtatcacatttatggtctgattttgatgcctggataggaaggataaagccaccctttgcttgacagaattccctttccatttcccttctccttgaattaccatggtcagaataagggagaataataatgactacagtggctcccaagcaggtttacgttcattattttagttaagtatgacaatggttctcctggcttatcaaaattagtgaagttatctgcacacagtgaaagaaagatcttaaaatatagatgtaacctgacccacccttgggataaacacagaatttaaatagtgagcccacagcatgtttgaagtgccttgtatttttcagtactcatgtccaaggacaaaaagatgaacaagaaatagtccctattctcaaagaggaaacggttgccttgcagggatatacctggaagcaaatcagtgaaaagaactaaccttctcagaggcagtggcatgaaaacaagtccttgtatgttgagtagaaaatctgctcacgggctggacacgtgtgtttggggataaggatgtgaagagaattgaaggcatcagatttgcacatgatcccatagcatgtggccaagcccaatcaaatgctggctgactgctccttccctactctcaagctgaattcttttatttatttatgtatttttgttagccaggaccttggcatgtcttcaagttgccacagaaaaatgtcccttcttagtggagaagagagaccacaggggcatcacctcacatttatttaattcatacatcccatgggttctcaacatggtcatcatcaatatgctttttaaaaattttaagatatggggtcttgctctggtgaccacactggagtacagtggcgcgatcatagctcactacagcctcaaactcctatgctcaagggagcataggagtttgctccccagtagctgggactacaggcacacatcacacccgactaatttattgatttttttttgtagcaatagggtctcccttcgttgcccagggctggttttgaactcctgaactcaagcaatcctcctccctcagcctcccaaagtgttgggattacaggtgtgagccacagcaccaagccctatatgcctttttaaaatataccaaatgtaatgccttctttatatcttgaaataaaattaatgtatcatagaacctaccacagtcataatttgaaaatgagtcaagataatatgcaaaccacgatataaatgacaaaaaccaaggaaggtagttcttataaaataacatgtattccaatatgcaagtgatcaggcacagttgcaaaagaagacatcatgagacacacatccctatacctccttaggatgcataagcctgggtttaagaggacatcagagcctgagcaacatagcgagacccagtctctacaaaaaataaaaaaataattagccaggcatgagtttgctggcatgcacctgtggtcccagctacttgggatgctaaggtgggaagatcactggagcccaggagttccaggctacagtgagtcgtggtggtgccactgcactccaacctgaagaacagagaccctgtctcaaaaacgaaaaccaaaaaaaaaaaatatgaggagatcagaaaatgttcctaagagaaaatgcaggacatgaaaaatcaggatgcaaatggcactagaataacaactagtattaagatgaggaccaacaaacaagatttcgttgatagtagtaaaagaaaaaagaaaggaagtgattgcaaataaagtagggataacatgccaagacaaattgcagactgtccaaggaaagaaagcacgagatctccgcacatgagcttgggttgcttattaagtgtagtgtcagaggtacttcccgggctatgacatgaaacaggttgtaacaaacgatcacagaaaacatagccctatttggaaactccaccatgtgttacgatgcctccaatatggtgagtggagtgcatttcactgacacaattttccaaagcagggctcaacatttggaaaaattctagacaaaacaaagtacagtcttacctcactttttgcaattctcagactccgtatgaaaaaaatggccctatgaattcccaaaatgctccatagagggcaacaccatctacattcagaattattagaagtcctggaagtcaatgataagattagctcctgattgaactgagaaattactgccctctgaggggatgagcaatcagcgagtatgtagaaggaaggcagaaagaaggaaaatgaaatacaacagctaccaggtgaagctcaagaattagatattgagcccaaactcagacagctattgaactactattgctgtccccaactctgcccactacagccccaggttctttccaccacccacatggagagtgggtttttagataacgttagtcattcctcactcatcacatgattgctttttggcaacaggctgtatgtaatttatgccttgctagggaggtggaccaagccaaacatggagaaaagagtcatgcaactcaaagacattcctttgtcctgaagcatagcccagcaacactaagaaccccttgctgctcttactcatagtcaaaaagtcaggcttcgattctcaaaaataggagtgtatacaggtttaacctataaatggttcagatagcattgatacacttgcactgacgaagttcttatttctttccatgtctttaacatttggggaggactgactgatcttgtgaacagagatggagcattaagcaaacaggtatgttctcccaccagtgccattctctgtgggcattattttttattattaatattattttgagacagagtatcactctgtcacccacgctggagtgcaatggtgtgacctcggctcactgcaacctccactttccaggttcaagcgattctcatgcctcagcctccccagtagctgggactacaggtgcatgccaccatgcccagctaatttttgtatttttaccagagatggggtttcaccatattgtccaggctggtctcaaactcctgacctcaattgatctgcctgcctaggcctcccaaagtgctgggattacaggtgtgacaggtgtgagccatcacgcctggccttttttttttttaattatttttttcttattttttaaaaactagcttcagggtctcactgtattgccctagctggtctcaaactcctgagctcaagtgatcctcctggcttggcctcccaaagtgctgtgattacaggagtaagccatgatacctggcctgttatttttatctgttaatgcttgcagctcattcttgtgagagggaggaagctctaacccagagagtccatctccattttaagtgcaaatatatgctgggccccgaaggggctgccataacatgcaattcagatgtagaaagaaagaagggactggcccccaggaaaagaggtcattcagagggaaagagaaaatagaaggtaccaggggatgtgagaaagaatggtgactaaggcagcatgagacatcaacattgagataattcaacatggttggaacaaagtcaggagcaaaacagcacggtagccctgcaatctcaccatagcatcttctcaagagaaggatttgcatctccaggtgagtatcgagactgtaaattacagtgagaaaggtgtgcacagacagtctctcatccaccatcttcagactcaaagcacaaggagggtgagatgtctcaacaaacactgcaaagagctggggagtgatgccagacaggtaactctgcaaaactcatcttgcaaggatgatgaataggagttttgacaattctgtcaaacccttcaaatcttaagtgacttgaaagttccagtaatttttttctttaaaacaagtggaattgcacttttccattgttatgcaaattaccttccccaagacatctatttacctgttactatggttctcaggtagtttctccatgccttgggcagtggaggtgggtaaggatataaagtttaaaaatgatgtcttcaataagaaagtttgaagagacattactcaaagaaacgattttaatgtgatattttatgtatgagagacctaagcttttccttacatgtgggaaatagaaaagtatgatagggtttcaagttctgccatcaagttttgataacaatcaacaaaacaacaccctgtgtttttccctaccccaagacacagcaacttcaaatttgaaagatagctcaataaacaaaaatggagtatctttgctttttaaagaactgatctcagctttaagaaataaataaagactgcatgtgatgacttatgcctgtaatcccagcactttgggagaccaaagtgtgaggatcacttgagctcaggaattcgagacctgcctgggcaacatagcaagacccagtctctacaaaaaaataaaaaattagctgggtatggtgacacatgcctgtgatcccagcacttcaggaggctcaagtgggaggttcgcttgagcccagaaggtcaaggttgcagtgagctataatcacactaacatactccagcctgggaaacagatagagacactgtcttgaaagcaagaaagagagagaaagagagagaaaagaagaagaaggagaaggagaagaaaagaaagagaaagaagaaagaagaacaaagaaagagaaaaaaaagaagagaaaataaaagaaaagaaggagggagggaggggacttggtccttacaatctgctgagaggcttaaacataaatacaaataaacataaacacaaacaatacacgggaatagctaagagaaaaagattcaactatggctttttttaaaaaatgctgaagagctttgtaactcttccaaagacttcatgataaacagctcagggccctcttggttaatgcttggaagaaaaacagtttttctttcaaacatcttctttggaacagagacttccttccaaagaattctctcctgcaacccacccagtagccagtctaataaaatgtgtaagaggagaaaaatggtcttactctctcctttccccccgtagggcgtagcaaaaaattggaaaacagaaaaatggaatctggtgacacttgagactaatgcccgaatctcctgcttctgatttttccagcagccagtccgcatcctctcagcacccctattcagctatcactctcgttttgctgtagtaggtcacagatcagatgatggggggtgggtgtttggtttgggtgtaacttttgttgtgttttcagcagattcagcccagcacaacttgtcaggagattcatgacttagcaattgtcagggattggtcaagtcatattgaaaatgagattaactgaaagattcaagtggccagccctatgctagactttgtagtgcttccaagggggttcacgtgaaggagtcacatctgggcttcaggctcatcaaaggcaggagtgaaacgcattggctcacccttggctgccattgcgggagaaacatgggaggtgagacagcaccacggacagctccaagacacacgtttcccctaacacggttccctctcctcttgatcctgggttctcattctggttggtccagacacctaggacttaacaacctgaaaacatcagcccacattgtccctttaagccacgtggcaccaggtttcttttttactgaatgtcccaatgacttcctcatttgtgaactatcctggcacccagttcaacattttatctgaaaccctacaaatctttttcttctatctcttacaatgaaatgcgagccatcttttcatgcaagactcatttttctagttgttctgaaaaaaaactctcagtttttcagaagattctttcaactattacccatccccatctcccaaatcgccacgaatgccaccaaatattatcagatattgagatgaggtacagtgagttaggaggggtgggggttctgtttattttcatgattgttttaaatttgttttaatattaataataaaacgtccacctccaaactaaccaatgggcaaatatacccctctaaatttcagaggaaacaataaaaagtttgatggcctgtgggaaagcaattaaataaaaaatgagaaagctgggataagaaaatgtgttttttttgctataagcctttttaaaatgagatctgacgtttaattctgacgtgagtaatttttcagataaaattaaacacaacatcctgcttcctaatcttttgagaaccaaagctaatgggagcttttgaaatgtgattatgttactcctctttttaaaaattttcagcacaaccaaaaatgcccttaaaataaagatgctccactagagcttaatgggtgtttccatttctcctcatctcttctttctctcctgaagtcaggattagggacctctttgcctgttttcatagcagtttggacttcttctatcatgtcagaatgtttctgtgtctcctttaaactccaggttccctggatatagacactttttcttgttgctattcatgattgtttcagtgacaacacgacggcttcatgtttattaagtgaatggacagacatttcttctctcattttcctgaccaatgcttgggggaaaaatcagattgtcagaaagggtacctaaatgataacttattgaaaatgaaaaaaaaaaaaaagaaagaaacccagcctgtccatttggcaaagtgatgaaaataacatgccccaaatatgccacattcttctctggaaaagaaattctgattccaactcttctcccagtccactttgctgtaaacaagggaaaaaaagcatacataataaagaaaaagtaaaggtatgtctatgaagaaaaaactggaaacaacagacaccaactacatccgttatagtcattcaaactgaaaacctcaaattaaaaggttatttagactgttgccagtccagagaatttcaaatatcagtcctttaatttgatttatcaaagagagataaagaatttgtcaaaaaaacatcaaaaaagcaattcagggcctcttggctaccttgccaaatcagaatctctgagggtgaggcctagaactgggcaatctctaaaatttccccacagaactctgatgcgtgtccaggcgtgagaacctagactatagcccagcctccataaaacatgtggatagacttgtggcatttctgagagatggccatttggtctctgcttgaaatcctctaattaaaaactcattgcctttcacagaactttattctattttcagaaacctcaaatcattgaaatatacttactgttttaaatcaactataccaaatcctcccataacttttactcattgtcacttatttgctcttggagaatcaacagagcaaatctaaaccttcctcgccatttaaacccatatatatggggctttatatatatgtatatatacacactatattatatatagtatatacattatacatgtaatgtatatactatatatttttgagacagtatatagctattatatatagtatatacatacatatatactacatatacactatgcatatatacttacaatctgctgagaggcttaaacataaacatgaataaacataaacacaaacaatacaaaggaatagctaagagaaaaagaaagtctataaagatgatcttacatttagaattagctatacatacatatacatatatacactatatgcatagtatagtatatgcagtgtatatatattacatgtatagtatatatgtatatatactatatgcatagtacatatattaatacatatatgtactatgtgacacgtatgtatttttatatatacatatagtacatatactatatactatagatagtatatgtatagtatatgtactatactacactatactaatgtactgtactataccatatatactatatatagtacctacatactatactatatggtatactatatactatatttatacatctatactatactatagtatatacacacatatactatgtgtatatagtatgcatattatatacatatatagtataatatacgtacactatacacaatacatactatatgtatgtatactatacatgtacatatactagacatactatatttgtatagtttatatacactatatataccatatagcatataaacactatatatactatatagtatatacaatatatatacacacatagtatatacgatatagtatatacaatatatatacacatacagtatatactatatagtatatacaatatatatacacatacagtatatactatatagtatatacaatatatacacacatacagtatatactatatagtatatacaatatatatacacatacagtatatactatatagtatatataatatatatacacatatagtatatactatatgtatatacaatatatatacacatatagtatatactatatagtatatataatatatatacacatatagtatatactatatagtatatacaatatatatacactatatagtatatactatgtgtgtgtatatatatatattttgagatagtatctcactgtgtctcccaggccggagtgcagtgttgtgatcatagctcactgcagtttctacctcctagactcaagccatcctcttgcctcagccttctgagtagctgggaatacaggttcatgccaccatgcccagataattttattttttcagagatacgggatcactgtgttacccaggctagtctcaaactcctggcctcaagtgatccttttgtcttggcctcccaaagtgctgggattacaggcaccagccaccatgccccgccttaagcctttcaagtatttgaaaagagctaccttgttgtattaattatctgtcactatctaaccaattatcaaactatctccaagtttgtgacccaaaacaaaaagcattccttgaggtttctgcaaattgagggtctggatgtggtcacctgggttctccatttcaagaagaagatctcttataggctacaaatattctagtcaatgggaaagattcactaagtcctgcccacacacaagtgcaaacggatcctcaagagcaccaatttcagcaggcagggatgattggatacatttttgaaggccgcctaccacatatgtggctctgttttcttttctccgggtccacactttccttaatcatctctccagcaggaagcccaggtctgcatttcttcatactctgcactagtccttacttggacttagacatttagccatggctcttctcatatctcattcaaaaataaaaccaaaagggatgcctttctgtctcttcatttcccccaagtccctgtttttttgttttaatttagaaaatgttatttgaatcttccccaaaatttaggatattttccacataagtccacaagcagcaacttagataagcaggctgcctgtgtaagtgtgtgtcgctatttccaccctccaactactttcttttcttgtttatgctggatgtctcaaaacccatattctatatgaagtctcattgctcaagctgggaaagctttgttctccaaaatccttgatgtttagacacacacagaaagtcacagtaccacacacacaccctgagtagtatcctttaggttattttgagctcttccttcaaatcccagcagtttgaagtgcacatgctgagcaactctcagcagagctgaggaaagtctataaagatgatcttacatttagaattgactaaagggttttatttttagttttattggtctgttttctgtcacagaggggctgccattgtaatagtcctgccaaacatcgcattcaagatttaatacatggatacacctgtcagccatagcttcccaacttaaagtaaatgaatttgtaaagatgcatatttatgactgtgcaaattctaaagctaataggacaaataaactctctaaatttccaattttctacatttaatatttcatgtattcaaaatgtacaccaagtcagtcaatcctccttctttcctcagaatggaaatacaaaccactgtcattgacatctttattgtgaagtccatactggacttaccttgggtgtctatatagtgaatgcatcttgggaataagctcagaacacagccagcatttacgatcaagtaaatccaggctggcttgcttcctttgacttctatcacctgccacaggtaaaatataatatccctgtagctgggtgaaaacatcatgtgttttggatttatacagatttgagtatacacctgaatttaattaaaccacttcagaaatgtgtataaatcattgattcttcgtaagcctgctttcccatgatttaacaaattttaatactaggaatattaaagatgatgatagttcaaaatgttgaagaaacaaagaacaaacggtatataaaagttgttcattctcttccttcttgctgtttctagagctcactagaaaatttcttccagaaagatatccttcttactggaaaaacttggtaaaatgtacggagacccccagaattttaatactcaagtgacaccacttaaatgtggataaagaatgaaaatcccagcaatatattaaagactggggtgggatttgggcatctttatggcataagccaacaacacaaagactgggtcttctgttcaagagaagagagttctgaaaattgctttccatgaaagctttcttcttacaattatttgtcccctcaccctgagccttagtaatattttacacatgcacacaaacagaagcccacatacactcactccctctatcctgaattttagatgtactattcattcaagaagatatggtacaattccacacttgctaattcatggattcaatactcatttcttctctgcaacacaaaatggtccttggagatatgacataggctcctttggagcaccatacattgccaagatttgagtgctactaaacgaaatttgaaagttcccccttttatctccatagaatggaggaggcgatggaagaacggattcactcaaaatcatatttgaaacacgtcttcatggatccatggtatgttttttaaagtaggttttcacttgtaatactttgtctccattcataatcgtagggatctgacaggggactttgcagtcttttcatttttgtaaaagaattttccttttgccactgatattgagctgcagatgaggtgtagtttgaggtgagctgcagatgaggtgcagtttgccccatggtgtctttaccagctgcataatattttgagagcggaagagagaacacacaggggataattttataattgtattttgtatttttattagaaaatacgtcaggtgtgcagaaatgtacagataataacataacagatatccacaaatctaccatccagacataaaatatatatatttttttcgccataaatttttcttttttttttttgactgggaagaaaaacaggtttaattggacttagagttccacatggctggggaggcctcagaatcatggcaggaggcaaaaggcacttcttgcatggtggcggcaagagaaaatgagacgtaagcaaaagtagaaacccctgataaacccaatagatctcatgagacttattcactatcacgagaatagcacgggaaaaagactggcccccatgattcaattacctccctatgggtccctcccacaatacatgggaattctgggagatacaattcaagctgagatttgggtggggacacagccaaaccctatcatcctgcccctgactcctccaaatctcacgtcttcacatttcgaaacgaatcatgccttcccaacagttccccaaaagtcttaattcatttcagcattaacccaaaagtccacagtccaaagtctcatctgagacaaggcaagtcctttctgcctatgagcctgtaaaatcaaaagcaaactagttacttcctagataccatggcggtacaggtattgggtaaatacagctgttccaaatgggagaaattggccaaagcaaaggggttatagggcccatgcaagtccaaaatccagcagggcagtcaaattttaaagctccaaaatgatctcctttgactccaggtctcacatccaagtcacactgatataagaggtgggttcctatggtcttgggcagcttcacccctgtggctttgctgggtacagcctccctctcggctgatttcatgggctggcattgagtgtctgcggcttttccaggcgcatgatgcgagctgtcagtggatgtaccattctggggtctagaggacggtggcccacttctcacagctccactaggcagtgccccagtagggactctgtgtgggggctcctaccccacatttgccttctgcactgccctagcagaggctctccatgagggccctgcccctgcagcaaacttttgcctgggtatccaggcatttccattcatcttctgaaatctaggtggaggttcccaaacctcgattcctgacttttgtgtacctgcaagttccaaccctgccaagggttggaacttccacccaggggataattttaaagcactgagactgggcggccatgggagagagattcaccctacaaagcagcaagacaccttgatgtaagtcacatagaactggctccacacgaggtgtaagtctgcatcctcacaaagggcgggactctataagtgaagacaggaacaggagagacacccacagcctgtgcgtggggctcaaggcacaggtccaattatctgatgaaggtagggtaaggagaaaaggggtgagactgccctgttccaaagaggatcaagaatagagactgcttggaaagcgtgtgagttttggggctcagggtggcatatcctgaaccccagcactcacttattggcatttgggaaaacaggcagagcaggaaacccacgttcaccttcccctcatccttctcctccaaagcaggccatgaaacctaggaaggattttctgaccttccccaaagcaggccctaatgatacaggagctagaaagaaattatttaggcagatagttagggtaaaaggagtcctcggtaaggcttcccttttaataaaaagcagccccacataatttcttttctcacaaagagcagcctgaaaaatcgagctgcagacacagataagcaagctgcaagtttgcatgggtgaatgccggcagccatgccaatacagcagggctacctggaagccaggggtgttcagcatggagcctccgtcttcccttttcttttcaccacgtgtacagtaagggccaggcaacatggcgctgaccaggtagagaacccatctgcataataaaaggttaaggtggggcagtcagcttctttgtgtactgtgtaaacggcacacctagtccaaccaattttttgtgctctatgtaaatcagactttacctcctcaagctcatctataaaactgcctgcatttcaccacggaactggcaacccattttctccaggaccccactctctgcagcagaaagagcttttctctttcttttgcctattaaacttccactcttaacctcactctggtgtgaccgcgtcctagttttccatggccacgggacaacaaacctcaggttttaccccagacaacaatgccacttcactaaggccttcattcaagaggggccgtcctcatacctgggtaaaggtatatctttatctccgaagatgaagaatctgaagacaggtcttgttaaagttcccccaagtttgtttccatgaggtcacagcctctcgtcctccaatcatacttctccatgcctgcccccctcttcatcaaacctaaacaagcgtgaaaacttgcaggtttccctgtttgtttttttgagacggagtctcgctctatcgtccaggctggagtgcagtggcgcgatttcggctcactgcaagctccgcctcccgggttcaagctattcttctgcctcagcctcccgagtagctgggattacaggcacgtgctaccatgcctggctaatttttgtatttttagtagagacggggtttcgccatattggctaggatggtctccatctcctgacctcgtgatccacccgcctcggcctcccaaagtgtttttttttttttttttaacttttattttaggttttggggtacacgtgatggtttgttacataggcaaatctgtgtcatgggggttttctgtacagattatttcatcacgccggtattaagcccagtacccaacagttatcttttctgctcctctgcttcctctcaccctccactctcaggtagaccccagttccctgttttttaagttttcatttcctcatgaaagctcctgtgtgatataaaaactaacattaaagaaatgtgtttgctttacccaagttaatctgtcttttcttttaaggggcctcaggcatgagtataggatgggaagaaaaggtatttcttttctcctacatgtgcaattacttttagacattaaaaagcaaaaacaaaaacaaaaactgtagcccagggaggtgaggttgcagtgagccatgatcttgccattgcacttcagcccgggtgacaaagtaagaccttgtcttaaaataaataaataaataaaactgtctatgtagtgggtgaaggaaaaaaaaatcctttacctcgatagatatatctttgacatattttgaaatggctgtcacaggttcagcaaacagatgtacccttgcaaggctgtctattgtggggggatatttgcatctacagagaatcaccatgaatgtatgcaggccttttccatgcctttccaggatctaggagagcttgagactctgacacctttacatttaagtctgaaaagaaatatttaccatctcttctctctgagaatggtgacctattaggcttcacctacacaacaaagtctgctttactagccagtcctctttctttcttgctcccattgttactggaaaggggtcctgatccagacaccaagagagggttcttgtatctcacacaagaaagaattcagggcaagcccatagagtaaagcgaaagcaagtttattaagaaagtaaagtaataaagaatggaaactccataggcagaggccccaagggctgctgcttgcccatttttatgcttatttcctgatgatatgctaaataaggggtggattattcataagtcttccaggaaaggggtgggcaattcctggaatggagggttcctcccctttttagaccatatagggtaacttccggacattgccgtggcacctgtaaactgtcatggcactgatgggagtgcgttttagcatgctaatgcattataattagcatataatcagccatgaggaggaccggaggtcactctcattgccatcttggttttggtgggttttggccggcttctttatctgttttatcagcaaggactttacgacctgtgatatagtttggctgtgtctccacataaatctcatcttgaatagtagtttctataatcctcacatgttgtgggagggacccatttggaggtaattgaatcatgggggcagtcaccacccctatgctgctgttcttgtgatagtgagtgggttctcacaacatcggaggattgcataaggggctttccccccttttgctcgacacttctccttgctgccactatgtgaagaaggatgtttttgcttccttttccaccatgattgtaagtttcctgaggcctccccagtcatgcttaactgtgagtcaatgaaacctctttcctttataaattacccagtttcgggtatgtctgtattagcagcatgagaacagactaatacaacctgtatcttgtgctgacctcctatctcatcctgtgacttagaatgtctaacctcctgagaatgcagtctcataggtctcagtcttattttactcagcccatactcaagatggagtcactctggttcaaaggcccctgacaccataacctgtctggacactaaacctggttgaccaacgtaacctgtttttggctatgctccagtctgcattctttccataacctgaagctggtatatcagcttctgtaccttattgtcgggttgggtcttccttctaaatgctcccatgtatatatgttaaatacatttgtatgccatttctcctattaatcaatctgcctcatgtcagttgcttttcagtgaacttccagggagccaaaggcaatggcccccacttgggcatatataatgaaaaatcaaatttaaaatgttgcctttttaaaattcactaaataaaaataaacatgttcaggaaagcaactctcctataacttcaaagagcacccaggtggaagacggtttgttgtttactgcaattaagggagaggtgatcttggacttgatcttggacttcaagccaaaacttaaatttacgttgtttaaaagccaccaagtctatgggattctgttgttgttgttgtcatggcagcctgaaagtattaagacatttattgaaggagccatggagcaagggattcagccacgagaaatgggatcctacaagagcacgcagagggactaaatattgttactgcacataacgttttaggatcatatagggtgaaaaaaatatatccctgggcaacttgtcccacaagatggttcagagcagcactaggaaacacacatcagaccttgccaatgacagagaaatgaaaatcacacatcaccctgcagcaaaacagcttccaaatgaacgaggagaattggggcagaaagaaacagcttagcaccgggtcattccctgcccacccgcgtggtctgatcacactgagctctctgctccgggcccttgcaaaaagaaaatgtgctagatgtagtgaaaaggaaaggaggtcccctggcagatggtataatatcaaaaaccatgtattctgctccttgggagcttggtaaaaggtgatggacatggtgtttctggcacctcctggaatatgacttagggggccttgactcccacctctaagtctccagcttggaatggagagaggagagccacaggaagctgagtgtggggtttctagcagcattcaaacaagaggaattgaggataccagccagtctgtgagcagagtacaggagctatggagcttcccagagaattcccttcttgtctctcccatcctgaatgcaagctgagccccaccccagcttgctgtgcaagagaacagatctatccctcaaggttccttctccagcagacccacatgtcagaaacaggggttatttcttataggttggtttatacctaagacccactccaaagaagcaggcggcaacaaggctggggtatgcacataaccaaaatcgactcactgatttggtcttacttaggaaaacaaagttaaactaatactaagaaattttttttaacaaaaacccatagggacaattctcattgtctttgcaaaattgtctctgatctcatataaattctaagtcaaaacacatagtaccacttttgcaaatacttttaagataatcagaagtagtatgctagattttttaagtccccttcccccatactcctctcatttctcaaatctgagctggagctttaagaaattttctaagtatttttaaatggaaagtctatttttttaattctaatataccataaaataatacctacatgcaacttgcataactgtaacaaatgtacaatttatataaaatagcaagtgccacatttattttttaacttataagcttaattaagtccttacagagggattcaatgtctcattatttaagaaggtccttatcttagtcattctccaaagtctctaccctttgatcagaacaccaggtagggacaattgaaagacaaggaggtacagggaatgctcttatttaatagtagctgaaaacttacatacatagacatagtagtataaacatatatgaaaatatatagtagcacaaactcacatggatgtccacactaaacttatatagatatagtagcataaatttatgtggatgtacaacgtagcaaaaaaagaagaagaaaatgtcaagaacctttgatattcatgctaattcagcaacaagttataggtcctaggttttaatatctaagaaaatatataaagtcttaccactaattcagaaatgcaggtacatcactcattcttgattttccttttgttagacaagatcctctctaaggtatcctctgtcttcttgtaaatttccatgtaaaaggaaaaccacagattgaccataaactcctggagaaactagggtgaagtccccttaactgtctgtgggctctgggagggcaggaatctcacccctctgagactgttcagcagcaaggatttaagacagaggccagcacactgtagatgtcatggaagcagtgattgttagggattgtcatggacacagctctccagacagctggatgctcagctctttttcagggatgcctaagtggcgactctaccttctactctcaaacaagaatgtggctgggctgaggttgcgtttggatcccacattgcccaattacttccttacataaacctcagtgttgttagtgtaaatccttctggattggtgacccaagctcattattatgaaaaggaaggtgttaccggtggagggtgtccaggttcttggtgtcttgaacaaagaattggacaaaatgcaaaaacaaagcaaggaaggaatgaagggatttattgaaaatgaaagtacactccacagtgtgggagcgggcccgagcataggggctcaagagctgtgtcacacaattttgggagtttaaataccctctagaggattctattggttatttggtgtatgccgtatgtaaatggagaggatgaataaagttacaaagtcatttactcggagtttgccctatagagaggttatttcctgtcatagctgaagtgtgaattgcccttatgttccctggctccagaccctattttcctgccttaaaagtgcacagcaaaaattctacctctttctcaactagagcaaatccacatttgtgcagaattttgtcaacaaatgtgctttccaagcaagggatgggagcaaagaaaagtcccattgagaagcactgccatccactctacaatctgaagccaccctattctgtcaacgtctgcatccttgttgagtagcttaaacacagaagagcctgtatattgtcacttgcaggttcatctacaatctgatgcacagctcaaaggaagatacacacttcgagtagtttatctacaattcatactggatatttgcaggactaaatgaagttctctttcattattactgtgagtaacacatgtattttatactgtatcggcatggggatcaggcaccattttaagtcagggaggagaatgtttcaactttcagctctgtgctttaaaaatgtatgcactaacagggttttctaacaataggcatatacacatgcattagtttcctgctgctgccacaggaaagatgctacaggcatctttggggaactagtattttacagctcataaatacatattcgtgtatatctgtgatgagtcctttttgcaacaccgtttcatagccaacacccagtttacaatatatactggaacaaagatgtcagcgaaaataagtgagatccatgcacattgcatacttgtttgtctactgattcagaattcacatggaacagaaaatggataacttaacctccccctacacacacaaacttatgacactgttgctatatatgtgtgtgtgtgtgtgtgtgtgtaaacatactttagaaaacttttagattcacagtaaaattcagatgaaagtacagagaattctcacctacccccagcacccacacatgcacagcctcctctactatcaacatcctccagcacagtagtgaatttgttgtaatcaatgaccttccatggacacatcattactacccagactccatagtttacatgagggttcacttttaatgatgtacattctataggtttgggcaaatgtatcatgacattggatccaccactggagtataatgcagagtagattcactgccctaaacatcctctgttctctgcatattcatccctccccctaactacagctctttttactctctccatagttttgccctgtccaaagtgtcatacagctgggctcatacactacgtaagcttttccaattggctcattcacttagtcatatgtatttaagtttgctccatgttttttcatggcttgatagcttattttttttttagtgttgaacaatatttcatttttggttgtatcacagttcatttacgtattcacctactgatatggactgaatgttagtgtccctctaaaaattcctgtgtcaaaatcgaacccccaagggatgatgttaggaggttggagttttggggaggtgatgaggtcatgagggtggaacctcatgaaagagattcgtgcacttagatgcagcaagaaggagccatctatgaaccaggaagtgccctcaccagatgcagaatgtgccatgacttgatcttggacttccagcctccaggactgtgagcaataaatttatgttgtttaaatgccagcaaatctatgagttttgtcattggtatatcaggttgaatggattaagacacttatagaaagacatcttggttgcttctacttcttagaattatgaataaatctgccacaaacatccatgtgtggatttttgtgtggatataaatttcaactcctttgaataaataccatggaaattgagattgctggatcgtaggataagagtatatttatttttaaaagagtatgtttcgttttataagaaattgtattccaaagtggctgttccattttgcattcccaccatcaatgaatgaaagttcctgttgctccacatcctcactagcatttggtactgttggtgttctgcattttgcccattctagcaagtgtggtatgtagtggtttcctgttgttttaatttgcactttcctgacaacctgttatatagagtctcttttcataggcttatttgccatctacatatcttctttggtgaggtgtctgttatgaccttgagcccattttaaagtcaggatattgttgctttttaagacagaatattgatcctttccacctcccacccctagctcctctacattcagagatggcaactctcaggtaagccactgggtaagaggtacaaggaggcttttggtagctcagaaggtcctaggaggtgagttcaggatctcggctgctggctgggttgagggaggcagtactccagcgttcacgcaactggtgagctgagggattcaccacattaatccagaacattaattgaaaaataatctagtaatgggataagaagagctttcacagaaaactgcagccctgcatgagggaatgcctgtcagtaccagaaaatacacccctgagaatgaatctaaaaaacctccactccaacaagcagaaagaagagctaagacaaagacacatacccggtctcttggcacagatcaggcctagataagtctctctttattcaaatgataaagaaaaaagtgaaaaagcaacacggatctaggaaaagaagacagtaaaaacaagggaatacaacatcaacctggaggctgagaaggactctctcacaccaagatgtaattggcatttttcgttttctgaagtaaaatgataaagggaaaaaaaaatccttcaagcattcaggcaggaaaaaaaagtgagaagaagaaaaacaggttacctgcaagaagtcagaattatgtggtactcatatatgtcatacagaatcctgaatttgaaatgtcttttttcttttaaagtagaaaagttagtgacaaaagaattttatgcccaaccgggaagtctatcataagtagaagcaagaggaaaaccattatcgaatatctaaggattcattttttataaccaaatagacttctcaaaaataaaatctgtctcaattcatcaagaggagaaacacaaagaaaaatttaagaatgcaaaagttaagagatacgaagcctaggggttactactgtagccaaattagcacagtgttttgcacaaaaaagaattttaagtgtagttatcaaaataaagtagatgccaaaaattgttgaaaaagagtgtaaatattgtaacttaactaaataaaatatactttaagtttaaaatcccatattgcaaccacccaatgggttctccttgcccgctgcctagacaagagccaatttatcaagacagggcaattgcaatagagcaagagtttaattcacacagagccggctgtacaggagactggagttttattattactcaaatcagtctccctaaaaagttgggaatcaaggcttttatgggtaatttggtgggtagggggttggaaagtgggaagtgctaattggtcaggtctgaggtgaaatcatagtgaatcgaagctgtcttcttgtgctgagtcagttcctgggtgggggccacaagatcaaatgagccagtttattgatctgggtggttgcagccgatctatcaagtgcagggtctgcaaaatatctcaagcactgatcttaggtctgacaatagtgatgttattcccagaagcaatttggggaggttcagaatcttgcagcttccagctgtatgactcctaaaccataatttctaatcttgtggctaatttgttagccttgaaaaggcagtctagtccccaggtaagaaaggggtttgtcttaggcaaaagctgtgactgactttgtttcaaagttaaactacaaactaagttcctcccaaagttagtttggcttatgtgcaggaatgaacgaggacagcttggaggtcagaagcaagatggactcagttaggtcagatccctttcactgtcataattttctcagttataatttttgcaaagacagtttcagtattctatttggaaaaatacaagttaatgagacaaattatcctcactgcatatagtgagaattaaaagataccatgtcattcatcatattgaacaatttagatgttaagaagaatgaaaataatcaatatgtattgaacagttactaggtgccagtcattttcagcattttacctgtagatttgcaatatgggttcaataaccttcttgaaatagtaaaagagaacaagtacattttacaaagcagaatctgctttctaatctttggaaaagacccaaacaagcaagacataatcatatggcaaaagacagaaaacaaaggaactagcaaggcagctttaaaatcactcattaggcaaggagacagaagtgaagccaatcatatattttattctgttggaaaaggtaaaggttaaactcccacctaaacagacaaagactctcaaaatgtgctaaaaagaaaaccaacaaaaacaaatacaaatatttggaggaaaataacaggccaaaaactgctctttatcccctctgcccctacttaacaaaacctatagaaactggaaaaaaagaataccaaagaaaagagaaaagagggaataaaaacaattgccatcctcagactggcaaatggcaccaagaaatgcaaccaacataacaccaaagaagttctgtttagagcatattggcccaaattaaagaggtcacccagaagcagctcaacaactcctccttttgaaagatgggtgtaattttggagaaagcaaatggaagataatctggaaaactcaaatagcatcctctactttggacctacaaaggacaaggttggggacagttcacaagaagtgggaaagcctccctatgagtgggacgccaaggcaatgtggtaaacaaaaaacaaaaagttggccactaccactacttgcaatttttctctaaactggcatgttaacggcaatctcagagtcttccatttggggtaaaggagaaggatgggatggctgggaattcctgaatcttgaagcacaagagctaactgtgaaagagataggatggatatatttgaagctattttcagagctgtaggattatagcagaaggacaacccaatagagaagctaagcccttccggggagtaactgccccagaagccaggatacactccctacttagctaggcatggaacccatagggttctgccttggggcaaaatgcttgtccttctgcccctcagctgcctagaattgtactactcagctgctgcccaaattctgaatatgctgtggaggcccttctgcacattcctaatggttaattctagcacaaaccggagctgaatcaagatctgccttagaataaataatttactgtcatctcagactgcctgctcatgtcactctctctctctctctgacatacacacacacacacacacacttcacccagttaactaaacatgatcaaggcttagcttagtatttagataacaagctattaaaaatggccactcacaagcatgttaaaaaatgttataaatagtaagttagggtaaaaagaaatgcaagactacattttcactgtaccaattttatttaaaaagtttctttctaatgaacacatatacttatgaagtttatatctaatgtacacatttatttacaattataatgtaggtaggtagatggatggatgaagaaaggatgaatggatggatgggatggatggatgggatggacggatggacaaatgcatgaataagtaggtggatagatgggaagatcggtgggtaaatagatgtttgagtgaataaatggatggatgggtggataaatggatggatggataaatagatggacgaatgaatggaagatagatggatagatcatagatggatgaatgaaggcacaaatgaatgaatgaataggtggatagatagctaaatggctggctggatggatggacaaagtaatagatgaataggtagacgtgaggctgagtgggtgaatggatgaatggttggatggacggatgtatggatgaatggatggatagagaaaagtttatagaaatagatacatggatagtctgactgacagctatttggataagttggtctttgaactcactcatcaaaaagaatctaacatttacagctctgtgatctgggacagatgacataacttctctgagctttagttcctcatctgtacagcaggaataataacatatattcagtctacttcttgcaaagatcaaatagctattattttccatgagcctgacccataagagttgttaaaaaattgatggtttccttccaatttaaaattacattacctcataaagacattctttaaaaataagcagcactaaatgttgtactatttgggggcaaatgaaaatcaaatcccaaactgaaaatatgtgtgtcctataattgtacattacattttaagaaaaactaggatgaccaagagtattatataactgtactccttaaaggaataaaaacagatacacagagagttagaccgtgaacagatctacatgatctttttgtctataaggtaagggcaggaaaggaaacaaacaggaaaagcgagagtttaatttttaatctatcaaaatgacccaatatgagtgaaataatatgtgctctcttctgaatggagatgcaattaccatactgcatgaaatgtctcaagcattaccttatttagtgctgactttattgctttcttcatgttctctaatcattcagatcattttaatgtgcaccttctctgccttgtctgtggacagccctgaggacctggttcctaagtcaccaggcaggatttaggtgacagttaaattttgcctagcctctggtttggctcatcgggtctccatactttatttcataatattaatatcattacattgttatataatgtaattgtggtccccaagaaattccatgcctgaattcccagatctgtgaaatatgtcaccttacatggccagaaggactttgcagctatcattaaagttactaattcattgaccttcagataggaaagtgtttttgtgcattttgtgctcccataacagaatacaacagactaggtaatttataataacagaaatcaattgactcaaggtcctgaaggctggaagtccaaaatcaatgagctagcatctgccgagggccttcttgttacatcatcccatggtgaaagggcaaagagagggtgagagagtgcaagagatcaaacttgcagccccaggcccatttgtaatcaacattaatccactcatgagggtgcagcctccaggacccaaacacctccaattaggccccacctcccaacaaggtcacattgggaattaagtttccgacacatgcttttcgggggacgcattcaaaccatagcaaaaggtggttctggatggtttgggtgggctccatgtaataccgtgagcccttagaagaagaagcagaagacaaagtagagagaggttgtttgagggaagaccagagaaatctgaagcaggagaagaattctgcccatctttgccaactttgaagatgaagaaaggcagccagaactgaagaaattggggagcctctagaagctgagaacaactccagatgatagccagcatagaaacagtgaccccactctgatgattaccaggagccgatttctgatgataactcaaatgagcttgaaagtggatgctgtcccagagcctctggattagagctcagcctggtggacaccttgattttagcccgacgataccccaagcaaaggacacagcaacgtcatagccaacttctgacctgcagaactgtgaaataatcactttgcattgttttaagctcccatatatatgggaatttgttaatgtcacaacagaaatctaaaacagtaatggaatgtattataatatagcatgtctataagcaagaatgcatagggaaatctagttaaaatataataaacaacaatgaaaagattatttcctgagaaatctgactctttcccaagagaataaaagatcatcatttactctcccagggagaaagaaagattcccttgtctctcccaattttgtaggagagactgttaatttcaccacttatacattgctacgttgttttttggttttttaagacagagtctggctctgttgcccaggctgaagtacagtggtgcgatctcagctcactgcaaacttcacctcccgagttcatgtgattctcctgcctcagcctctcgagtagctgggattacaggtgtgcactgccactggcttttttttttttatttttacttttagtagaaacaagggtttcaccatgttggcctggctggtctagaactcctgatcttaagtgatccacctgcctcggcctcccgaagtgctgggattacaggtgtgagccactacacccggccgtcaccacttatgcatttagtaataatactataatattattttaattatattatattacctgcactataataagttgtatgttctaataatactattttaaaatttgtattttatgcataagttcttttgtgttttttatatttaatatgcacatgcatatttatgtcagaaaacctgtaaatactattacagattcgtaatttccttttgaacttcccctccatctcaccccagttcactgccttaattttctatccctgttgtaatgaattaccaaaacctcagtcacttaaaataataccaatttatcatgtcatagttctgtaagtccgaatcctgacatgggtctcactggtttaaaatgaaggtgttgtcagggttgtgtttcttctagaggctggaggaaggcatttgttttctgacttttccatcttctagaggttccttgcattcgttgcctcatggtttggtaagatgctgagcagagaacacaacaatgttgtgtaagatttctgacttacagaactgcaaggaataaattctgccaatcttcaaagtcagcaatattgtatctttcagaccattcttctatagtcacatctccctctcaccacagctgggaaaggctttccaattttaaaaactcatgtgattagtttggacatacttggctaatctcttatagcctccacacatcaagactcttaatttaatcacaattacaaagttccttttgtcgtgtaagaaaacattcataagttctggggagtagaatataaacagcttccctacagtctacactgggcagaaagcaggcacttagtgacttgcttataaattcaactgtgattggtctctactggaggctcagagaagacatgaaagcccaaattcctattttctgtccatgccatttgtgataaaaactgaggaaaagcaggaaaaggagatagtggggtagtatgcattggtcaagtcaatattcaaacagaactgctacatgtgcatttgggcaccaatgagcgcatttaaattgtgcaatccatgtcacaaatgtagtttcagtgtccttgtttcaacaggaacatgcataagggaatatggaattgagtcaagtcagtagtctatgaaacacagaaagtgaatttaaggcttcctaaaaggttgccgtgacgatcctccctgtctttgagtacatcattcacctccaggcaagaacaaataatacatctcatggattgaggaggagaaaatatttccttggacacctgaaaggatctgctatcacatcagacagtgtgcacaatgagaaggcagatttctccacataatcgccagcacaaagctacgatggaaggggcagaatagccctgccataatggcatgatggagctttctctcctgatgtcaggtgacttttgtcgcacttgggaaatctcagagaatggcctaccgttagcaaattgtgctcatcagcatgtgcatacgcacacacacaaacacaagcacacacatcctggaagggagttagaattccagcaacctcaccctggctccaatgtctaccttctagccttggtatttcttccccctggccccgcattccacgtgtttaggtgggaacttactgccatggtcagaaggcctttttcatttccagctctggaatctggaattctagaaacacacacatgttgaacaagtatgtacactgatgcgcaacccatctgtagttctcattggaaaatgccccagccctttctgtggctagaaattggccttcatgactctttggttaacatctccccatcaagggaatcagccatcctaggacacataaaacaacagatgggatatatacctatttctaccaaaaaaaaaaaaataagtaaataactcaaggagtgccataacttgtaattatctcaacacaatagaaatatcaatgtataatcagaatgtaaatgatgtgctaggttctcattaaatcatgcttttctagaaaaataaagacaaaataattttcatccactaccctgttgccagagatccatgtgaatcagagaaggtaaggatggacatgacctgttctgtctgctttcttatccccctcgccagtgaggatgtgttagctacatacaatattctttccagaaccttttaattatttggaaagaaagtgctatatggtcaaggagaaaatcctcagataatttgtattctttctctttagaatatgattttaaaatctagacgagttaactcatttgcctctgcaaatcgagcttgaatgaatgcccaaagtaaggcaggtggatggaggtgtccactcactgccatctgtctcttagaattaaaattgtcacgcagatagctcagagcaaaaatttctgagagacttaggctagagtcaaggtagcaagaactttgcattgatgacatttcaagttgcccatggcagatgggtgtgggtatgatacatatttttgaataattttctacgtgcttctaaaaccttcaactcccccatccaaactctttgggcttaattacagaaccgcagcattcaaaatactcaacaacttattgccactcattggcaattaactcagattatcacaaaattgatacaggaggtccagctggatgaataacatgagctggctagagaagggggaaaattttgtcatggaaggagcattaaaatgggaagttggctatctggggattgtctgtcttttgttgtttgttattttgtctgcaagatgtccttatcaaaacttctaccttctctggacttcagtatttctttgctagtagaataaagacattgaacttgaaagtgactgtgctccatcaagtcatgcatgtctaaagggcttcagctgggctcttggggtccacaagagaagtttcttccttaaacattcttgaaatagcacagactccctttctgtcagccatagccatgctatctatgtcaagtctttctgacaaattggttcagagaataaacacaaccatgtttttatcttctgcatcataggtaactacacacaggtaacagcttcctaaggaatagcacattgatgatctcatccagtctgattaaaccctaagtcaatgcagctttcagtgtttattgcacatttttttcattgccttcttttgaggcaataagtagtagggagtgcggcaaactgattaacagagttatttcctctgggcctaggactctgtaatatctcccgtttctgtttcttcagggatcacaaatctgatctggtttctaggattaggtccctcatgtctgattttcctttttcctatatttttggactttctagatcatctgtaggcactgcccaaaagctgtctttgccaaaagaggagcagtcgttagaaatttggggtgtggaaggaaataattgtcccaaaaatgtccctgagcaccaccactcccccgaccatgataaatttcttgccttggaccattctttgtgagtcaatgaaagttgttttgctcacataccctaaaccaacgggtttttcacattagggttaaaattatttaccattcaaatgaaaacttatgtgatgcttcacataatatgtcatgagaggaatgtaacttaaaacaacgagagaccaccacacacctattagaatggccaaaatccgaaaactgacaacatcaaatgctggtgaggatgtggagcaacaggaatgcttattcattggtggaaggaatgcaaaatagtacagccactttggaagacggtttggcagtttcttacaaaactatccatactcttactatactatccagcaattgcactctttggtatttacccaaaggagttaaaaatgtatgcccccccctcccccatacacacaaaaaaactgcacctagattttttagtgcatttatttataattgccaaatcttggaagcaaccgagatatcctttagtaggtgatatggtttggctgtgtccccacccaaatctcatcttgaattgtagctcccataattcccatgtgttgtgggagggacctggtgggagataattgaatcatggaggtggttcctccatactgttctcatggtagtgaataagtctcatgagatctgatggttttacatgaggttttccccttttgctttgctctcattctgtcttgcctgctgccatgtaagacgtgactttcgccttctgccatgattgtgaggcctccccagccacgtggaactgtgagtccattaaacctctttctctttataaattacccagtctctggtatgtctttatcagcagcatgagaatggactaatacagtaggtaaatggataaataaacagtggtatatccagcaatggaatattattcagcactaaaaagaaatgagctatcaagcatgaaaagacatgaaggaaacttaaatacatattactaaatgaaataaaccagtctgagaaggctacatactatatgatttcaactacaggacattctgggagaggcaaaactatagcaacagtaaaaatatattggtgtattccaggagttagtggggagaaaaggatgcatatgtgaagcacagaggacttttagggcagggaaattactctgtatgatcctataatggtggatccatgttattatccatctgccaaacccatagaacgtacaacatcaggagtgaaccctgatgtaaactttggactctgggtgacaatgatgtgtcctcataggttcatcaattgtaaaaaatgtactgctcaggtgggggatgttggtaatggggatgggggggttgtgcatatgtggggataggaagtatatggaaactctctgtaccttcctctcaattttgctgtgaacataacaaatttctaaaaaatagtcttttaaaaaaaaggtaatctgactctaaaaatctgactctaaaaaaacatttaaaaaatgcattttaggttgggcgcggaggctcacgcctgtaatcccagcactttgggaggccgaggtgggtggatcacaaggtcaggagttcgagaccagcccggccaatattgtgaaaccctgtctctactaaaaatacaaaaattagctggacatggcggcgcactcctgtaatcctagctgcttgggaggctgaggaaggagaattgcttgaacccaggaggcagaggttgcagtgagccgagattgcgccactgcactccagcctgggtgacacagcaaactctgcctcaaaaaaaaaaaaatgcatttgaataaaatattttggccaggtgtgctggctcatgcttataatcccagcactttgagagggtgaggcgggtggatgagttgagcccaggagttcaagaccagcctggacaacacagcaaaactctatctctacaaaaaaatacaaaaattagccaggtgtggtggtgcatgcctgtagtcccatagtcccagctactctggaggctgaggtggaaggattgcttgagcccaggaggtcaagtctacagtgagccatgttcatgccactgcactccagcttgggtgagagtgagatcctctccctctctctcaaaaaaaatgcattttatttatagaaattaacacataatatttatttaatgtaagttcaatgaaccagatcaatagagttattgagatgtgcataaatgcttgaaatccacagttaaagatgacttgcagtcttatcaacttccgggtcaaatttctttctttgtttttttctttttagagatgggatctcactgtgttgcccagaatcaactttctttctttatcttgttctgtctgcagtattgagaaaaccctgattaactaaaagaaatagtcacacatgccaattctgtgtgtgtgtggggggggttatgtgtgtgtatgttttatgtattatgtgttgtgtgtgctatgtggggagttcatgtgtgtgctgttgcatgtgtgtgctgcgcatgttgaactgtgtatatgctgtgtacgttcaatttgcaagcttcttcaatgaaagaatcttggaagagacacgataggacatttgtttcaatgtgaatagctcataatatctctcaaaatctcatattcctcttgctaagaccaatttggagaaagctgataaatgagattttcagccagtttaattttcatttttgagacatactttccaaatatatgttactattatgaaaaacgtaacatatacacttacatatgtatttatatgtatacttgaatataaaatgcctccttgtcagtctcaggcattcattcaatctcttttaaaaccctcacatttatttatattgttgtgtaggaaaaatccactgtggctttactgctgacactctatctgcaatggtaaacctaatattgacactgggtattaccaaattgtacctatttagattattaaaaacaagacccaaggcacaaagagtggttctgtgtcttagcagtatttaatagaatttctataactgcaaaagaaaaaaactaaaataatgcaaatgttaaatgtatgtatattgacaattacacagtcctatctgtggcattgcctcctaacgatggacttaggtaggaaaaagtaaattcaaaacttgtatttgaactattacatatattgtgaaaatatatccaccaagatatctgtacatcagtacaactgaaatagaacaaaagtaccaaacactggcatttcttaatagctagtgtttaactaagcaatataaaatgacttcactatctgctggttacagctttatgagcacccctcttccaacagtttttagtctcattggcttcggaccatcaattaaaggtcatgtcatttttgccaacttatccagagagtgttacaatgggtctaagctctttaaaatgtcctctgcttttattcccgtgtcaaatgatttaaaacctcatgggagaccttgaatcacaatcaccctattgagctgctccagaattttctgaccctacagaaatggaaagacaaaaagtgtgtgagttttttggggaggtcattctaaaccactgagttttgagataatgtattatgcagtgaaagataactaatacagccatcttctttcacctgtggtgtccagaagctccaatggaccaaaggcaaagctcaaagtgactaagaacaggctaaacaggggcaccctggctctaatgaatggactttatcctcctggagcccttgggaatgtaagacataattctgcgtctcctgagcccttgaaatggcagtgtttccgtgaattaaacaccactttgggctccagtcaccctgataactgaaaactcagtctgagaactgtcagaaaacccttcagctggtccagtggccccagtggagggtgttaatgagaaacaagacacaaatatcctataaaaaaagaaagggagtattgtgaatgctaccctaggtcctattgctcaattaatagggtagtaataagaggaactaagccacacacacatacacaaaaataagcactgttctgtctatattaaaaaatgtcatgggagtgttgagaaaaaggtgaatcaacagcatgtcgatgagcgatggaaggtgcagtcccaaaagatcagcatgccactctgacgtggaaatctccaccctatgggaaccatgcccctccagattcaatatggtcctgaaatcaaactccaatcctgtccatgaagaaaattctgcatcatagttttgctaactaaccatcagtgcagtcttcctgctctcctctgagtgaaacttgaatttacctgtccaaacaaatatttaggaagcattgaatatttatgacactgtgttggttgccaattgcagctgtaacaaatgaccacaaaaactacataaaattttaaccttacagttccaaaggttttaagtccagagaggatcttactggattataattcaggtatcagtagggctaaattcctttctggaagtcctaggggagaatccattgattgtattttccagatcctagaggctgcctgctttccttggctcagggatcccttctatcttcaatgccagaaatggctgattgagtgtttctcaccttgaacctatttggttctctctgatgaatccacctttcccatatataaggacccttgtgattacactgggtccatctggatactccagaatcatcttctcattttaagttcagcaattgattaacaactttaattccatctgcagccttaattcctccttgctatgcaacatataacatattcacaggttttggcaatttggtcatggacatctttgggcaaccattatgctgccagctacagatagcttacttttttccagagatacaacagtaaataaaatatttgccctgccatcttgggtctccaattctaacggggaaaatggtgtgcaaccaaatatttcaaccatacggcccaataagaacatagaagacatgagtcggagacatcagctggataagtctcctcaaggaggtagcatttgagctaaatcttaaagaacaagtattctgatgccaaattgtattaggattctccagataaacagaaccaataggatatataggtatagatataaacacagatatagatatggagatatacaagatgggatttattatgcaaattggctcatacaattatgaagacaagaagtcccacaatgatgccatattcaagctggagaaccaggaaagccagcagtataattaagcacaagttcgaaaggctaagaaccaggggaatggatgggtaactcccagtatgaggccaaattcctcagatcagggaggaccactagtcccagagtctgaaagcctgagaacgagaagctgggatgtctaagggaagaagatgaatgtcccagctcaagaagagaaagcaaattcacccttcttctgccttttcgttttatttgggctcccaatggatttgagaatgcctgcccacattggtgagggtggatcctctttacttagtctactgattcaaatgctcatctcttccagaaacactctcacagatacaccgaaatcaatgttttaccaactctctgggcctcttttagcctagtcaagtcgacacttacaatgaaccattacacaaatgaatgctgatggtaagatattgagctccaggtaaaggtatatggaatataagacctacaaggaaagttacttggagtccttatgtaaaaataaataggggtattgagaagcgtgaagctggggcaggacatgattagacctgcatgtgaaaacaatctctctgaccaaaaaacgaagaagctgggggcaagaagaccagttacctgtgccttaattccaataacaagctctttttttgttgttttcttgtatgacaatcaacctcgcagtccattccaaaaatggcaacttttccatccctaattgcatgctttaatttgcagaccaatgtttcaagtccttataagggctggaataacatccttcaatcccagtctcttagtacctggtaaaaccatcccagtccaagtccttggatttgcctgaatttccttttagagcattcccagcatgaaggattgtgttcccttaactcagctatgtcttcctctcttttctttacactcactgatatcttgaaaggacagattgaatattttcaaaagtagaagaaacaatcctgtgaaatagcaaatagtccttccctagaaatattcagccccttaatgatgatatgaaaactacgagaaatactatagaagggagggttgcattgtgaggaagtcttgctggggtgccttttaggatgttgctacctaaagtggagtctgtggatggctgctattcccaagtcattaccaatctgcaacgagttaagtaaagaaatggagagtaagcattttaaaatatgtacagcacttcaatagagtaattgtatagctcttgaatctaatagtaaaaataagagcttgtatttgtaggtctctatttcttccttctcaaaacttgtttttatttataaaactgtactgtaaacattgtaaacattggttttggaaacattggaaattttttttgaaaagtgtcagttttctctgggaggccgaggcgggcgggcggatcacgaggtcaggagatcgagaccatcctggctaacacggtgaaaccccgtctctacttaaactacaaaaaaattagccgggcgtggtggcgagcgcctatagtcccagctactcgggaggctgagccaggaaaatggcgcggcgtgaacccgagaggcggagcttgcagtgagcggagatcgtgccacggcactccagcctgggtgacagtgctagactccctctcaaaaaaaaaaaaaaaaaagaaaagtgtcagttttggatgtttttccatctctccagtgtggtaactcaggtagacacaggggcatggctgtgagactccctctcctacctgctctcacttggcctccctgggatctctactgccccaccctttgcatttaaatctccaccaaaccctactggaccttccattgctcttgtcatcagttttgaccttagctttggtatcttaaactatgcacttcagattcaaaaaaggcatgtcctcaaaattctaacttgtattaagaaaaaatgagtattactgatgagctactttgttctaacaactactgagtattttatatattaatatattgtcttttacccttacaatagccatgagggaggtgaaacaccttatagacaaggaaagggagtctatagacagtatgcctgagctggtttgggaccagtgcatgttccttctgtgctctgtcataatttatatgcagggatcatgcctagtttcaccaaataattataatttaatattttcctagttcagggtcataatccatctaaagtccagctatgctgacctaaaactataaaaagtgctctacaggaagctctgtggtcacttttcataaaaccctttaaagatctgaattctaagtagctaattgcaaaggttctttgctaaacagtaaaatgaatgattttaaaggcattatttaaataggatataaattttgatgaaaactctgtggctcttgcagaatcatgaaaatgtcacttatataccttccctttctcgaaggcaggttgtcaggaattgacatttgattatgcaaatctattttctaagactaaattacagtagaaagatccaaaacagaaatgattttagagttgtgtactgccagtacccacccccaaaaaaaggaatttaaagaaaaaaaaaattgcctaaactcaaactcttttagaattaccataaaatctaaaatttcaatacagtttggacaaagagaaaataagaattcttgtctcccattaaaaatctgtttaatcacaatcttactttatttttctcccttgtctgagccaacacaatcttacttttaagtgacacaaaaagatcccaaccttcatatattatcaaccttaaaatcatatctgccacttggctattttgtgtgtcccagacaatgacaaaactctttatgatcaggatctcattgacttctcacaatatccagtattacacaaatgaagaaaataagtgtattggttagctattgctgtataacaaatggttccaagacttagtggcttaaaacaacagccatttattattcctcacatatctctgtgaatcagctggcatcagaatcagaagcatttctgatctagaatgagcttattggtcttgggtggccttgatcctgcattcagactagcctgggcttgttctcatagtagtgattgggtcaaagaaaggaagtagaagggaaaaagtgctttgtgaaacctctgcatatgtgatattggccaaagcaagttacaagactaagtccaggatcaggaataagagaaactgcaacatagctgagtcctgggctggtttaggagtcgggtctgaatcccgtgcatgtgctttctaccttgcctcatgaaatttacaccaagggatcctgtgtacatcttcactaaacaattacaattaatccttacctagtttagagtcaagaaagtggctgttgtcctgctgatcaaatttataaacatgcaccacaggaagcagacagagaagcacttttcacaaagccctttgaagatctgaactgtaggcagccagttgcaaagggtgtggatatagggtggccgttcaacagggcagtttgtgcaatcagtcaattacatcaaggctgaaataatttaacaagttatccaccatcaggcaactagtaatttgaaaataggtctgtgggactccaaagtctgcagtcgagaggccgttttacctctgttatatgggactaatattacggattttatctggcttatttgttgaaaattttgtagacattacagatggagagaatgtgaacactgaagctgtgactgtggcaacaccagaatgtaacagatgctgcaaacaaaaatgaggtgagacaatgatgtgatttggatgtttctcccctctaaatctcatgttgaaatgtgcttcccagtgtcccggaggtggggcttggtgagaggtgattgaatcatgggggtggatccgtcttgaatgacttagccatccctttggtgataaggaagttctcaattagttcacgcgagatctggttgtttaaaagagtctgggacttccccccactctcttactcccactctcatcatttgatatgccagcttcctgaggcctcatcagaagcagatgctggagccatgcttgtagagcctacagaaccatgagccaattaaaccagctttctttgtaaattacacagcctcaggtattcctttagagcaatgcaaaaatggcctaacacagttgggaatgcggaatttaaaaaggaagtattccctaactctcagatcccttcgccagatcaaggacgtgaaaatggatcaaaccgtggaaggcacgttcctttggggaagttacaaagagtgtgattcccatttccctggagctgggaagtatgtggggtggtagacccgcacgtcagtgtgaagaatgtgacctctattggaagccctctgagagcgtgatgccgctccttgaaggtgagatgtaccgaagactacatcaggcgcctagctcagacctgagaagggaaagtgggtcatgcgagcaagtgtctcagggttcccccaacgttcaccacccaataatttgtaccttgacttgaatgatcttaacatgtgagcatcatttaatgaatatgagttttttcaatccagcttggtgcatcttaggaaagcctcaagttgtgcaaatctggtgtgagagtagaaagacctctacgtggacactctggattctttatgcttgagtggtaggacctgggcaagagactcaagctctctgtttcctttttggtatcctagatcatattgacctggccaaacttacaagttggttggaggcttaaatagagtaatggatgagcatatcttaaaaagagtaaaatgttatacatatgcatttaatcatctcttgcataaatacagagccctgcccccatgtgccccaaaaagccaattctaattttcttagattccaggcactctcttctaactgatccaggtaaaatctactatgaacctaccatagaaaggaggaagcggatggatgtgctgatgagtaaatataaagaatgagatttctgtaagttcactgcatataggacaaactctaaaatgctaagtagttatgtccacagcacagtaaaaaaaaccaatccagtttcctgactgtgagcttacatcattctttacagtactacacattcccaaactgcctccattccaaacatagcattctatttctagcattgtaaatcaaagcaggaaagtgttggaggttttagaaggcttttgcttcacctttcttaaaatgtacatgagtttctctaaattcctgatcaagacaacatttatcttcttcaggcacactcctgtggttctagaaggggcaagacataaattaaaaaaaaaaaaggagattggaattctaaaagaataagcatttgaaaaccaccaacttcctcaaaatttacatgactgtgcaggtttccacaaacactttcactacatgctgcggtcatcacgctccactctgagtccctggacagaaaaataaagtgcacgtcagttgttcaggaatttaatatccaatgggcaaggaagctttgctgcagctacatttattttaaaaaataggattgataagatgcaaggttggagacacgggtggtggttgttccagacaacgtcctaggataaagaattactgtttttaaactgaaaactgaaaatctagccaacaccaatttgtcatagatcctaaagaaatccacagaatcagagtatttaattaatctaaatgataaattgcctatgaatctcaactgcgcaggcagcacctatgagcagaaaattcacacaagaaagaaaaataaatgggaatactggtggtgttagaaatttaccttataaacaacattattctaaattttgcagcctaatactttggagtcttataatatatttgctcataatccccgaaggagtgaaaaattagcagtattctttagggcttctccaaagatgtatagccatgcacatttgctgttgccaaatacacacatttaaatgaaaatagctgacacctggtagagtcaccctctggagacatatacagaaacattaatctgaggttaacccaacaacccaatgtagacatgatgtactatataggaaaataaaatacacagtcatatgattattcatctgacagtaatagtgtagcctccttagggaaaaagataaagggaaaaatccattgaatattttgaaaagttcatttttaatcacatctcccaggcatctaacttatttgtaggctttgcaatcatacagatatataaatatatatttgaaatctcttcccctggaaaattaccattctttaagagaagacacctcctagaatctatcaaagaaaaatcacgtttatatgaaaagatcattatttcctttcttgaattctgaagcatctttgaagagggaggagaatttgcaaaatcaggaaagggctgctctcagaaaatccaatcacttttcaagcaatgatacaatgccagatgttaaaatttgtctgaagatttctagagaagtgaaagcaattagacgttatccttcatttcttctgttcagaatctcattaccaaagattgcagacgtgtcggttatgatgtacatcttgcaggtggcactttgtcattgttaaaataaagtggggtagaacagaatcttattataatttttccttggtggggtgggatgaaagagaggaagatggagagaaagggagagagagagagagaagggagcgaggaattagatgctatgcatatacaataaaccttattaattgcattattttgaaatgttatttcctagttacgataattacagggcattttaaaccattttagcatgtaacacacaatgataaactctatcatacgtatcttctgtgatgtggccacaaaagaaggctaccataagaatgtcacaccacagctatcccatgggcactgaaaaccagaaagcaatatgggtatcaccttaacacaggcaccaccaactgtggaatcagggacacagagtccaactcttgctccactcccaatagcaaaaaaccttggccaagtcaccagtccctttgtccatgcaatgatggagtgataccacatcatccccagaaaccttttccaagtctacggtgccttaatactaactaattttgactgtttccaacagctccaagggtgtttctgaagaatgaatttggaacatgtggtaaggcagatgacaatgtcttcatttctatatgtcaaataaagcctctggtctttttctactgacagctgaggaattcatgcagaagaaagtaacaacctgtacagatgcatttgaccagcaggcttgcataattccaggagcacctactctgtgcatggctacaggagaaacagcagaaataagagagacacagcatggtctccacccacaagtccagctctccctgcaagacattggaagggcatactggtgtcaggcagaattcactcagtacacccccaaaattagaatgtaatgtgttcctgtcagggtaagatcaactttgcaaggccaatcgggctgatgcatactcagcatccctttgctgggtcccagcagccagagctgctgatggtatttgcaggctggcaggggtgttgtctgctctgcagccaacctacagcacttgggtgtagggctcaccaggaaaaggacaaagccatccagctccatgatcctcatgctccttagggtctgtttatagcttaaaaaagtgcttaagttttgtaaaacagccaacttcactaaatgattgcaaattcattctcaaacaataattgtgaaaaccattcattaagctcacgtcattttattcagaaagagagaaaacaagaggtgatttttaaaatagactaatatctttaatatttgtaaacactatttttaatattttttaataaagagactaatatatttaatgtatcatccatgtgttacagtctcatcaatgtaccacaatgtagcagtctctcattgtgaggtatcacccggagttctttgtctcacaaccaagagaattgaggagcatggatacaaaggatgaggttggaacaaaagtttaataagtgaaagaagaaagctctctgctgcagagaggggatctggaaaagggttaccacttttacagttgaatgcaacggcttttataggaaactgatgagggccaggcatctcttttgcataaggcacacatttctggtagctccaccacttcctactaatgcacatgcaagcccttagactccacattgctttgctcctcttattgctcatgtgtcaggggacagaattttccattgtaggcacgtctgggcaagtcacctgtgtagactttgttatctatgcagctgtcggcatgtcttaggcaagcccccctgtgcaagttcccttatctatgtctacaggctgttcttttgtttgaaagaactcaacagaagacccaccttaactgcctgcctgcctgatggggtttttttctttctcctctctcacatggaacatagtcattatggcaacttggtgggaattccgggctcatgttaaaaatttcctcccatagctcccaagtccaaagtcactggtatccatgaacagtaagtggtcttgtcaattctgaaaatattccccccttttgtgtgtgtttttttttttaattgggattaagctcacataacatgaaattaacaatttaaagtgtgcaattaattccatggcatttagtgcattcactgttatgcaaccatcaccactatctacttccagaacatttttgtcacctgtaaaggaaaactcataccactaaatggtcaatccccattctcccagtccctcactcccgaggaccaccaatctcctttccatctctgtagatttgtcaattatagatatttcatataaatgaaatcatacaatatgtggtcttttgtgtctggcttcttttacagagcatgtttttaaatttttttttaaggcaatgtttctgtcttgtttcccaggctggagtgcaatggcgcagtcttggctcattgcaacctccccttcctgggctcaagtgattctcctgcctcagcctcccaagtggctgggactacagccatgcaccaccacacccagctaatttttgtatttttagtagagatggggttttgtcatgttgcccaagctggtcttgaattcctggcctcaagtgatctgcccatctcagcctactaacgtgctgggattataggtatgaggaaccacacctggtcttacagagcatgtttttgaggtccctccatgttgtatcacatatcagtacttccttcctttttataactgaacaatattccatctcctttagtttttaatcttctataatgtgtatatcaaataaagaccactctactttcacatgcagtttttcttttttaacactctgactcatagactactttttatcccagagcaattgtgatgcatacactctttaaagaaattaggattccaactttcaaaacattcagaatcagaaaaaaagaaaaaaaatctgctagaaatgtggagctacttactaccagtcatctcaggttacaaagattggtctgtgtaattttgtcgaatttcaaaattgaaatccactttttcaatccagtgctaagccctttctaaatagagctgacccttgaacattgcagaggttaggagcaccaactccccgtttagtcaaaaattcaaatataacttttggctccccaaaaacttaactactaacagcttactgttgaccagaagccttactgatactataaatggccaattaacatatattttatgtattatatactgtattattgcaatgaaataatctagggaaaataaaatgttattaagaacgttataagaaagagaaactatatttactattcatttgatggaagtggatcatcataaaggtcttcatcctccttgttctcacgttgaagaggctgaagaggaggaggaagaaaaggggttagtcttgctgtcagaggggtgcagaggtggaaggaagttcactgataagtggatcctcaaactccttgttcaataaggttaaaggttaaagaaagttaaagaagataaatgtgcattatctatttcaagttcaactctctagtttgcaaaagtaaaattgacaccttggtataatttcatgagacttagttttttaaatgagttacagtagactcttgaacaatgagtttaagctgtgaggatccaagtatcagtggacttccttccacctctgcacccctgtgacagcaagactaacccctcctcttcctcctcctcttcagcctcctcaaagtgagaataaggaggatgaacacctttatgatgatccacttccacttaatgaatagtaaatgtattttctcttctttatgactttcttaataacattttcttttctctagcttactcattgcaataatgcggtatatagtacacataatttataaatcccatattttaattgaccatttatcttatcagtaaggcttctggtcagcagtgggctgttaatagtttaagtttttaaggagccaaaagttatacttgaatttttgactacacaggtgttgatgtccctaacctctgcaatttgctgggcttccctcgatgccctcatagagctggtagccttcccttccctgtcttagatgtttatccatgctatgtcctacaagcccccaatccccattagatactgagtctttagtttgaatcctccgtctatattcaattcaaacatcactttgagtggccacaacacttttgaccagcattttaaaaaatgtagtcgggggaacaattgttttgaaagacactgacagatgctaggattggggatagtggaggaagaatggtgatgcaatgagtctaaaaattctgaattaaaacaagcttcaaccagtgtcttaccgccaaggtttcctgatttgcatatcttgagtatactagtgttctatgataggggtagacattagaacatttcttggttttatttagtctcaggaaccttgcttcaacaaccctctccctgggctaaggttcctcagtgcaggccgtggaaatgattctctcagttcttgccagatatttataccttagaatgaaaaatatatctaggagcaaatgtggctagcagttggggggtgagctaaggggaactgagctcagaaggggacttgcagacattaaccaggcttctgggaagccctgtggctttgagatcggaggaactgaagataaacttgtctactttctaatattgctcttacgtgcatgtgaactctgcaggcattaccaatgttggagaggtgcaataggaaaagaaagctgctctgttcaaagaagggatggaggtaactggaccctcaggaaagcaaagatcacatggtgaccaccaagcaggtgaccatccaaagacaaaaactccttatcagagggatttagaagtaattagactcacctattatctgcagtgagcacctgtttccaggcttcttttcaacttacaatttataggtgactagaatttctatacatttctggaatgcatgcatgccgaaattcattgtgcaacccttgctcacattagggcaccaaaatgcctacaaatgcaatcatttatcatgcaaattacctctcagttcccgctttaagttccataactgctaaggaaaatgcacctcggcacacagtcctctcttgccaaggcacccagctgcatgcttttgctgagttttctttctaataaaattttcctttttcaaacctacactgtcgcaaaacactttctgatgctggggttctgacaccttgcatgtcaggcacctctccacctgtgatgactcattttatgcgtcaacttgacgggcccacagggtgccctaacaattgattaaatattattttgtgagggtgtttcaggatgggattaacatttgaattgggaggctgaggaaagcagatcgccctccccagtgtgggtatccttcatccagtccattgatttcctacctgatttctgccactttgacttaagtaagccaattaagaagacagatgttttagcatccatacgtatattcaaattaaattgaaatttgtatataccttgtattaaactgttttaaagtaaccatggctagttagatggttctgatctggctgctgttatgaattacagatatactaaacgaaagaatgtccatgttccataccgatgtgtttagaacaaaaccaagaggttaaaatctgaggaaatttagtgaacattgatttatttgttcaaaaaaagcaaacaaaacaacaacactctaccaagagcatttaccctggagcatgggaaatactttcaggcagagagaatgaagaataaaagtgttctcccaaaggaacgtgaaccacagaataatcagaatataatgtggcaaactgggggaaccccacggaagccaatatttggaggagcacacaaggggttgataaagctgcactcatagaatttcttctgagtagagagagaaaaccgtggaaattgagacatttaaatgcacctgttaaatatgtttcaaattatgggaattttttaaaattattatgatgattttgagacagtttcattctgtcacccaggctggagtgcagtgacaccatcagaactcattgcagcctcaacctcctaggctcaagcaatcctcccacctcagcctcccatgtagctcagactacaggcacatgccaccatacctgtataatatttttattttttgtagagacaggttcttgctacgttgtccaggctgctcttgaactcctggcctcaagcagtcctcccacctaggcctcctaaagtgctgggattacacctgtgagccaccctctgtgccagcaaatggtggggatttaaaaatgagatgtaaatatgtctcttggtcttctatgccctcctacagaaccttggctgccatatgttgaacactcaccctgtgccagcctttattacaggttattaactcatgtgagacagtaaataatttgcctggtctttgtcctgggttcccagcacagaacttctgaaacctttggaatttcctgagagaattgtgtcttccttatggtaatgaggtgactcagggtgcactgaagttaatagcgtcaggatgggggctggtcacaagaaagaccaactatgtgattggagggttggggggattttcatctgcctgacctctggcgatgggagacagcaggagatgaaagtcaagaacatggctaatacttaattgatcatgcttaccaaacaaaacatggataagaactctggacactgaaactcagtagagcttcctggctggtgaacatcttgatatgctgggagaaggatgtaccctgattccatggggagagggtacggaagctctgaattcccaattccctcccggatcttgccctatgtgcatccttttttttttctttcttttttttttttcttttttttttttgatacagggtctcactctgtcatccaggctggagtgcagtggcacaatgatggctcaccacagcctcgaatctctgggctcaagccatcctcccacctcagcctctcgagtagctgggaccacagcacacacaccatgccccactaactttttaaaaattttttgtagagatggagtcccattatgttgtgaaggctggtctcaaactcctggcctctcaccttggctttccaaagtgctaggattacagatgtgagccccaggacccagcctatgtgtatcctttgtaataaaactataactgttaagtatagtacttcctgatttagtaagttctagtgaattacagaacttgagggattcacaggaacccctgaatttatagtaagttggtacaaagtgcaggtggcctggataccaacagtgtggctggtgcccatggcatgggaagtcttcttgaggattaaatcctttaacttgtggggtctgagctaactttggatgattagcacgaaagctgaatggcagtacactcagttggggttgcaacagaataatacctgatatgacttggctgtgttcctacccatatctcatcatgaattgtagctcacataattcccacatgccagtgggaggttattgaatcatggtggcaggtctttcttgtgttgttctcatgacagtgaatacgtctcaggagatctgatggttttataaaggagagttcccctgcacacactctcttgcctgctgccatgtaagacatgccttttctccttcctcaccttctgccatgattgtgaggcctcctcagccatgcagaactgtgagtcaattaaacctttctcctttataaattacccagccttgggtatgtctttattagcagcatgagaacagactaatacaacaccccagttacacatactcccattaccattggaggtgaaaccacctttgcaaaattataacagtgggagaaacctgacatagttgactccatcttgcttctgacctccaagttgctttggtcattcctggacataagtcaagctaactttaggggaaatttaggttgtagtttgacattaaagcaagaatgattataggtcttccccaaaactaaaccagttttgaaaggccacaagaataggattatgggaagggcttgtactgtgctaagatttaggcatagattttataattccttactgctcaggggtcatgtggccagaggtcacaagaactgtgacctttgcaattgctcccataaataacatcactattgtagaaccttaaattgtttttttctgagttgtttttcagactgaccacagcaggactcatgactcatgacttagctgctcctatggccccacccagaggtggactcaatgtatgaggaccattttccacacccctgctgattggctgtgtgattttacccacagacaatcagcagcacccattccctaatcccctgcccaccaaattgtccataaaaatactatcctccaagggacactgacatgaatgataactctgtttctcctttatgggttggcctcacatcaattaaactctctctctactgcaatgccgtatctcagtgaattgattttgtctgtgcagtgggcaggaagaactcatcaaacaattatagaggtagatattgttataaaccctattttgcagatgcagaaactgaggcacagaataaataatcagctcaaggtcagagagtggttgagccaggctttggacccatgtagctcagtttcaagcccatgttctttaattattattacaattatagatacagagtcttgctatgttgcccaggctgatctcaaactcctgagctcaagcaatcctccctcatcggcctcccaaaatcttgggataacaggtgtgagccattgtgcttgacccctattttttctctttattatttttattttaattttttttaagatacagggtgtcactatgtttcccagggtcatctaaaacttctgggctcatgtgatcctcctgtcttggcctcccaaattgctaagattacaagcgtgagccactgtgcctccaagcccatgtttttctgtgtgtggttttttgttttttgttttttgttttttgagacagagtctcactctgttggccaggctggagtgcagtggcatgatctcggctcactgcaacctcctgcctcccaggctcaagcaattctcttgcctcagcctcccgagtaggtgggattacaggcgtgtgccaccacacccggctaatttttgtatttttagtagagacggggtttcagcatgtgggccaagatggtcttgaactcctgacctcaggtaatccgccctcctcggcctcccaaagtgctgggattacaggcgtgagccactgcgcccagccagcccatgttcttaacactctcatgttctgcctcctaatgaaaagctaatgtgttatccaaactcaaggaagatatattaatgacatatcatgattttaatcataatagaagggttaaaaatgttcaacccttggaagagaaataagtaaacaaaaacgtacatgacactataataaaagaaataatcacaaccacaggtatatctctattgctgtaaatctaagtaatttatctggtattttatagaggaagaaatatagctgtgatgatcccaggagtcatatttgcatatgcagacattttccaacatgataaaagctttggaaatcccatctatattgactttagaaggatctgatgaaagtttcatcaagtaataccctctacttctcttccagctcctgcataatttacatctctgtggaggagccagtcttttgatctgcccccaggaggtttaggcattgaagtccccaaggctatccgtgggctcaatgactagagtctctgatatactcccattccataaaaagcaagatgcatgctccaaagtttgaaacactgcaagatgaggaggctttctaatacatatattaaagggaggtttttaactgtgtatgggactcatggtttctccccatcacctttcccctaatgctttctaaagaaattccatcacatgacactgcaatgcttaatatgtcataattccatgtgtcgttaatgttatgcaatattaaaaatgaaattgtgatattcaaagtgcgcacatagcacaatttgagaaaatgtgacagttttgaaattctgccaagatcagcttgaaaatcttgacgtagattgttcttacagatatattagtctgaattctcccacgagtcaaccccgagacaaggaggtgagtgtagtggccttatttatgcagtggcttatgcaagagcttatccaagaagctcactgggcaagtggggagtgagagagaagaagtaaagagaatgtgttaataagtaggggcttagtcactctcacccctgggaaggaaggtatggtcttggaaacacacccccaccccagggaaggaggcatttgacctccgactcccttttccagtgtctgagggctatcttaggggttttgacccacgtgccgctgagtaagtttcctagggacagagtcagccctgagctgagaagaaggaagccagacatgcttagtgagaggctgtcagcttgctgtgaaccctctagtgcacctgctagcgaactgagaacggtcaagggaatgagggtggagcatccaggcaccttccacagatggagcttaagtgactgtgctgaaagtaatccttgatatatttatttagaggtctcccttttaaggattcagaatgccaaacaaaattctgtcctttttaagggccctccttagcaccatccagactggaaagaccaccggtctatggccccaagcttcccctactaaaaataagaaggctgtaagggacagacatcaggtcttctgttctggcaatatgtctcataccaagaaagcactcaatccttttgttaaatgaaggcatgagttgatgaataccaccatctcctacacattcagttcagacgaatagcagatcatttgctgaaattcctaaagatgttcattttacattcagaagtctgaaagaagaaacaaatgctttttttccaacaacttttttttcatgtcattttaaagcacataaaatgagtcattaaagtgaaaattttaaaaagaaccactaaaagggacggggtttttcccacggtgtctttatatcttcttaattccatttgaataactcactctaagttctctataggaagacaaccatgtaacagaatttcccaaaggttaacttggagagtatataggcatgaagcacagccattactatattttagacaccatggtatgatttccagaaggtcctttccatgattacatctatagtttgaaattttaaaactctatggccaacattgccaatgttggctgattattaatttgcaaaggatggtggatggggtgatggtcgctcacaatattaattaaagactagcaccatccaatagaaacataacacgagccacaaacaggagccatgcacatgattttaaattttcccgtaacctcattttaaaaagtaaaaagaacaggcgaagctaaattcaataacgtacttttatataagccaatatacccaaaatatgatcacttcattatgtaaataattttattattattttagagaaggagtctgctatgttgccctggccagagtgcagtggcattcacaggcatgatcatagcatactacagtctcaaactcctggcctcaaatgattatcctgcctcaacctcccaagtagctaggactacaggcatgtgcaacagtgcctggctatatgtctgtcaataatgttttataaattactgagatattttacattctctttcttctactaaatcattgaaatctggtgtgtattttgcacatagaacacatctcaatttggactattgtccaaaagaagacgaggatggctaaatagtagaaaagagagctttactggagatatcagattgtaaattggggaggatagtctccggtgtggaccaaaagtgctctgtcttcaaagatggaagaggcaggttaggctttatgcctcacaggttctgtattacacagtggagttacacatattcagcaggtttggggggaaagctatacatatttataatcggggtgactgcatgtgcaatgggtaaacatacatgtaacttatgtctcatattcactttggggcatggttttcccattaaaatgagttagaatttggctcttcacatggaaaggtgaactataagacccaaatccaatttgtgtatagcttctataggcgagctgaaattggcatacggtctacggttgcttttcagaaaagaatgtttgtaagggtggtcctctgtccaatcagttacactagtctgggttgtaaaccagaattgggagaggtctgataactcctcttgttaaggacttcagcaagggtatggttctgacagctgcagggatttaggaagttgtcattccagcctagccctgaacccttgaccagtaggtcctactaacttttgtctccttaaccttggggtccatcttagttgatagagtggggtctgttttggtctctcagatcccaggactcacaatgttctaagagcccatagccacatgtagtgagtggccaccatattgggtcattcaagaccagcttatcttgtgggggatcttggtggagggtagagttgaaatcggtgaataggattcaagatagagaagagaatatcttccatagatgtttcatccactggagattccttttgttaatgtgctacatctctcctactcgtaatgtaataacagagttctctgttggtgtccatgtttgtggctgactgtcatgtggcagaaaaactatggtttggaacattctgaaaaagtgaaattagatgaagttaaaaggataagaaaggaagctttgagtgtagaaggtacttcaattgttgggagaataaagagttggtctaggtccagccccactttttggaaccacacaatataacacttgccaaggaatgtccctatttcccactcactgtatctttggtctttgttcccctaatcaaagtagggggccatactggtttcctttgcctacctgcaatacattatcacaaattgagtgccacatttctcatcccacagttctgaaggacagaagtcctaagtgaatctcactgggctaaaacctgtgtcagtaaagacgttcattctggaggctctggggggaatgtatttcctgggtttttccagtttctagagtcagactgatattccttgcctcctggcctccttccatctttgaagccagcaaatgttggccaagtatttctcaaatcacatcatttgattcttctatttcccttttccccatttaaagaatccctgcaattccactgagtccacccagataatccagttaatctccccagtttaaggtcaactgattagcaaccttaatttcatctccacatgaattacctttgtcatgtaaagtaacatattcaaaggtcctcgtaattaagatgtagatgtttggggatagaggtgtcattattttgtcaatctcagtcgcattccattgtaattctttttcattgtcgatgctgttgtgtttgctgaagccctatgttctgaaatgaaatgcccaactaaagtagtgtttgcctctagagtatatgtatattttaatttattgacaactattcttactatttatttttcactcttattatagtttaggggttaggatcagggttattatagttagggctagggttagggttaatccagctctttcctggactaaagtgattattgtgtcttaaatattttttagttttaaaataagtagctgattttctgtaaaggcaactatctacataaaatcatctcaacctccccatcaaaaataccttctaacatatctttctaaattctctctcattcagagacttgcaactgttgcatcagagcacagaaagatttttcccataagacatatggaagaagtgaagccaagaaatattataacacttttagtcacttggtaaatgtgtcaattttgggaactgaaccacaaactcaacagtagatgttcttaccattagcaacatctctagagcttccacattcagaagagcacattccttcttaaaattatgtgaacaagtcattgaattttaaatgagggtaactttttttagacaaaagaaaataactaattgccatttgatggagcattccctcagatgcctatatcatggcagatatgcaaaaaaagtggaacaaatttacacaaacctcataagtcaaaatatagacacatctaagcatgctgagctgattaagctaaaaaaaaaacagattttatttttcttgagggtttagaaataaatttatagctcacagtaaaataggacatcatatctgctttcaaaacaagtacgcacagcaatggaaatgtaagtttgtttttctattttttaagttaaaaaaaatttaagagacagtttctctctgttgcccaggccggagtacagtggcacaggcgtagttcactgcagcctcaaactcacagtctcaagcaatcctcccattttagcttcctgagtagctgtgattacaggcacgtgccaccatgcaggactattttttctttttatttttgtagagataatgtcttgctatgttgcctaagctggtcttgaactcctggcctcaagtgatccccttgtctcagcttcccaaagtcctgggattacaggcatgagccaccatacccagctgaaagtttttttttttttaatttaaaatttatggtttttttttttgtattacttacattataccacagaatgcaagatagtatacggttgttaaatttttaaaaattcataaatagaaaagtaaattcaaatattcccaaaacttgttttttaattcaatgtttgctacaaggagtgcacccttgccacaggagcaaaagtgtgtttttaaatatcaaataaagagaattcatttcacccattggtatttatttagctccagggctgtctcagggaactggggaagctgcgccctgtaacaagtgagcgcatgttggcctgccagggtgagagagaggggcatcaatttgagatttgccttaggaagatggtgcctccttgtgactcctaagggctgcactgctggtgctgcctctacctgcagatcaagtttgcaggcacaaagatgaagaccagggaagatccagtcctaggggaagggcatgtcacagattcagtcaattcttttgacgactgtgtgtgagaacattcactgtagtggtcatcactttgagaactggggtacagcagttaacaagatagatgagattcccagctctatgggactcacattatggtggagaaaaataaaatgtcacggaaacttacagacagcgggacatcacccaacttgctctgggaatgaaaacttcagctggaactggggtgagaaaagaagtccatcaggccccagagggtaggcgtagggtcaggttgagaggatgggcatggatttcaatcatgatttcaatcagaggaaggctccatactcataatgtgttcagattcttttcattgctctccagaaggcactagtagtattccaagatacctgcctatactgaatgcttccaccaagttttccattttccaattgctgagagccctaagaagccttctgtaaataagatctaggtcatctaagtcactctaccaaatcttcccctgagaacacattgccccctacctttcaaagttattgtcaaagctgctgtatccttgttgttttatgttcaacaacaaatgctttttattaaatgtcttctttgagctgggtagtgctccaggcatggcagattcagcactaagcaaggaatacagcaccctcactttcatgggggtcacagtgaagccagcatgatggtggtggtagtggtggtggtggtgatggtaatgatgatggcagtgatagtagtgataatagtggtgatggtggtggtggtagtgatgatggtggtgatgttggtgatggtttggtgttggtgatggtgatgacgttgatgatggttggtgataatggtggatggtgatgatggtagtggtagtggtgacggtgttgttggtgatggtgatgttgatggcaatggtggtgttgatggatactgatgatgtggtgataatagtggtcataatggtggtggtggtggtgccgaaagtggaggtggtagtgtttatggtagtgacaatggtggtcttagtccattttgtgttgctattacagaataccacagactgggtaatttacaacaaacagaaatgcatttggcttatggttctggagactagaaattccaacagcatgacaccagtatctggtgaggaacttcgtgcagtataattccatgatggagggcagaagggcaagaaagggtgagagcaagaggatgaagcttgctttataacaaagccactctcaggatacctaacccaatctcatttataaggacaacatgacctaatcacctcttcttaggccctaccttccagcactggttgcattgggatttcagtttccaacacatgacctttggggaacacattcaaaccatagcaacagtggtgtcagtgaggttggtagtgttggtggtagaggtgacagtgcaggtggcagtggggttgtggagttgggcaacaaacaagcacattagtgtactagaaaaataacagctatatacactaaagacaaagtggaaaatataaaacgtaatgaagtggacctgggctgctacttcaaatgaatggccaagaaagacctctcagacacagtgacatttaagccaagatctcaaagctgagtggcctgaccctgtgctccatattcatgattaagattgtattgaacaggtctaaaggttcaagaatattagcaatagagaataagctcctataaagcttatggtcaaaatatgaatgagctggttctcctataatctcattttctctataaacatttgagaatttttcataacaatattttccatcacatcacataaactctacacaggggaaaagattcaaattagcatttaacatttattctaaagtccactttgtgtctctctatacaaatgtcttttcttaagcttctagaaagtctttctgttcctataaacttgctgtaagtagaaagcctactttatttattctggcatctttatattcttgagaacatctctgcaaaattttatgtcatctgcagaaaatagactttttctggcaatttcctaactattgatttagctgttcttgtgtgtctttaaattaggagccaccagcctggtgttaggccgtgaaatggaaaaattatggggtgagcatctcagtcactcttccctgtcagtctttgtcttaatcctcatttacttttctaatctactttcaacttgacagtgctaatttcctggcaaagtattaattccaaacccagagaagaagaattactaaaggttctctgtagcaatgactgttggtgctctgttcaggttcatgctggcattttatcccccaggatacccattggccagttgagaagaatactgcctgctagcagctcagagctgcaccacctgctctcagccaaatgaaaatatctggagtttacattcctccccagaaggtcccaaagcccatgactgacagtgctccagtgatctactgctgcataccaaaccaccccagacctagtggaataaaacaactatcgttttctttgctcataaattagatggtttgggaatttggactgggcacattgggcagtttgtcctgctccatgatgtctacggcctcaatgaggaagactccaatgaatgggagtgacctgaaaaactggaaactggaattacctggagatttctcccctcactttcttgcgcctgggctggcaaaactaaaaatctgggctcagatggggctgttgagagcaactgcagattgcttttttgtgtagcttgaactcccttacagcatggcagcttctggttacttgggcttatactgtggtgaattgaaattccagcagtgactgtgtcagcaaacaagggagagctcctttggccttttacaatccagccttaaaagtcacatggtatccagtgagcacatgcaaagatcctcaatatcactaatcactagggaaatgcaaatcaaaaccacaaagagatatactacacacccattagcatgactactattaaaaaaaaaattacccagaaggtaacaaaagctgctgagaaagtggaaaaattgaaacccttgtactatttggggagtgtaaaatggtgcggctcttatgaaaaacaatattgaaattcctctaaaaattaaaaataggattatgatatgctctagcaattctacttttggatatatactccaaagaactgaaatcagggtatcaaaaacatatttgtacactcatgttcatagcagcactacttacaatggccaaaatgaggaagcaaccgaagcgttcatcaatggataaatgaataaacaaaatttggtctacccatacagtagaatattgttcaggcttaaaaaaaaaaaggaaattctgacacatgttacaacctggatgaaccaggaggacatcatgcttagcgaaataagctagtcacgaaagacaagttattatttaatggatacagagtcttagttttacaaggtgcagagagttctggagatgggaggtggtggtcattgtaaaacaacataaacttaacagtactgaactgttcatatggttttgctgtgtccccacccaaatctcatcttgaatttccacatgttgtgtgagggaactggtggaaggtaactgaatcatgggggcaggtctttcccatgctgttcttgtgatagtgaataagtctcatgagatatgatgattttataagggggagttccccagtacaagctctcttctctttgcttgctgccatccatgtaagatgtgacttgctcctccttgccttctgtcatgattgtgaggcctcaccagccacatggaactgtaagtcgattaaatctttcttttgtaaatttcccagactcaggtatgtctttatcagcagtgtgaaaatggactaatacaattgaacacttaaaaatggtgacgatggtaaattttatgttatgtgtattttacaacaattaaaaattattttaaaatgtcacatcatgtcactttcaccatattctattgttggaagcaatcagtcttctgccaatattcaagggcaggggatgcaaaccctgtctcttgatgggaagtgtcataaatttgctgctattttcaggtggaggttttttttatagagaccgaatctttctgtttcccaggctggagtgcactggtgcaatcatagctgtctgcagcctcaaattcctgggctcaagcgatcttcttgcctcaggctcccaggtagctgggattacaggcaggcaccaccacgtctagctaatttttaaatttttatagagacctggtcttgctatgttgcccaagctggtctcaaacttctggtctcgtcctccaatctcagcctcccaaagaaattgctgtgttttaaagccaccgcagtggactagagaccagtccctttaccacaaggcagggcaaatctgtagcactatttctgctccacaactcctcatggaatcaagctgaggcttcatctgtaatcagatctctgactgccttctctctccacccactcctgcttccctcatttcctgaggggtttctcctctgagccctccatcaataaatcactggcccatgagtcctcatctcagactgcttctagagaatctgacctaaaacagactgtgaggctgggaatctattaaaaaatcaaaagggcagtggaattttagattttttcagggctgtggggaatatattttgaaacaggaagccttttcatcactccttttgaaggatgtcagctattcacaagacctatcctaatcacttaaccatatttccttcaaagataatgactgtcattcttcctgttgacctgttgttcttaagaaccaaggtaccaactcagggagacagtgtggtcaacacccaaaggccaaagggaacattattgaatgtccaggtgccagccagggtgaccagttgcccttgtttgctccagaatgagaggcttccttggatatgagattttcagtgtcaaaaccaggagattcccacacaaaccaggataaatttgatcacctgtgggaagtttgcatttgtctctgggattttgtcaccctcatgttaaaatcactctccaggcatgtgttagattcttagggctgccacaacaaaaaaccatgaactgatagctttttaaaaaaaccttacatttatttatcatagttatgggagctgaaagtccaaaattaaggcaccagcagattcagcagctggtgaggacctgcttcctggttcatagacagtgccttctggctgtgtcctcacatggtggaaggggaaagggagctttctggggtctctttcataagggcacagatcccattcatgaggctccatctttatgacctcatcacttccccaaggcccatctcttaacatcatcaccttgggggttaggtttcagtatctgaatttgcagggggtggacacaaacattcagtccatacctgcagagttggttccttctaagggctgtgaggcctctctccttggcttgcacacagctgtcttctaccagcaagttttcattgtgccttgcctttatgcataccttggtatccaaatcttccctttttataaggacaccagtgttattcgattaggatccaccttaatgacctcattttaacgtgattacctttgtaaagaccccatctctggggccaggcacagtggctcacacttgtaattccagcactttgggaggctgaggagggtggatcacttgaggtcaggagttggaaaccagcctgggcaacacggtgaaaccctgtctctactaaaaatacaaaaattatctgggcatggtggtgggtgcctgtaatcccagctacttgggaggctgaggcaggagagtcacttgaatccaggaggcggaggtttcagtgagctgagattgcaccactgcactgaggcctgagcaaaggagcaagattccattaaaaaaaaaaaaaaaaaaaaagaccacatctctaaatataaggtcacgttcccgtggtactagggattaagacttcaacatattatttgggatgggggaaggtaaaattcaatccataaccatacataaaggctttaaccaggtaactaagtcagggagcagaaattagggggaagatctagcgatacgaggtatcccctggaagtttgcagatcctgtgacacatggctacattaaaaatcaaatcaacccaattagtgaactgaattacttccagaggtgtctgaatcaaggcagacacataaaaacatcaggtgggaacaaacattctaagttcataagaaacagaaaatcaagagctcccaagcacgagagaaatccctccatgtgcctcaggaagactcaaacggcatagcgctttggtcatcaaactttttgtttttgtacagatgctttgaattttaacttaggggctcttggatccattcctggctttggtatttaatattaactagctttgactatgtgaccaatatcctcagaatctaagttttcctcactggacaaataaaggagtagcaaggaattgctatttactcttttagttctaagttactacgaatcaaagacaaatgccaataacatattttctaaaagaaaattatttcttctggtttactagattcacattgagtaaacatttgcttcaataaatggtaacatgctcctggtctaaaaaccattcattcataatgaaacactgagtagttcgccctgaaaccacgaacaggatttcattgactaaatctatgttaaaatggctcatagattttgtttttacagagtaagcctatgaaattgatcagtattatgataaaataatgaattggcaattatataatgtcatatcctatgtactttaaaagtatgctagctacaaaaacctcaactatatattatactcacctggtattagattatctgtcaaaccccatcagcaataggtaattacccactttttacgagcactataaaaactagttgtcaatcagatggatggagcaaccaatttattcttgtacattgccattacatcaaattgcattatatgctgacataacctaagatcatatagttgtttatccattaagcaaaaacactaatcagaaaaattaaggtttaaacacttctagcagaattcaagtaaatgctctggtaaataatttttcagcctgggcaacaaggcaaaacctcatctctacaaaaaattaaaacaaaaattagccaggtatggtggtgcatgcctgtaattgcagccactcgggaggctgagttgggaggatagcttaaggccaggagctcaaggctactgtgagtgatgatcctcagatcacgacactgcactccagcctgggcaccagagagagaccccatctcttaaaaaaaaaagaaagaaaggatttttttttccaacctgagcatgaatcacaaatgctgactgtacattctacctttttgccccttttagggggggtctcattctattacagattacaaaaatattttatccactttatatgaaagctgctttcataactaaccgcttaatatctaccagtagacatcctttcacagagaaaatagaagtcaagaaccccatctgagtatattaatagggttcatttattattgtttgttaaatgtctcataaattgtttcagaccaagtagagaggaaacagaccaccaatagagatgtaaacattttgaaaagatgagcagttgtctgcagacaattctgttatcagtgtagatgtcagtccaattactgcactctgtagcattcagctgcccaggagaaaactcaaactgggaaactataggctgtgtttatacacgccaaatgaagtgtgaagttgtaccatgctggtgaagttgatccatctagatgccaatcaaatctgttaagtgaaaacaagaagtgtatcctctcttctgactaggtgtgttgctagccatgtggctaagtttcccacggtgttctctcccttggattaaataaatatactgttactattgactaatgtttcttttgggaaactcaagcaatgtttccctccagaagacatcttttctctgagaaatgatgctcatttggatattaaaacctaaatttcaaaatctgaaactaccctccattttcagtccaatgatgactcaaagtcttagagaaagaaacaacctgagacaataagaaatgtatgtggttttaaatgcatttcttacactttccagcaattaattttcatttacgtgagtgcttgtgccctgcaaaatcaaatgttttttaaaattttatttatctttaaatttattttgttttattttgtagagacagggttttgctctgtcgtccaggctggagtgaagcagcataatcatggctcactgcagccttgaactcccagctttaagctatcctcccatcttagcctctcaagtagctgggactacaggtatgcgccaacaggcctggctaatttttatattttttgtaaagacaaagtctcggtacgttgcccaggctggtcttgaactcccagcctcagtctcccaaagtgctggcattagaggcatgagccactgcacccggcccaaaggacttttaaagaaaaattaaatggggcaatgattttcatcagttatacctctcacccccatctcccacacatgagcacacattcataaacttttgatttttcaggcaccaccccagctgttttctgcagaaaggaattaatgaagaacatgattaggtctccaggaaggacttccagaccaacgttaacaaaaacagccctccagggtaattgcgggttttgccacaggtgggagactaggaggctgtccctacaacttcattcagagccctatttcaccttccagaccttccctggcatgaccacttttctctccatctgcctcaactactaatgcaggtaggtgttaagacaatgcctgattggtggagctaaatcccatctggaaccctagctgcaagggagtccaggaaacggcattgttggccttccatcctttgcagtactggactacacacttgaatgatgtggaatacatgccaagtcagtcagttaaccacagcttcccacaaaactactccacatgtaggcttattccctgccaacatgtttgttatttgaaaagcaatggtattttattattacatagttcattattttttctagtatgtgggatcattttaatccatctgcctttcaaattgtattatgtttaagcaggcataaagttaagtcctgacacaattatacagatgatcattgacttaacaattgttcagcttatgatatattgactttataatgatgtgaaagcaatatgcattcagtaaaaactatcttttgagtgcccatacaaccattctgtttttcacttttaatacaatattcaatgaattacatgagatatataacatgttattataaatctgactgtgttagatgattttgcccaattgtaggctaatgtgagtgttctgaacaagtttaaggcaagctgggctaagctatgatgttcagcaggttaggtgtattaaatgcatttcaatttaggatattctccacctacaatgggtttagcaggctgtaattccatcataagttgaggaatatctgtgtgtgtgcatgtgtgtgtgtatatgcatatatgtatacagtcacacacatatatatgtatatacacacatatacatatagacacatatacacataaacatatagacatatacatatatatacacacatatatgtataaacacacacatacatatacctatgtgtgacctatggtcacaccactgcactccatcctggaccatagaacaagaccctgcacctaaaatgttatgtgtgtgtgtgtgtgtgtgtgtgtgtgtgtgtttgtgtacacacatatgtacatatatgtgtctatacatatatgtctatacatgtagatgcacatgtgcatgtatgcatgtttgtgtctatacatatatgtgtacctatagacatatatacatatagacacatgtgtatacacatatatgtgtgtacctatagacatatatacatatagacatatgtgtatacacacacatataaatatagacacatatacatatagacatatatatgtgtctatccatatagacacatatatacattcatatatgtgtacacacacacacacacacacacacacataacactttagatgcagggtcttactctgtggtccaggatggagtgcagtggtgtgatcataggtcactgtagcctggaactcctgggttcaagtgatcctcccgagtagctgggactataggcatgtgccaccatgcctggctaatttttttaattttttgaagagagaggggtctttctatgttgatcaggctggtcttgaactcctggcctccagtgattctttggcctcagcctccccaagcattgggattataagcatgagccactatatacccagccaagcatctgtatatttaaactcctgtacttttgggtcttctttcagaggacaacactatcaattattcatcctaacataaaaaagaatatggagcagtttttaaagaaatagaaaggctacaacaccaaaaattctctctgaacctcatctcttagacttacgggatctgcaatatggcagagaagcatgcggtgccagggcaaaggaggaccataacgtgagaagttttcctatggtgttatcaaggaaggattagatttccctacaagcactctcagcagatctggggtggagaggggatggtgctgagagtcaacgacgaagtcccagcagtcagcccatgagtgtcattgattcagccagttcaataagcaatacccacaggcatctatcagagagctcacaatgtctctgataggcaggcacttcccaatggctgcaaaactgtgactaagcttgttacgagtaattactcagctgagtatttcatgtacagcaaaatctcttgagaagctttttaaaataaaggtctcaagcctcaactctcaagatcctgggcttggactacagaacctgtccccactccctcaagtaatgctgataaaagctggctgagtcgctactgtagagaagctggacaatgccatgggggaggtgaagggacaagaacgcgggttaggcaaacctcatgcaaagcaaagaacacaaccttctccagtttatgatttttctctagttagaaactggagttgcattcttgcagggaaaaaagacattttctaaaactggcttgtacttttagatttcaaacttaaagctattggcatggtatattggagaacctcctccacactcttataaaatggaagcacacacgattttcacatattattttgggccactatcctttcccagaagggtctgctttgtttagctcaagtttaaatcaaagagcagtgttaacttttgttgtgtaagtagtagaataaatattaggtttctctctgaatctgctcatcttcagttatcatgaataacatgaaattcctgccattgaagtaccatgtgagccatcctatattataaaacattacttagttttcctggcttttttttttttttagaataaaggtctcaatctgtcgcccaggctgaggtgtagtggcacaatcatagctcactgcaatggcctcaagcaatcctcctgcctcagcctcttgagtagctgggattacaggtgcacaccactatgcctggctaatttttgaaaatttttcatagagacaagatctcactatgttgcccaggctggtctcaaactcctggcctgaagtgatcctcccgccttggcctcccaaagtgctgggattacaggcgtgagtcaccacacctggtcttcatgacttttcttgatagcatatgttacaaagttttcagctggatgaaattttgagttattagttaagatttcataagataatttacatccagtaacagatggcaatgcagacctgtttccaacagtggcaacagctggttgggtacagacaacagtgtttattctactttcagtgcagtgtgccttgatgagctccttgcactaaagatcaaacaatactttgcatagaagcatgcctggccatacactaaccatcagagctattgcttagaaggccgattcctggctcaatctcagcctcctctcttgtcaggacacctcatgaagcagtaaaaaatggtatgaggactttgaaaaataattttccatggtcagtttcatggtgaaaagtgtctattgaatagcctcctagatggaaaagagcttttctaaataaaaacttaagagcatgtaacatataccctcaatcactggagaagtctaaatccattcctcatggcccaggaccatgttaccccatggttactgttctacatgcagtgaaggaaaaaggcagaggccaaggaggataatgctcaaaaagacttctgcactgcagtgttttgggtgaaatgtccgtgagccatattactgtgctaagattggattatgcttgcattaaagcgggatcatatgtgttgattttgcagaatggccttgaattttgttgttgttgttcctccctctgccattcagcatgtggtctggaagtgaagatgtaacagacagcacaattacacacacacacacacacacacacacacacgtgtacatcacatgcattgagtccaatgtaagagcaacattctagggttctttgcttaaatcctaccactcactatggcatcttgggcaagtcattccatacctctgggtctcagttttctcatttgtgaagcaggttcactgtgcactgatgacccacttgtctgcatccagtgagacagaacactcatgcacagagtaagtaaagtgggtttgttactttcaactaggcagcaagaagcaatagaagctgggacttcatagcaagccactcttccaaggctcagaaaagctgccccgggtagatgggggtctcttctgtgcatgcccaagttgcactgaagctaagagaccccataaatcagcctgccctgggtttcacacctggggccatgggacccgctgggctaaagcattgaaggacatcctatttctatgaggggattggaacagagcctggactgttctaggtaactcccccttatctcaagatgttgcattcccagcacattctatagttattcttaagaactccaagaaaaaaaagaggggagaaccaagactactcaaaggactgtcctgcatcagtggaaacagatgaattacaattcagttagaatgacagaggaatcgttaaggtttttttttttttaatttcaatagatttttggggaacaggtggtgtttgactatataagttctttagcggtgatttctgagattttggtgcacccatcacccgagcagtgtacactgtatccaatgtgtagtcttttgtccctcatccccctcccagcatttcccctgagcccccaaagtccattgtatcattcttgtgactttgcgtcctcatagcttagctcccacttatgagtgagaacatatgatgtttggttttccattcctgagttacttcacttagaataatggtctccaatttcaacaggttgctgtgaatgccattgtcctatcattgaaaatattatccagcccagaatttaagattgtccaaatgtcttcccttcaaatcttattgccttagtttacaaaaacagagggactataaaatatattttgacacaattaactatttcttgtttactattaatttcccaggcagcttggcactaaattaccaatcttactctatgtctggtatggagcactctgcaagtctataattctttttaatatgagatttctgtatgaacatgaacatttaagaagtaattttaaagccaatgcctattccaaataatgagccttacagagaattggaaaataacacaggactgtgttatttcttactgtcagaagactagaattacagtcctggctctgccatctactatatcattcattcattcatctgtttatttattcaataatttaacaaatatagattaactacctaccctgtaccagacactggtgaagttttgtgcacatacctgtgaagagcatgtactcttctctcatgaatcttgtagtttggcagagaaaaagataataagtaaacaaaccagaatgtattattagagaatgaaactttactttttgtttggatctgagtctgccagggcacaatttgcaaaatgcaaacttgaactagaagtctgggcttttctcagtagtcatagaatccacacactatacagagttatatggtcaacgatctcagggtcagtgggctcatttagagcttatgtaagcaaattgaatttcctattacaaacacactccataacttaagacagcaagtgcaatttttataatgagcagttttcaggcatatgtcgttaaactacaaggctcacttcaggtcatcagcaacctaggaagagcatcttataagtaaagactgtagtttgccaagttcagacctaacaccttgctcccaacagtctctctgtttataatcttttactggaattataaatattctctgttccagtggttcttagagtggatgcaccaagctcagggtgtttgcagagatatccctcggtgagtgggaaggaaatgtgaggatttccactttgtatctcatgaatagtaaatagtaatagttcaagtccagattaatgcttcctccctcatgcaagatgtaagatgtgatggggctccccagtagggataggagtgcctcacttgtttttactcatttttattttcagcagattgcaacctttcattaacaagtgcctgcttaagagaatttgctggtgatgccacctgggtttaagtatattaatcctcacaaaatggatgagtgacttaaagcccctacaaaaaaacaagagtgaatttgctaagaatcatgcaagcacaaggaggcaacgcatcacctaacccttgtcagggcattttcaaatgaaagacaacaactctccaataaaatctgataaaatcttagctcccactccaaacaacaatctgaattttctggaagactatgtaatggggtgatctgcatctgctatcatgatagaggaatctctttttttttttactttttttttttttttgagacggagtcttgctctgtcaccagactggagtctagtggcacgatctcggctcactgcaacctctgcctcctgagttcaagcgattctcctgcctcagcctcccaagcagctgggactacaggcacacaccaccacactcagctaatttttgtatttttagtggagatggggaatctcaccactcctgtattgtgtatcacgtgagacatttgataacagttggatgtgtttataatttacaaataatattaggtcggtgctaaagtaattgcggtttttgccattactttcaatggtgaaaactgcaattactttccaccaacctaatagctaagcacaggaaagtgttattgttttatcatggggatacgtgaccacaaaaatctggagaatgatgttctagccactcccattctattgattaagaaatgtaatggttagcagtcccctttgaatgtcatggctgtctgtgtttgagaagaaccatatgaaaatgatgttatgcaaccattttcgggggggctacagaaaggtaatttcatgtgattcaacctatcaaatacaatttggcttttctatttttattaagaaattaagccttgcagggtgggatcataacatcaggagtagtcatgagcggtggttaaggcaataaagaaaatccaactgggtatcaggaaagacaacgactatatcagggatccctggggtggagatgggaacaaagatggaaatatggaatggatctagttgtgcaattatccagggcgatgatgatggaagcagaaggagcagccggggcaagagtcctgcagcggcactgaggctgggttgggtcgctatgtctgaggtgatgggtccagggaaggaggatccatcaggattctaggcaagagaggccacctaagaaaagcaggcaagccaaggaggttggatttcatcctgtggacagagggtgttgggtaggatagggctggctctgcctaagactgtggacactgaattcccttctggaagccttggtttctctgatcactgtgagaataataccaatttcacagaattactgtgagacacacacattcttaaaggtactggtccccacatctggccccatgtgggcacccagcaaacatcaattccctccccttctttgatggactgcatcaatcactttttccaatttttccaattttcataggagtgcctatttaaagaaggtgactttaaaatattttaaataaggccgggtacagtggctcaagcctgtaatcccaacactttgaggggccaaggcaggtggatcacttgaggtcaggagtttgagaccagattggccaacatggcgaaaccccatctccactaaaaatacaaaaattggttgggcatggtggcgctcgcctgtagtccctgatacttatgaggctgagacaagagaatcacttgaagctgggaggcagaggttgcagtgagccaatatcgagccactgcactccagcctgggagatggagtgagaccttgtctcaaaaaaaaaaaaaaaaaaaaaattttaaacaatctgcataaatgccaagtaacaaattcgtctcattgatcctattacacaagaagtagggaatgattagtgactaaatattctacaagcagggactttcagaaatgtttttaaattaataaagtaaaaatgaacaagtgaaaaaattatctcataataattattatgttttgtattctatttccttgtgctcagttttccttattttattaatgcctatgagtaatagaggtagtattcataggtattagtaaatcaattctgtccacatttttaatgttcattcttttttttgtttgttttttttgagacggagtctcactctgtcacccagtctggagtgcagcggcacgatctcggctcgctgcaagctccgtctcccgggttcacaccattctcctgcctcagcctcccaagtagctgggactacaggcgcccgccaccacgcccagctaattttttatatttttagtagagacggggtttcaccatgttagccagggtggtcttgatctcctgacgtcgtgatccgcccgcctcagcctcccaaagtgctgggattacaggcgtgagccaccgtgccgggccttaatgttcattcttatttccatttcacactttcctttttactcttattgtgagggcttctgttgacgttttcaaacaatttgagttttgggaaaggcacttggcatgattccatctttcctttcttttaagaaatatacccaacctagtgtttcaaaatgaggacatcctcctcagagtagtcacctttggaagggaatcactgtgcccaaatgttgatctattagaatagcccatagagtgtttccaaggtgcatactgtcaccactttggggcaatgggctaggatgtaagcctcatgagagaaaagaccatgctgctcacatctttgtgcattctcaccaaaagccagattaatctctatttttatcaccagaattggatgcaattatttgagtgatacaagaaagcaaattcatccaccaagaaggacaatcgccatggagaatgttacaatggacacaaagtcagcaacatgagagacctgccctattcaatactattgcctgcagctctccaaccgaaagcgctaagcccagaaacaggtacaacgtgggcattccaatgctaaaagtattggacatgttcaagccctgatatcaatttcaacaaggaagtcacatgcaacttcctatcactgcagaagtttctggattaaatatccaatattggtttccgaaagtgatcactttgaaaggaataagggttttatgaacatctgtgctgggacgtgacttggaccaacccagtgagtgtttctgtatagtgccatctgctgctcccagatcagactgagatggcattaagtgagcacaaaaccaaaaatctaggatgaaggagatggaaagtttccaggtggtcagttggtgatagcatgaaaatgagattctagcaatatggagaagaagctgacatagataaatcagtgcagaacatctgtgccttagatgccatagaaatgctcacagagaagggagataggacagttacagttgttttccttttttaaagcagtggaaagaaactttgagaacttagagtccaagtcaatgaatatttgagtatctttaaactccagtccctgtactaggtgctgggcagctgctgtctctatgtccatggagcctggagtctcctttggaagacacacaatcaaggttactttttacaaattgcaacctgtgacaatgcatgagacagaagaagattaaaactttcgcctctggtggtggagttttggatctactgaagagcagtttgaaacaggtctagactttgatgtacccgtgagaagagagagttacaggttatttctaaagggtgttatcagaacaagtcatggcactcaacaaggttcctctcctcctacccaatacaaaccttaagggggatcatccaatggtccctgtttataacagcacagaagccaaagccagctcaccacctgtttttgttcatcaagttttgctggaatccagccttactcattggtttgcacagtgtctgtgctatttccacactatatcggcagtgagtagtgaagacagcagctgtacagctgctaaaccaacaatattgactatctggccctttacagaaagagttggccaactcttacttatataatagcagcatacattgcagaaaaaagaaacaaaggctcataactatacatcaggtatagcaggtgtaaggtgatattgcaacaccaaacaaatggaactgaatacagagatacagttacactttcctttaagtttgctatcaagttgctttctaagaatgtatggagtggctttttataatgtataattgatcacttaaaattccaattgtttttctgctgtacaaacatttctattgtgtcttggccttcttgtgaagtggagaaacagaaacatcgtctatgttgtattgctatcacggttccctggccatctgcatctaactgtaaaataaacagctctccagaagcacctatgcaaatatgagcacattcttctactgatataatttgcattaagctgaatcatttcccagaataaattccaagggtatataattttaaactccaattatggcagttgttctaaaatgggtttatccataaaagaggcaggtcctttactaatttacacaaaatttttcacaaggctgataattgaagttctaaaggcaatgagtttaattataatgccacctgtcttgatatcagatgaactgtttactttggaaataacagtaaagtaggttaatttttctttcaaggaaattttccaaagcatcatggaagtgtggatataaagtatttccctctgcatttataacaggtactcatggtccaagaaattcttgtcattgacaattgacagacttctctaagtaaagtttatctctttatttttggatggacaggatttggattctagttttttaactcaccaaaaagcacccctttctagtgtgctgagttaatacaaggacaacagaactaataaatccaagatatctctgtggagatagagagagcagctgcccagcacctagtacagggactggagttaacagacactctttatcttcaacaaagagttgaacaaggactacaaaatccctatgtctcttttataattaaaaattgagtactcagaatcatatcatttagctaaactattgtctgatggagtgcacgtgttttaagaaacagccttgcattccagaaaaatgaagttgatgatatttcttgaaattagaaacacattttctgcatcatggttgtaccaggaggatcttagtttcttaaaagtggcaaaggatagtcaaagaaacatgcagctccaaatatatatatatgatattgcatataatatagattacatatattatatatctatatgataaattatatatgaatatatgatatattatgtattgtatatttatatgataaattatatataatatataatatattatatgatatataagtatatttgatttaatttaattatttaatttaatttatttataattaaatatatttatttataattaaatatatttatttacaaataaatatattattgtatgcattatatctattatatattaattatgatatattatttatatgtacatttccaaatgtgctcttagctcttgttagtataggttttaaagattttttggactgattccttgaaagaaacctccttgaatttttattttaatggtagaaatatcttgatgacttcatggtaaattaagatgtagaaagagagccgtattaaggcaggacccctcaacactggcgaaacataagactctcctggagaggtttttaaatcctgatgcccagcccacaacctgacccaggtgcacctgaatgtctatgggtgggtctcgggcgtgagctttttttcacattccaacagtcaagttagagtaccctggacagaagtaaatcacagccatcaaaattaaaggccatgaatagaatatatagtaagggacagattcattacaaaggacctcagcaaatgagcatcagtcatttagtaacaatgccttgttataaatacagcttcaaaaccatttgtttgaaatccacatcttcaccttcactccatggccaagacttctaagtacctagcaacatgccaaagtcagtcatttgtcagctttctgccaaatttgagaactgcaatatggtagtgtggaaagagggcttgccttttgggaaacagaccctggaattttataggaacagcttctgaaaagccaaaaagatggggtaagaagctaagctcagagacagggcagacagtctcgcccaaaccacaggaacgaagttagggattgacacccatctatagtcagtcctctggaaaacatacctgtggccacattaacctgaaatgtgctctttttgagagcgagaacaatgattccaaaatattaataattgttacttgactaaagtttgaacatcaagaccgtgtattaaaattcattgctagaggccgccctaagaataattcctggaagttgccacgctgctaatatgtgtgattagcagcgtggaatgctgtgtgacaacagctgactgcctcccttcagtttcgtggggaaagaacacagcattaaatctcatttaagtggccccagaaaaggtaattgatcacatgtacgtgaacatttttttatcaagaggaaatttgggccaggtgcagtagctcacacctgtaatcccagcactctggaaggccaaggtgggtggatcacctgaggtcaggagttcaagaccagcctggccaacatggtgaaatcccatctctactaaaaaaaaaaatacaaaaaaattagccaggcatggtggtgcacgcctgtagtcccagctactcaggaggctgaggcaggaaaatcacttgaacccggaaggtggaggttgcagtgagccgagatttcaccactgcactccagcccgggcaacagagtgagactccatctcaaaacaaaaacaaaaacaaaaacaaaaaaaggaggaaatttgtttcacaggcatagaatccacgagaagaggtatcatggttgacagtgtctggcatcctcattaatgactccagagagacgccagtgactgaacatggcagaggacagaaacctcatgttgtggctatgcataaagcagaaaggtccttccagaaacagtgcttccaaattccattttaagaatgccccatcatttcccggccagatcgcccctgacgagatattgcactaccaacaggaagacaccgttgaatgcattctggacaaaagacaggtctgagagttcacatggattctggcaagggaaacgtatgatttggccactggctcagaaaacagagttttggaaatataagaagaaattaaacatgacgtactgagctaattacccaggacacacactgtgaatcattacacaagatgcattctccgtacaaggcagtgctggatgtagacgtgactctaactcattatattactgtcttcagaggcaaacatactacttgctgggtttttttcctctctgcatgaatgtgacagggaatataagtgtgcccttagttcttgcatatttgtgatgttttctgattctccctctctccctccacgttgattgacattttcctttatcttgctttttattttatttttattttttgtacagatgagttctcgccatgttgtccaggctggtcttgaactcctgggctcaagccatcctcccacctcagcctcccaaagcgctgagattacagtcatgagccactgagcccagcagacattttcctttatctttctattgaatttgataggattgatcattatgcctttgaaattctcttctggcttgtcatgcgacattttggtttcatagactctaactcagtaccttgcatactccataaatagttgttggattgatgaatgaataaagtaattcattaattatccctttttttccatattcttctccttcctttctgtcttctttgttttacctgtattggcttaattaccacttcctttacataatctctggatgatccttaagactcatcactcggctgttttcccatctttggatgcctcatccattctcatttcatgacattatgatcagcagaatgggtgggtgcaaagatctactacaggcaacagagaataagggcaggagtcatcctcacgggctgtgaggaaacaggtagaactggggagtgtgggcagacaggatttgagacatgatttgctgagctgggaggtcacttctaagcagtacaggaggtagctagatactacaggtgagcacagttatgaaaggtaagacaagcactaactagggtagcaagctaagatgggagtttggttaatcagtgctggaaaccaggaagacaagagaaaatatggcatgcatgtcagaggtatggtttccacatgccagattccacagggcatattctgccgggcattgaccaaggaccccactgtggcagaccaagtatgcatcgcctttgaaggaatacacaaggtaaagattccattataattttcagcctttaactattcactggtggaactattgctcttcaaataccctggacatttagaatttagccttctcccatcaccttaagtaacctataactaaactcacacactactgattctgattgagtctttgcaaacttatttagtaaaacttatttggaaccccaaatcaatatctacagcagttttgaggtcatttgctggcaaacgcagagcagtaaaaaattctagtcacctgatgcataggttcccagctgaggttgaataaggagacactttgccttcttgtttcaaccctcagacctaaaacaagtatccttttttatatcaatatagtggcacattttccacatttttgtgctctttgttggtgactttccttgtttgaaacagctcccaagagtagactgctgcagtgctgtctagagttcccatgttcaagaaggctgggatgtgctgtatagcgaaaatacatgttagagacgctttgttcaggatgagtcatagtgctgttggctgtggagtccacgtgaataaatcaacaatatacatgccacaaggtgtctttaaatggaaatacagtccaggcatggtggctaatgcctgtaatgctagtgctttgacaggctgaggtgggaggatcacttgaagccagcagatcaagaccatcctggggcacatgatgaggcctcatctctccaaaaaaaaaaaaaaaaaaaaaaaaaaaaaaatagcagggcatggtggcacacacctgtagtatcctagctactcaggaggtcaaggtgggaggatcacttgagctcaggagttggaagctgcagtgagctgattgcaccactacactccagcctggggacacagagagaacctgtgtcaataaataagtaaataaataaatcaacagaaatacacataaaacaatgttatgtattgatcagttgatgaaaatgtaaccagaagttcccaggaacctaactctgtatcttcccctaggagcaatattcaatatttgctaattcaatgtttaggatgacatatagagtatcacttccatgaataacaagaatcaactgtgctctattttcccagcatttgtttcccaacctcctgcactaaggtgcagcctgtctttcattgctatgccttctttcacctgcaagctaacatgtggtttctacaattctcgattcacaggctctctgccttcccctttctttccattctcaaagcaatcctcccttcctggaacctatttgatagctgaatcattgccatctgataggagctgttctccccagctcccaactcctttctcctctctgtcagcctggacaaggcattgccctctgttcttgcacaagccattgccctctgccttggacaagtcattgctctctgtccttgcacaagccattgccctctgcctttccacaagccactgccttctgccttggacaagtcattgacttctgctcttagtgtcctccaccttcccttccacccagtgagatgtatcaccatctgcagagtccagtggaaggggcacctcttccatgaagacctctatggttcctaccttccgctttcccttatccccatactctcagaggtcctatggtccaaggcactaatgtaataaactaaccgagtcaactttctcaaccaagtcaacttcctcatcagtttggacagatcccatggccaagcactttttatgggaagaaccggtaacctctttgtgcttcttgggattgtccacagcactcagcacagttgctgattgaactttgctcctgtttccatcaaattgagacttcctgcaattagggttgcaggacaaaatataggatactcatttacatttcattttcagataaacaacaaatgcattttttagaattagtctaactcaaatattgcttgagatatacttgtacttaaaaatgatttgttgttcatataaaaactcaaattaaatgtggtgttccatattatcatttgccaagtctgataaccctactgctatggactgagttgtgctctccacaaaattcttaagttggaacctgtattagtctgttctcatgctgctgataaaatcatacccgagacttggtaatttataaagaaaaaagaggtttaatggactcacagttccacgtggctggggaggcctcacaatcatggtggaaggcaaaaggcacaccttacatggcagcagacaggagaggacttgtgcagggaaactcccctttataaaaccaacagctctcatgatacttattcactatcatgagaacaacacaggaaagacccgtccccatgattcagttacctcccaccaggtccctcccacaacacatgcgaattgtgggagttacaactcaaaataagatttgaatggggacacaggcaaaccatatcagagccctaaccttcagtgtggctgtatttggagatagggcctatgagaaagtgataaaggttcaatgaagtcataaggatgggactctaattctataggactagtgcacttacaaaaagaggaagagacagcagaactctctctttccaccatgtgagagggcacagcaagaatgtagcccatctgcaagtcagcaagggagccctcaccagaaaccaactctactgatccttggtcttggacttccagcttccagaactgtgacaaaacaagtatctgttatttaagccactcagtctgtggtatttttttatggcaggctgtgctgatttatatacctactgacaagtttttaatttttgctatgtcattggggaaaaaaaactactttataaggaatacaaaagtagcagatttctagcttcttaactgtgaagtggaaacatacacaattaaaagatttaaaccttagtgaggaaattattatcaaaggtaaatgtatagaaagcaatctgtaaatatcatggctgaggagacacaaaatgtgatccaagtcaggttagatgaattgatgctgatgccaaggacgtgaccttgaacccgattttggaggaagagagaaccagatttttagagaagtcaaggaaaggtaaacaaatgccctggagaagctaatgtagaaatgatcacatgaattcattcatgtcttgctcttccacgtcactgtcactgatgtgttattgtttgtttttaccattttccccctaaaatatcaagaaaagtgttcatggattgtgaattacaaagcctgatacaattagtcacaagggaccattatgagtccttctgcaaatgtctgcaagggccagggaaataaaaagtacttacttgtctgaaaaaagcagggaagtaattaatcactatatggtagtatttatgcatgctatgaagatgattccctaggatgaaaattcctattggtaacattattctatgcaaccattattaacttagttagaaaggcaaatttaaaaaatttagagccctacagaaataccatttgacccagcaatcccattactgagtatatactcaaaagaatctaaatcattctattacaaagatacatgcacatgtatgttcattgcaacactattcacaatagcaaaggcatggaatcaacccaaatgcctgtcagtgatagactggataaagaaaatgtggtacatatacaccatggaatactattcagccagaaaaaggaacgagatcatgtcctttgcagcgacatgaatgaagttgggagccattatctttggcaaactaacacagaaacagtaaaccaaagactgcttgttctcacttacaagtgggagctgatggatgagaacacatggacacgtggaggggaacaacacaccctggggcctgttggagtgggggatgggagagggagagcatcaggaaaaatagctaagggatgctgggcttaatacctgggtgatgggatgatctgtgcagtacaccaccatggcacatgcttacctatgtaacaaacctgcacatcctgcacatgtaccacggagcgtaaaataaaagttgaaggaaaaaaaaatttagagccttaggaccaattaactctcaaaatccccagtaaagggatgcaggtattgtcatacatttggaatggttgttctctgctggctttactcctaaccacaaccacctccacaaatacagcaaagaaactcatctaatacaatctttcataacaagagcttccaaagatttcagctctcaattccttcagtgatgtttctgtagcggagacgtgcaaagtttatctgcctcagctcttggagtgagatttgtgagacaatgcaaagtcctatttttgtatcacaagtctgacatcagctccattttctgagaacaaacagccaaaaaagactcactggagcagtttgcaatcatttgtgtgaagtggatctccaggctagtcctcaggttgataaaggtataggaacaggacagcagagccaaggatggtgtgggggggttggttttgatctctcaaaaggttccatctgttacagaggctacttggaggaactcacatgtaccccaaaccagggaatcagtcgttcgaccctgaaaaggatgcatgggtttctttctttgtttctaaatctatttatgtgggaagtcttgagatagcatacaaaattaaatgatgctttccaaagtgcacgtttcaacaattacttcaaaaaagagggtgtgtttggtctccagtaggttgctgttactactcaacaggccagatacagtttcttgtctaaatgctgaccaccagaaaagccgactgctatttctgatcatgggtgcaaagagagaaagtgcaggaatctcagaataggctgactgtcggtcctgaggaggtgggctgttagttgggaaagtgattaaaaatattttatatttgcaagagagaagataaaacaagagtgtagaatatttaatttcccacaactaccaccaaatattgtgtaggctgtatataatatatatatatactatatattcttcatatttattgtatgtaattactatatattatataattaacaaatgtaatacatttattggacataattattatatatactattatatattactataatatctaatatttttagtactatttatttattatactattactatttgttatttactattattagcaaataatagtaatttactcattactattagtaaaatattagtaatatagtaattatacataatactaatatgttattatattttttctctagagaagcctgacaatttaaaattcatttttaaatttcaaaatcacctaccaccttgatatataagctaaaataaaactgcctgctattggtccccaaggaatgagtcaaattgccaaactctaaactcatataaacactgtgaagggataaatctaagcagataataagcagatcaaaataaaaagtagatcaaatagttttccttaataagactgccttagtccatttgggctgctataataaaataccatagactaggtaacttaaagaaaacggacgtttattgctcacagctctggaggctgggagtccgagatctagccatggcagattcagtgtctggtggggactcgcttcctagttcatagacggcgccttctcactatgtcctcacgtgggggaaggggcgagggagctctgtggggtctcttttataagggcactcataccgtccatgaggctccactttcatgatagcatcacctccccaaagccctaccctctaataccaaaacattgtgggtgaggatttcaatataggaacttgggggaacacagatgttcagattatagcaaggaccttttcattagtggatttgtgaaatcgctacaatctacctcaacaggcaggagtttagaatcctactccagtttatattataggctgaaacttgattttttttctttagcagcagattattgaatgggttgttatgcattgagttgttgtcgttgatctgcactttcatttcttgctctttaatgggcagtaatcacgtggagaagacccttgagcgcatcttcagtctcagatgagtccctcttgaggccgagtgaatttgaacatctaatgtagtaacaaagtgctaaggtccttaacattgtttaaatggaaaagtaaatgttttcctttgcctgaacattagattgttttacctgtgcatcttagcactcacagaagggcaggtaatgcaatatggaagtgcctatacattgcacttgaatgctggtggatgtcctagctctatttcaaggaccaagggatgctggccactgtctaaggcggatgtgcaatttcacccttcaatgtggttaattggtttgtccccatatgtgatgtagccaggagctcccttcaccttcctcctgcagtataacacaggtgagtttttttttattttttattttctgcttcacagaagatgtcttgagagtcctggacttggagttaaattttaatgtgaccctggtacatggagatgtagacttttctgtctccgggctgttccggcctttgcttctacagagttgttagggatgatagatgtggcgggacagaagactgctaacacattctggggtttgtttgtttgtttttttaaattctgagtagtataattattgcaattccattgtttgggagtttctgctaagtattttataagcctgtttttaaagccaggcttaaataacatatatcaccaggtctatgtagttggtgaatataagagtttgtggtttagatgtgttggggttgttggccatgttcataaggtagtaaaaaccccgggacagacccattgcttgccctaatcctcagatggctatggtctcctttcttaggatgtcaggagtagaagtcagcaagtcaggaagagggcagacagcacatcatagggagagaaagctactccactgctaggtaatttaaacatcatttgtagaaaaccaatatttctacatgacataactcaatagtgtttgatttctttagtgtatatatgattcttaaaattataatatacttgtgtgtgtgtgtgcactgccagatagatattggagtagactccaaaatctctatatattattcagcatttaacagaagaaatcaaaatactccttgcagtagccccttgcagccatggtcacaggattcacgattcaacattcatttttctcttgtaggatgcagtttgtcttggttcaacacagagtgtctcaagtcagactgttgaatttcagtccatcatgaactagtgtctgtgaccttgggcaggtcgtttaactgccccctgcctcagtttccccatcttagtctattcaggctgctataatgaaataccatacactaggcagtttctaaacagcagacatcatttctcatggttctggaggctggaagtccaagatcaaagtgcccgcagattcaatgtctggtgagtccccactttctgattcataggcggcaacttctcaccgtgtcttcgcatggtgggaggtgtaagggagtcctcatgactttatcacctcccaacggctccacttcctgatactatcaccttaggggtgaggatttcaacatcaaaaacttgcaggggacaccgacgctcagagcacagcatctcctctgcaaaaagggattatatttgcacctggggcattgtaggtttcacatagaagatgagatatgtaaaccctgcatggagagaagtacttcacgcatagtaggtgctcactcactctctggtagccaatattattattcagggtatcatgcagtggcactttgagaagaccctgtgtcttccttctgctgtcacagccacctgcagtgagatgtgaaggtgaaagggctgaggaagggaggctaagcccatggagcccagggagcacatgagtccacaggtcttcctggttgctccatgttctgagcatcctcagctccccatcatggaagtagacacctcttgaaggcagctgcataaatgcagaaataacacctggccatctttcaactcaactctgtttttctttcggcaaaagacatgtcaagattcatcgagttcatgcatttttattttttcaacatcagaaggtttcaaacacagagaagccaaacacaattgctgattttctggtcttgccttaaacaaccccagttattattggaaggcctagatttgattaatgggtatgatcatgggttcatccttctgcttatccaacgaggtgactctggttactttttaaacaactaaagcaggggtcagcaaatgttttctgtcaagggccagattgcaaaattatttttggctctgtcggccacagggtctgtgtcaaagtattccactctgccagcttagcagcaaaacagccacaggcgacacagaaagggatggggcagctgaggaccaataaagctttttttctggacactgaaattttaatttcacagaatttttgtgtgtcaagaaatattcttcttttgattcttttttgccaatcatttaaaaatctaacaaccattcttagcttgtaggcaagaacactgaaaggaggtggtgggctggatttagcttttgggccataactgtccaagtgatggaatccacgcttctcttcagtataagagtccagggtctctaagatttctgtcttactatcctacccaagagaaggtctttcttaccccttcatttgcacctacttaaatccagtcctaagagggctggttgaagatccacttgttctgtgtagcctgtctaactccctccagtctctttaaccacatttataaacatctgtcaatcgctcagtgtgacacaggctactgtcatatttataaatttctgtcaatcacagggtgtgacacactcatcataaagacaactgcaatggctttgaagatgggccaaacagggtttgatctccagctcttactggccacttcaagtctttgttttcctgtctatacaatcatcatcataatacatacttggtaagattgttattgtgggccgggtgcactggcttacgcctgtcatcccagcactttgggaggccgagggagaattgcttgagctcagaagttagagaccagcctgggcaacatggcaaaaccctgtgtctacaaaatatacaaaaattagcatgacccatgcctgtaatcccagctactcgggaggctgaggcacaagaactgcttgaacccaggaggcagaggttgcagtgagccgagatcacaccactgcactcgagtctgggtgacagaacaagactttgtcccaaaaaaatttttttaagattgttattgtaaggatttaaacaaagacagtacatttaaaacaccctaaatgattttagctcgtaaaacaaatctgtgatagagatgatgatgatgatgatgatgatgatgatgatgatgaagatgaactgtaaccatgtacgataattttggttaattgatgaactttgtaaatttgaaatctctatccctccatactaacgctgactgtggctatatcagatggaaatgccccttctggatgaaaaatgtttaaagtccccaaatatgaatccctctcaaactgctacttcaggcctaactggaaaaattaagatattaaaatcttaatatcttaagatattaggtgcagtggctcacacctgtaatcccagcactttgggaggccagtatagggggatcacttgaggccaggagttcaagaccagcctgggcaacatagtgagaccgtgtctttacaacaaataaaacaatatagcctagcatggtggtgcatgcctgaagtcccagctactgaggaggctgaggtgggaggatcacttgaccccaggagtttgaggctgtagtgagctatgattatgccactgcactccagcctgggcaagagagcaagattctctctctaaaaaaataataataatctgtttccttacagtagtcatttataaatagagctatttttttcccctaaaaaactggaggaaatgactgatgacatttttggttgtcaccacttgggggggggggcgctgctactggcatctggtgggtggaggccacagatgctgttgaacatcctacaatgcacaggatgctccccgcctccaactaaaacatgatgtgtctccaaatggcaatgtagtaccaaggttgagaaatctgttttacaaaagagcaagaaagtgaggtagtaaaagagagagggaaggagagagaaagagagagggagacggagagggagagagggagagaaggagagagggagacggagagggagagaaagagagagagagagagagaatgctaacaggcatttccttccctttaagtaactttttcaggaaattaaatcactgcttttaaatcgctatggcgtaaaaggactctgtactttcttttttagagagggagtcaaccactgaggacacgagggcataccagatgaccaattttttttgtttttttgttttgttttgttttgtttttgagacggtgtctagctctgttcccaggctggagtgcagtggtgcgatctcagctcactgcaacttctgtcttccaggttcaaacaattctcctgcctcagcctcctgagtagctgggactacaggcatgtgccaccacacccagctaatttttgtatttttagtagagacaaggtttcaccatgttggccaggatggtctccatctcttgacctcgtgatccgcccgcctcggcctccaaaagtgctgagactacaggcatgagccactgcgcccggccgaccaattatttttaaattgctccatggggactaatacaggacttgacccaaaatgaaaagataagctttctcatcagctggacaactttttgctggagttggaacagtctgtctgtgtctcatagacactgaacaaatggctgcagagatgatgtaagatcagatcaaatataaatctgatcctagatatcattgggcctagggaactctaacaagatttctcttaacataattgtaaaaacactcaaggagatgcctcctatattggaaagcctaacaaaagagcaacgaaacatctacagccaacgatcaaagataggtttcttacaggtaggacgtctacagctgagtcaacaaacactgatgccaggacactccttaccttgctatcttgtttgtgtggttatttaaaaccgtgtctctacctgaaggacaaacccagcctttccacttatttacatgcttgctccacggggcgcagcctgacctgtctcctggctgaatctgttgaataatgcagtcgataataagaattctccactcatctgaaaaatagcgataacaattttccagatagtcacactataattaaaagccactgggtgcgatgcatcactctatctaaataactatatctaaatataagaggaaacggtattgccacaaagaccctgcattgggcagggagacatgtgcaatatacaaatacttgattttataattttttaaattccaggaaaatgtaactggtttcttgcaaagctagagctgggcagatcatgagaaatactctttttttgtttgcttgtttttttcagagagtgtcttgctctgtcacccaggctggagtgcagtggtgcgatcatagctcaccgcagccaaaaactcccaggcacaagcgattcttccccctcagcctcctgagtagctgggacgataggcacacaccatcattcctagctcattttaaaatttttttgtaaagatggcggggggcgggggtctcactgtattgcccaggctggtctcaaactcctggcctcaagcagtcctcctgcttcagcctcccaaagttctgggattataggcaggagccagaaatactcttttccaacacttgggtttcataactggtaaacagaaatctcaaatggtaaattacatgctaaaatcacataggtcttgtgaccagacagtactagaagccagtctgtgttcccaattcaattctgtttccctcaaccaggcttgaccttggcactattaacactttgggctgggcaattcctggtggaagtggctgtcctgtgttatgtgggatggttagtggcatcctggcttccacctgttagacactgtaaccaaatgcgtgtccaattgctcaccaattgcagagaccagttagaaagagcatgttcggtataaagaaagtgactttattccagaacttagctgaggggaagaggtagaggctcctgccttaagggtattgctttgtatttgggggcagagggcaggggcttttaaagaggcactgggcgtaaatggcatgcaagggagaaggcaaggagatgtggggtctatgtgacttgcttgggatgtcttatctatttggtggtctggctggtgccatcactggcagagctagcctgtaaactgacacaatctcctggtgagagagagttccaggggggcctggtttgcttcagtgttcgctctctggaacttctaagttaacacatagttacaaaagcttgccatgtagggagtgtctgctggagagaaggtaaaggctacaattgcattcctaaagagctaagtaggaggagggggaaaaaggaaaagaggaaattcatttttttctttaaaaacaaggtattcggttacaatgtcagtaatagctgtccccctccccaccaaaatacatttaaacattaataaatgtcccccaagaagaaaatctccccacttgagaatcactgctctaaatctatcttaacttgactataatattgaaagtatgcttctaaacccaatgatgccacatgcagcaatgtcacatttctgaaaacaaaggttctattggcaaatgagcatgaacttcttacagctaaataatcccatttcagcttttattacaacccattccttaggtatcctcttcaggaatcctatataagaaactttcaaatcacctttcaccttccaaagaattaatgatctcctttgctttactcttttttcactgaatcagtcagtgtctcagtggcccacagacagggtaatgagagacagatgtagtcacaaaaggtctatttataaaaatgtgggtgtacctttgacccagcaatcccactactggttatctacccaaaggaaaagaaatcactatataaaaaagacacctgcacttgtatgttcattgcagcactagtcataatagcaaagtcacagaaccaacatagtgtccatcaatggctgactagataaagaaaatgtggcatatatacaccatggaatactacgcagccagaaaaaggaatgaattcacgtcctttacggcaacatggatgcagcagaaggccatctatcttaagggaattaactctaaaatggaaaatcaaatattgcagttctcacttatacgtagaagctaaacagtgggtccacatggatataaaaatggaaataatagacactggggactcaaaaagagggaagggtaggagggaggtaagagctgaaaaattacctattgtgtactatgctcactacctgagtaacaaggtcatttgtaccccaaacctcagcactatggaatatactcatgtaacaaacatgcacatgtacccccaagtttaaaaaatatatatatatttatttttttttttttgagatggagtctcactccatcgcccaggctggagtgcagtggctcaatcttggctcactgcaacctctgcctcctgggttcaaatgattctcctgcctcagcctcccgagtagctggaattacaggcacccgccaccgtgcccagctaattgctgtatttttagtagacacggggttttgccatgttgaccaggctagtctcaaactcctggcctcaggtgatccatccgcctcagcctcccaaagtgctgggattacaagcatgagccaccacggctggccctaaaataatttttttaatgtgggtgtagaacagctgttctcaacaggaagcgagttgtcagtgtcaggagacatttgggtttgtcactgctgtggagggaggtgatagcagcatctggtgagtagagaccagggatgctccgaaacagcctacaatgcacacagcacagccctccacacacaaacaagagttatccatccctaaacgtcaacaggtgccaaggttgagcaactgtggtttataggaacaagggggagctggcaataacccaaggccagtagctaccaaactgtctccaccaccaggctcagaaggatgagggaaggaagtccaactggtactggaaatggggagaggtttgtactctcagccattctgagaggagctgcggcatttggttgagaggctcagccaagctcaacgtgccctggaagggagcagccaagggaagagatatataattcaattctttcttctcccctgctcactgtccaactggggctccccattggccaaactctccaggacaccagcagtacagaagccctgtggatggtgtccatgcgaggcagcccaggagggagagaaagcagggcaagaatgacagacacacacacaagccctctaagcacactgaattttctagcattgcactgacttatctgatgcctgaggctatttcacttcggattcctggatgccaacactcactgtccactgctctgagatcctcatggtcaatgcctgtccatccctgactgcttgaataaatccaaccacggctctcttctttacttcatctccttggtagtgcactttctcacagctgcttacattcttctgaaggttgtattgacatagaagaaaaaagtctaatcatcttaacagtgataacttggatattgaatcctacaactctgtttcttagaaaaatgttggatctgaagtcagaggttttggatatgaggcagtgctctgacattcactggactctgaggctcatatgtgtcccagttgagtaatcacaggttccttaaccctgaggtgcactcaatggcaacatcaggatcatagtagcaagtacaaaggaagatgacgaagattatacaaaggtgtattaatccatcttcacagcaccataaagacatacctgagactggataatctataaagggaagaaggttaattaacttacaatcatggcgcaaggcaaagagaaagcaaggcaagtcttcacaaggtggcaggagagagagagagaagagggaagtgccagatacttatgaaacaaccagatcttgtgagagctcactcactgtcccaagaacagcataggggaaatcctcccccatgatccagtcaccttccactaggtccctccctcaacacatgaggattacaattggattacaattcaggatgagatttgggtggggacacagccaaatcatatcaaatggcacacatatagcgatcagcccagagacttcggtgtacaaaatagcaaagagtaagtattattttcatgaagaaaacctcatgatttccatgagggaatcacatataagaggtatcttaaatgcaaaataaaaacattgcaatgatatttattatttttaatgcacttacgccctaagccaaaggtaagatagaataatttgaaacaattttcaccaataacattggaaattttccctctggctatgttgaattgttttctcctctccattcctcaggaagtaatcttcatgttctcaaacttgacgcattctatgcctaaaaccttttcatcaaaaccttttcattatcttccatgcggccctatgcccaaggacattattcaaagagctcaatgtgagatgttcccatgccatggctctggggggcaaggtgttgcatctggagataagccagtttggaaacatctgttgtttactgctgctattggatatccaaaaagcacctgcatgttgactctcctcctggtggccctctcagcttcataccataagacacgaaataattgacgacaacaggcacaagtttccaataacttagggaaaaatttaaaacacgactctagggacagtgagttgcaaaagacagaaactatatgaagccaagaagaggagataaagaaatgattatgtattctctctgacctcgccccccaaccgtgtttgcactgaaaattgcattgagtgtagagaaatggtgagattttaattatgtgctctgtgcagaggcctcgaacgcaggcgcttcttgtcgagaatcatctactggcagagcgaagatgctattggacactcctggaaacagacatgctgggcatgaagaagctaaactgaggcaggaatgagagctgtaaattatctgaaattgctggggaagaggccccaaagcacagagaggcatcagcaacatcaaagagggtatgacaaccccagtccaatttcagctggggggaaaagtaaaacaaaacaaaacagacagcctgtttccagactgagagaaccacatgcctagcacatgtgggaacatcagactgtagctgagacacctgtggcagcttccagcacactgaaaatgcaaaccctattgtggaagacatggctggaaatggtccagctccttcctgcttcttggcttcccctgaggcactaggattttctttgcactttcttgaatgtgctaagcagtcggttttgttgctgctaaaactttctcctttgagtcttaggcacactccctcagtttactggtctctacttgatatggtttggctgtgtcctcacccaaatctcatcttgaaccataattcccataatcccacatgtaatgggagggagacggtgggaggtaattgaatcatgggggcggttacccccatgctgctattctcataacagtgagtgagttctcacaagatctgatggttttataaggcgctttccctgtgttcactctgcacttctccttgctgccaccatgtgaagaaggatgtgtttgcttccccttccaacatgattgtaagtttcctaaggactccacagccctgtggaaatgtgagtcaattaaacctctttcctttacaaattaccgaatctcaggtgtgtccttatagcaccgtaagaacggactaatacactactcaaacattgtttccttcatgagccgctctccatgtctgtccccacatgtgtccatcattctctatcccttaccctgttttatcttctccacagcacttagtatgtccaggcatgctacatacacatttaatgtcagtttccatggaagctccagaggagaaagccctgttttgtcttcagctacaacccagtagggaggagcacctcccacaaagtaagagctcaataaagtcactgtaggaatgaattagacctaaagcaaggtctactctggggtttttcattaaagaaagcagataactcaatggaaatacaagtctagacctggcacattgagctggctgatgtcaggcaggaaaacctctctccagcttcactggagagaccaggatgggcaagagggtgaagggtacccgcttcctaagagaaaaaggcaaagggggcaacataaacagaaaagtaagaaaaggatggaatgtttcatgagctgccaatatctcacttccaaactccatgggagcaggaaccctgactaatttgttcattgttatctccccagagactgcttggtcttcaccttcatcagatgctggacaacatactggatgaatgaatggatgtcattgcagactctagcgacctgcgaggtccagctttggggcaaacagccactaaatcagggccacccagtacaatacaaccatagcatgcccgcatgggcttctttggggattccagagaaggtgaaattctgaaagtgagagagagctgacacactgcaaatagctagactagcctttccaggagacagggattgataaaacccgagcactcctacatatcacgtactattctgttttagtctttacagtcctgaatttgttttttaaatgaagcactggaggaaacagtcgacaaggctgcccctcttttctgatgccaattgcaagctcaaaggtccctaagagcacccttaagtttgatgatttgctagaaagatgcacaaagctcactgaaagttgtaatactcatgcttatggtttattacagggaaggggtgagaattaaaaagcagtcaatggacaaacagcatagggcagaattcaggagagttccaaatgtggaacttccagtggtcctgaacttgtggagtcttgaacagtgttactttttggacatagatgtgtgaaaatagtcatggaatatgacaataagggaagctcgcctgaaccttggtgtcgagtcttcctcagagctctatcatataaaattggttggacacctgtaacagtaaagagaggcttagcatgactaagccttagcagaactgtaatatatttgttgtttataagccacttagttgatagtattttgttatagcagcctaaaagaactaatacagacctgtggttttccaaatccatcatctcatcagattatctagggagattccttgttcccactcatgacctacaaaatcaagcctccatggctagacaccagaagccgatagctgtaagaacacctccaagagattcttgtgcctggaccaggccctaatccatagatgagagcttgggagtctctactaagtagctagatatgagatcaacttgtatcagtatctctgatccaaagatacctggatctatgcttttcactgaaagagacccacatgctttagactgaaggcatacagatatctaaatatcttcttataaaaatcagtatttaatgaaagcaatgtcttagtaagttcaaatatatatattttatctgccttttttcttttttggaactttaaaaatcatataattaaaagaatagtttgaagcttgtaatatggtattaaaaaaaagaacaaagctgaaacataatttgaaattcaaagatttcttcctgtctgctttgactatggtagtatggtagtactttgagtatggtagcattcatatggcatcttcagttcttcaaacagccatcgcccaagatcactagggtccttgggagtttaagcaaggttgtccaaatccatttcaccttcttttttcttcattagtctaaagcaggggttggcaaactttggcttgcaggttgaagctgtctgcctgtctttgtaaatacagcttttttggcacatagccatgcccattccttcacatctgatctgtggctgctttcaggctacagatgcaaggttgagtcattgaaacaaagaccacccagaccacagagcccgaagtatgtctctctacaggaaaagttagctacaccttggtctaaaggcttggttatcctctgcctttgcataggagtcagcgtggattttgagaagtggaaaactgtcttccagaaatcctgcactcaagggcatgtccccctccccgtaagagtattcaagctgattgatggattttagttataggaaaatgtgtcaagtcctattcagtattatttgattctgatttaagactctgtgggggagatttccagttgcccactaaagccttttctcactcctcttctgtggaaacagagtaggtgttgtcttcaaggagagacttagccaaaggctacatttccaagctgtctttgcagctgaatttggccatgtggactcagtcatcactatggggaagagagtggagatgatggaaacagcttctgctatgctaggccatgcacatgctatggttgtactcaccttcccttcctgcagcacggaagatggaagtgccctgagcttatcagacagaagatgaacagcctagtggatgaagtttccccgtagccccagggagcagaaccttaactgtgataagaatgctcagcctgggattaatgcactgcagagagaaaacatgtgttttaacccatgtatgatagcatctttttcattcagcagattaaacttggccctgttcatcagacactattccaacctccttcatgcagtagtgagtcatgaacagcagcttttgaaaaagttgagtacaaccaacctgaaagcagacctagatagtgtgtgggagtgagatgtaccagacaaagggcacatattcaggttttacaagtccaggctctctcagaataggatacagaacacagacccatcctgcaaggagctaggacttgatgtcagagaaagaaagtgtctccaagtttgaggagtcctggaatagagatgaacagtattgtactgttggtcatgcagctgaaggctccctggaggaggaaggagacaggactaaaaaaaggaagtgtttctggaggataaaactgtgtgagcaaagaaaaggcacagtggtttaaccaggcgttgcttggggtgcacacctgcaaaaatcacagagcacagggttcaaggacccaccattcctatgcataaatttattgctcacaattctggagactggaaagttcaagatcaagatgtggcaaatacaatgactggtgaggccctgctccctggttcatagatggtgacttcttggtgtatcctcacatggtggaaggggcaagggagctctctggagcctcttttataatctcattcataagagctggctgcaaagcaaggaaatatccattcagttcgcttaacagagtaaggatggataaatgtatgcatgtggaacattccacctcacacacctgcccagtgcatagatacttctgccctttgctttgggtagagttttctctccctaaattttgttagaataaaagataataaactttcatttttttaatatatatttactttctgattttttctttgattttctttttctttttttttttttgagacagagcctcactctattgcctaggctggagtgcaatggtatgatctcagctcactgcaaactctgcctcagggttcaagggattctcctacctcagcctcccagtagctgggattacaggcacataccaccacacctggctaatttttgtatttttaggagagacagggtttcaccatgttgtccagtctggtctcgaactcttgacctcaaatgatccgcccacgtcagccttccaaagtgctgggattacaggcgtgagccaccgtgcctggcctctttggttttattctactaagcttttctttgcatctttaattgtattactttactggcctttctttttttaaataaatgtgtttcaggccatgttttaaaattctacattacttaccatgcctcatgttgaatgtatactacataatttgtcattaaggttttaatgtttgaattgcctttttaatttttttattaactgaaaatttattttagaagtgtgttcttatttgtcaagtatttatttgctttgtctttttatttttagtttctaattcaatttccatgtggtcaaagtggcctaatatgtcaatactttgaaattatttgatattttgtaagccaccaatgtgcaatttttataaatgttttgtgtgtccttgaaaacaacgtgaattctctttgtttgtccggataaaactatcttatcattcacatttcctataaccttagtattttttgttctgcttgatcaatcattttctgagagtattatattaaaagtacaacctacaattttaaaagtttcccttaattctgttactttttcactttttttctttttgaagttatgggtcaaatggacaaagcttcttaattgttttagattttcctagacggttccttttatgttaagtaatggtctgtctttgtttttaaatactgctgtatttgtattgattttctcttatgcctttttctggtttttatttttctgctttcctgatttctgttgggttgattgctttctacagtaggtttaagatttcctttgttgattcagaagctacagatttaatacacctgttctttttttgctattagcatctttcttgcatataagaaaaatgccttggtgtgattttatcataccagtgtgcatgctacccaatctctctcaataatgttaactagaattgaatcacaccttttcattcagtgttttctttcttccttaactgctagttaattaaatttgccaagaggcttatattttccctcttcctggctgtttaaggcatcccacattttctccttgagtctacatttctccttcagaatcaccatctctagcatgttagcaaagccaacttgagttgctcacacttcctggtcagccaggacaatgatcctgtgtgtgaggtagttttgtcctgttcattttctctttctgatttcatgttactattcccatgtgttttgatctaaggaagagcctaaaggaaaagcgaactattttgactggaagcttcttactaaaatatcacacattttcattttagagaaattagaatataaaaataaaccaaaagaaaacaaacctaacatgctcttaataccctcacccagaaataattactgtccacagttttatatacatcattccaaatcattttctctgcctacgtttgcaaatacaccttacaaaatatgtttcaaatactgcttttccctctgaatatcataaacacttttccaagtcaatatatcatttctatatcataatttattacatgaatatagcagaatcaattttgtcaatccactatggttgggcatataaattgtttctcatccttcatttttataagtgatacttatatcgcttacaaatcctagggcctatattttttagacaaaccatgaaaaattccttaaagtggaatttctacaaatggaattactgagtcaaagagatcaatatatttatgtcttacttagattattagtgactctctccttttacccttggaataactatgtgctgctctgtaaatgatttggattgaagaaattagcatctgcattagataacatgcatttaatatatattatattttggatctacaaaacttactaatttgtggaaagactctgtggaaaaccctagaaatattcataaagaaaacattgtttaaaatgttttaaatgttgaagaaccttttttggggagatactccaagtcctaatttcaccataatctaggcatggtaatagtaatctttttgcaagcataacaaaagattagtgagatagttatccttaaaatctcttgtacaaaagatggatttttctttcaaaagagcattgtttttcatcttacccactccagtcttccatcaaaaacttttttggaaatattttgtctaaaaaatacataaaatacctctattcatctactctatcacaaagttatttcaagttttagattcccaatgtgcagcacgtcactctaacttcaaagaaaaaatacttcaaaaagcaatgggcaccccttcttccaaattctctcacttgggagactgaaaacattcctagtgttgttagttttactttgtccccctgtctccaatttgtatagaaatattatacaaatgaagagttttaaaatgtttctcaagatctgtgcccccccaactgccactggcatatagctttaaatataaaatcacagttacggtcaggaggtagagaccatcctggctaacacagtgaaaccccgtctctactaaaaatacaaaaaattagccgggcgtggtggcgggcacctgtagtcccagctactcgggaggctgaggcaggagaatggcgtgaatctgggaggcggagcttgcagtgagccgagattgtgccactgcactccagcctgggtgacagagagagaccccgtctcaaaaaaaaaaaaaaaaaaaaatcacagttacatagacacagttatatagagaagaaaaatcacagttacatagacacagaacatagaaaagaaagggccaacaagctaaagtgagttaaacaggaagatggacacactgttttcttgttttcttgcatctgctttggtgattaatttcccttgtccacatacagaatcatggacctagaccctttgacaaggatgaaatagattcgccctgggaagtgcttcatttccttttcgcgacgcagtctgtgaagaacttggtattttgacaaggactctccatggtgtctctaaagagccttgtagaacatcatgcacatcttatttttagtgtgtttaaaagtcagtcagttcgggtgaatcctcgaatttattcaaattgcatgcaatggccctgcaggaacaatggtggccgtctagaaataggcacgctggacctggagcaccgctcagaaaagcttctaggcaaaattgtctgtttatgtgtctcctacaatatttcccttccacctccttggcagtgactgatttttgtaagactaaacacaagcacatctcatgctcacattattatggtaccgaaagaatcaacagtgataaggtactaaatgaaatagagcccaattctttactttgtgctctcacgtcgatataaagtgaaccaccctctacaatttgttaacaatctagaaggaatctttttttttcttgttctaatctgaaagtaatggtatattcaaaaattgttaacatactactaagcacatggaacatgattccataaagcatgttggtgttcaatttccatgtatagcaacataagctcccagtatcacatttttaaaaaatgtcattcaaacaaacccctttaactatattgagactctgttttcagcgaatgtagagaattagcctttgtatctctgcattgccatttctaaatagttctttttgaagggctgctttgaatagctactcattttcccatagacgtttttctaaaaactgcctttatgtgtttcactcacaaatacatggtttgttttcagtcattatataaacagagtaattatatattttcattgctattttgcctccagttttcccatattttcaaaaaaagtgtatggatttctccttagacacaatatattttgaacgaatttatgaattcacaaatgtccatccccttgtcctcacacatactcctgcttagagggatgcctcagtatctctggtctcacttatacaaccttggagaaaggagagaaggagaaacaaagagaggggagagaaggagaaagactgaaaggaaggcaaaaagaaagtgcctctgtctacttacaagcaaatacagttatgtggaccttgtatatagacctgtgattatatgccatgtcccacccacttctccatgtgtcagtcttgcctactaaatagatttcaaggtcttgaaaacagagtacatttcttatatgttttgtttaccctacctaaaaactaaaaaagatactaaagtgtttgagtatttcaacttatccatttaaatataaagtatctaaaatcttctaatatggataattcaaattctgatactttgtccacaatagcatctgttcaataatgactgccctaggtgttataatatgtgatctcacttaatggtataaactaatattagaatattaatatcagaacagaaggagtctctggggcagcaaatatgattgtcattgtatagagaaggaaaccgtagcacagaaagtttaagtaactcagccaaagtcatccagcaagtggctgttagggtaggattttaatccattttaacttgaaaccaaagcactgttttgctctattcccagtgtctatccttccttcaagtcaccaaactggttattgtttttaacaggcttccccgcacacatacacatgtactgttatctccttcatgtcaatgcatttctacccagtcacccaccaactcatgctttttctacacacacacacacacacacacacacacacacacacacacacacacacacacacacaccctggggaactggtaaatttggggactcaagtcttgcctatcaaacagtccatgtcatgattgtgtaagttgtgctgagcctgattatgctacacactgtgtcgtgcctccccaaaccattcattctacctttttccttcctttcttttcttgcatccccagttttttttttttttgcaattatgagtagtcatcagaaccaatctatccaataagatgtaataaatgagtaaataaaaattaatgggttgattctctagcttattaagtttactaagagaatcagactcagcatgtttccctcgtctttactcctttgcccttttcttcttcctttgaatacggatgtgatgcctggaagtgcagcagctatcatgggaccgtaaggtcaatagccacatggtaaaggtggcagagcaggaagataaggtgaagcttgtgttgttgatgccattctggggtgactaaactaaccctgaaaatccataaaccttttcactaattcagctagtattttgacttgattttgatgtctttccttcctagaagcttgtctacattgaaataactgtaacatgtgggttccatttaatggtcagcattaatgttatctattgttctcttccaatgtgaactgaaaagcatttagtaaaacaaggtttcaattaataaaattatcgtttctatatctatgcagatgttcctgtatttgatgtgtgtatctatgcagggaaaaaaaagaaacaatatccagggtacatcagaaaggaaatgtgacatttcattgtttttatgtttatggaagacctgccttaaaaataccttaaaagttccactaggcacagtggttcatgcttataatcctagcactttgggaggccaaggcaggaggatggcttaaggccaggagtttgagaccagcctgggcaacatagtgaaactccatccctatgaaaattttaaaaaaattagccaggcattgtggtgcgtatctgcagtcccagctacttgggaggctgaggcaggaggattgcttgaacccaggaggtcgaaagtacagtgagccatgatcgcacaactgcactccagcctaggcaatagaggaaaaccctaactcaaaattaaaaaaaaaaaaaacttaaatactttaaaagtttgtttgcaggaggcaaacaaaactaaaatttttcttcttgcattctgactttgattttaaatgtaaaacttcatacatcttgtggttaaacatgctagttgaagacgtcaagtcagaaaacaagagaaattgttgaaaaaattatctaaatataaaatagggccgacacatgatgaaacaagctttgtggatttatgagttataattcttatttattcaaagctaatgcattgttacttcagatgtaatgcataatgcctttgtaattatcatttaaatgagtggctaaatgtgaattattacaaaatagaacttaatgaccttcctcttaaagaactcttgaatagggttactttgcaattataaaaagtcacttgagccacttgctgtttgaccactctaacgcattgctgaaattgcaccaaagaaaggccaaatcacatcaaacaaagaaaggtccgtgagaacataaagagataatgtggcgatgggtaatttggacgtcatggggcaaacaaagaaacgccaaaccagagtccttcctcctttgagccagtacatgcgttcataatgaatgattgctaaaggaaaagtcacagctcttcagcaaagacatgtgccatctcacctctagccaacatcaaatctaaaccttgcctccataacatttcctgctttttaataagcctaaaagggacatattaattatgtatgatgcctgagataccagatcttattaatctgctcttgactcttctttgatttcccacgcttccacacacagctctttggatataggcagtcaacaaatgcatattcagtgggaaatttcaacatctaaaataagagtattagaaatattgtgatcctttattgttcaaaggaagtcattaagcctcgaatgacatcagcatttgtaaaccagtctcagagaaacgaaattcaatgtcccccagttccatgggcattcactgaacccctactatgtgtaagctgatcctcattgcagtatgcaagtgaaaatcatctatcatgagcttttctttgaaatacaaaaaaaaaaacataatttataccatcacggccttcacaaatctcctgcctctacaggcttaacctgctaatgtctgttctggctgctataaaaagaaaccacagacagggtgactgggtacccatcacagaactttattgcttacagttctggaggctaggaagtccaagatcaaagtgctggcagattcagtgtctagtgaggtctgtttcctggttcacagacagccatcttttcactgtaacctcacgtagtggaagtgggatctctttgagatctctttcataaaggtgaaaatgtccattcatgagggctctgccctcatgactcaatcacctgccaaaggccccacctcgtagtatcatcactttggggatcaggatttcaatatgtaaatttggggagcagaaatattcagtcaatcctacaatgtaaatctttacacaaggatacatttatcattcaaattcagaaacaaaatgatacttctacttaattctgttggtttgccacctgtttgatctacgttcatgtctccattaattctgcaacacagaattaggagagaacaactttcgacccctagtgaaaatctacaagaggaggctcataaaaatagaggctcctcttttttgctttagatatgtttaatacaaagagggataaagagagtctgaaaagttttgtggaattcagaccttctcccaaatacagtcttcaaagagtttgaaatatttatcatatacattgtactcttttcttttttcaaatgcaaatatacggccaggcttaaatagggtggactgaccaccaacatccattttttcatcttctcaaaattgaactagaatgacaatgaattaagaaaaacataaataaatttaccaagaaaaacccacagtgaatatttcaacaggtattcaaaagatgaaaagccctggagggctgttatttggcatcatagttccaaactctaagcgcttgccaagtggagcactgaagggaaagaagtcaatttatcctgtcaaccctgaaaagcctctggactttgaggttcaaagctgtaaaaggctgagaatgagacacaggttgaaaacaggagaacgacttgagaatccataaaaaagcacaaagacccgtaggtttctgatccaaccctaacttcagaaagtaggtggccaaaactgtgattgtactgaggggatgctgaatatttgaaagaatgtctggaccagctgggccaacagggtgaaaccccatctctactaaaaatacaaaagttagccgggcgtgggaggctgaggcaggagaatcgcttgaacccaggaggcagaggttgcagtgagccaagattgagccattgcactccagcctgggtgacagagcaagactccatctcaaaaaaaaaaaaaaaaaaaaaaaaaaaaaaaaaaaaaaagaatgtctggaaaccaatggatcgtgcttgcattgaataaaacaggaaacaggatagtcatgtgatttagatgtattaagatgaatcccagagagagctgagtataacctccctctgcagaacaccatggccatggctcaggaggctgcttggggcaaggtttacctctcctagaatcaatggggcaaggggctttagaagttaccatctcctggaaagaaaagactccacccccttgctatcaataatcgcatcctttcaagcagtcttccccttggaaccttcagctctaatattaccatatccctcatctctgcttctgtgagtcactctgaaaagtccagagcccttggtcattggtcatcacctaggttcttggtcattggtcatcacctaggttctagtcccattgtacactgcattttctgatcctcatctctcactcttcatctcttgatatccttggtctgagctttctgaaattttaggtccatctcatgcaaaatacctttcatcctcaactcttctgtgcattctgtggaaggaaaattatcttgggcccccaaaatctctaagctaaaggaaaattcaagctaggaactgctcagggcaaatttccctcccagtctgttcaaagtcatccctctgctcactgaggtagatgcatattttgattgcctcctttggaaaggcttatcagaaacataaaagaatgcaaccttttgtctctcacctacctgtgacttggaagcccccctctctgcttcaagttgtccccacctttctggacaaaaccagtgtacttcttacataaattgattgatgtctcatgtctccttaaaatgtataaaaccaaactgtgccccgaccaccttgggcacacgtcgtcaggacttcctgaggctgtgtcatggactcacatcttcaaccttgacaaaataaactttctaaattaactaagacctgtctcaaattttggggttcacaattcctctaacattcctcctctgtttaaaaccagctctatccttaggacacagcttcccctgcagccccctaagtagtgatcactctcttatataccccatggaccactgggcctgagagtggggtgagtgtcctccttgttcctcagtagcatatctctcccacctcctgaataagtccttggcttgagtcacgggtcatcagaatataccattcatggccaggcactgtggctcacacctgtaatctcagcactttgggaggcgaggtgggaggatcacttgagctcaggagttcaggaccggcctggacaacatgtgagaccctatttctacaaaaaatcaagaaattacccaggcatggtggcacaaacccctggccccagctactcaggaggctgaggcaggagggtcacttgagaccttggaggttgaggctgcagggagccacgatcatgccactgcactccagcctaggcaacagagcaggaccctgtctcaaaaaacaaaaaaaagaaaaaaaataccactcacaactctcattgttgttggtgtcttttgacactcaacaactccctgttattctaattcactcactccttaaaaactatggcattcttaactctcatgcatgtataattagatgacttgttaatgactgatgatgtctcagttctgtgacctctgtacctcaatggtcttgtcctacacacatcttggccactctctcccatggccataccctagacctcacaattatcaatttcttctcttcttcataaagtcagtttcaaatatcccatcctagataactccctcctaatttttctaccctctctgccgactactccaaagttaacaatcatttacccaaagagaaccctccctccattggccctatcacctttcactgtttcccatggctcccatgaactatttttcttccttctcttccttcaattgtgtgtttcctgacctatgccctcaattctctttcctcttccctacttccccgggctcatctgtcaaaccaaacacttaaattgtactgttcacctactccatgtttgaagtggctcagatgaatatggttggaaaaaaacaaataagccaggcacagaaagacaaacatcacatattctcacttatttgtgggatctaaaagtcaaaacaattgaactcatggacacagagagtagaaggatggataccagaagctgggaagagtagggggatgctggggggcaagtggggatggttaatagctacaaaaaaatagaaaaaatgaataagacctactatgtgataacacagtagaataactataatgaataataactggactatacattttaaaataacttaaagagtgtaattggattgtttgtaactcagaggataaatgcttgagcagatggacaccccattctccatgatgtgcttatttcacatttcatgcctgtataaaaacatctcatgtacaacatatatgcatccactatatacccacaaaaattttttaaattaaaaaataaatagatatttaaaaaacaaacaaacatgcaaacaagcaaacaaataggcaaacaagatcatgccgaatggcttcattttaaatttggatcactactcccaagtaagtttttaatgccggccagtaagcatattaaatttatctagaccttatgttttcccgcttttcttaatgactctttcttactccttaattttcagcatctccattcccatcctcactctcagcttacaatgttgacttctgctctgacttcacagaaagaaatggaaaggtttagaagagaatgtccaaagaatctcaccacctctctccatccacttggtttcatgctctggcaatgtcatctctgcctctggaaataccagcttctctctccttctctactggatccattccaaacagcaaacaacgatgctattatttctttcatcttaaacaaaataaatacagaaccctctcttgagccctcttcatcctccagctacatcacatgcttctgttcttgccacaaaactccttgaaataattatctaaaatcgtgttgccactttcttttctaccatttgtcctgaatcaacccccaatcacttccccaccaccatagttctcaaagtcctcagtgacctccacattggtaaatccaatggttatttctcactcctcacctaacttgatctctcaagagcatttgatacagtggactgctttccctccttgatgtcttttcttttatctctcctgatttgcctcctgcatttctggatggcctttctctgtgtgcttcctcctatccctcttaacaggatgtcatgtgctcagttctcatgcctcttctctctctacctacacttacttactaagtgtctcattcagcctcacggttttaaatactacctatattctgatgactccagacagacacctcccctgaatttcaaaaatatacaaccaattcctatgtgacctctgcacatggatatctgattgtcaagttgaagacatatccaaaaccaaggtcttcgtctcattcccaaaccagcaactcctgcagtcttctgttagtgcttttccatttgtttcttccagttgtccaggcagaaatctgcttgtgatccttgggtcagtgctttctcctatagtcctcatctagtctcttgggaaatccatcaagatgtatccagaaatcaagtgacttctcaggaacccccaggacatcgccctggtcttggccagcaccatggcttccttgaattattgcaagtgtctcctgagtggtctctgtttctactcttgccatcaactgcctcttctcatctcttcaccccgctaaaatgttaaagacacatcgtgaaccatctcagctcacaccttctagtggctccacgtctcctcaaggtaaaagccaaaggcttgactgtgactctcaaggtcatgcaccatctggtccctcatgaatccggggacacacactttgctacccacacactcccctttgcagttcagccaccctttctcccttgccagccccaaactcataccatgtccatggagccttcccaccttctcttgctgctggctgagatgttatcctgataacatccacctgactcacaccttccattccttcgtcctcctgcaaagtcaccatctaagggagcccttcccagacacgttgtgcaaaatgtcaaccccagccctgacactccatactcccttctttgttgatacgtccttcttagtacccatccctatctaacatgctgtatcttctatgtatttattacatctgttacctacctcccacctgagacagtgagccccagaatgacatgcatttttacttgttttgttcactattgtatctcttatgacaaggagttgctttataactatctgttaagtaccaaaggaaatagctgggagaattgagggtagttgctaatgagaaatagaacgggggttgaaagaggactgtttgcattattggctttttagagctacaggtcgagtatcctttacctgaaatgcttgggaccagaagtgtttcagattacggattttgtaatatttgcatacacataatgagatatcttggggatgaggccttgagtgtaaacataaaattcatttatgtttcatagacaccttatatgcagagcctgaagttaatttcatttttcccttgcgggactctggatacaccacatgttgagtggctgtattttgactgtgactcctcccaggaggtcagatgtggagttttataattgtgatgtcattttgtccttcaaaaagctttggaacatttcaaattttggatttgaggattagggatattcaacctatatttgcatttcttaaaaaaacaatgcgttatttaaatatgaactagagctatgcaatgtgcctgaatatccttgttgttctttgtaagcatttgggcattatactcatttggcccaattattgggatttggctatgcgcatctcagatgccagaatgctcgtgggaagacgagctgctgttatgtgtgagcatgagaccagctggtaaacatgatgcccaaggagaactaaggtgcacatcttgccttaaaataaatacaatttaaggccgggcatggtggctcacgcctgtaaccccagcactttgggaggccaaggcaggcagatcacttgaaatcaggagttcaagaacagccaggccaacatagcaaaaccttgtctctactaaaaatacaaaaattagctgggtgtggtggtgcacgcctgtggtcccagctattcaggaggctgaggcaggagaatcgcctgaacctgggaggtggaggttgcagtgaggattcttctctttctctcatattttgatctgccataagccagggataacatttcttcatttgtgtcttccctcttcaaagcctgtttaagcaacaggtctctccctgtgccccattcagtcagatgtctcatgattaggcagatgctgagaactgtatctgcagtgacagggtttggtttttgagcaaaaggaatgggcagcaggaacatcagtggatcctcatgcttcaaggtccctggtgttaatggaaaaaccaactctgaaaaatattttaaagaagcctactctgagccaatagcagtgaccacagcccaggaaaaacacaaacccacgaagccttcagcaagtggtcccgaggcagtcggattataatttggttttacacattttaagaagacagaagttacaggcaaagacataaatcaatacatgggaggaggtgtacattggtttagtccataaaggtgggatatcttgaaatgggagcttataggtttataggtgaattcagagatgctttaatttgcagctgggtaaagcagtaaggctctgtctaaaacctggagtgagcagaaagggatgttttctgttaagataaggatgctgtgtagcaagattgatgatggcctgtaggggtgacttaactcttgcccagcacagccttaggtcctgttgataatttggtatcttattgccacaaagagtctgttttgtcagtcttatgatctgtattttaacatgaatgctggtcacttgtgcctaagccccaaaagggagaggatataaggtgtgtctgatcccccatcacatcatggccgggaactcagtttttcaggtttctctgggatccccttggccaagacagggtccattcagttggtgggggacttaggattctatttttagttgacactgggtagggtcctgcataggacaccatgctcttttccaagatggtactgtgcgttaagacaaagaaagtgctcttgagaaagccctgccagaggaagccctcacgaattccgcacccgtagctgcctctcagccttctgctgacagtcagacaggagtgtactgtggaattagagcacctaaaaatacagctgaataaacacacaatgcaaaacacaaaggaggcacgaattgtggatacacttaaatgggaacagcaaaacttaaattagaggtctgaaaagcgtgctcttttcttggaaggcgctgttctcctttttctaatgatgctaattccatgaacactgaatgtaaccctttaaaagagaaaaatgaggcagctccgcactaattcagtttaattaatgccatcctgttctttagtctacaaacagttattgaaattgcaagatagctatatctgtccttccttaactgctctctgttcttttacaaaaccattttattgtgcattcagagctaccaaaaataaaactaggattgttccaatagcatttccatgcttcctatagaatgagctcacattaccacttactcttgaggagtctaccagtgagcttgatttgctttggataaatgaatcctccatcatttttttaagtgactggcaccctggtttttttgtttgtttgtcttttccacaaatgttcttagccatgacctctaatggacacaaggagacaattcctttttttttttttttttttttttgagactgtgtctcactctgtcccccaggctggagtgcagtggcacaatcacgggtcactacagcctcaaactcctaggctcaagcaatcctcctgcgtcagcctcctgagtagctggaactatgggtgtgtgccaccacacctggctaatttttttttttgaatttttattagagatgatgtcctaatatgttacccaggctggtctcgaattcctgagctcaagcgatcctcccaccttggcctcccaaagtgctgggattataggcatgagccatggtgcctggccaagaagacaattctttatagtgcctccagctctaaaaagttaaaattactatgctataggcatagaatgagacatctacaaaaagctaccccgtgtttttaattaggtgtttagtgaatcactttgaaaattctgggaagtaatttcctctcctttaaagaaaagaacattcttatattccttatcagataacgatgctgttgaaagtggatacacttatagctgggatcctcagttgtcccagtgctaagatgcctatgcagacatcaactcagttcacatcagctctaactgcatctcactttgtgggcacctgcagaccagttcttctcaggtgctgtgcccatagcacagagagcttcttgggatgtgtagggagccttagcccctaaaggttcactgaaaaatcaccgacatgaggcagactgattaagaggagaaaaggcatacagattaatttaacgcatatacacaggagccttcagaatgaaggcccaactccccaatcaggtctagaagcttatataccatctgaggttacagaaagaatggcgacttggatcctggtgaaacaggtggtgggctgggggagaagagaattctatggaggggattactagagggaaggaatggatcaggaacagagattaacttgtaaagagttctctttggaagttaaatgatccttagagacactcatcattcttggaaaaggcaggtgtggtcttctcttttttttttttttttgagacagactgtcatccaggctggagtgcagtggcatgatttcggctcacttcaagtgattctcctgcctcagcctcccaagtggctgggattacaggtgcacaccactaggcgagcttattttgtgtttttagtagagatggggttttaccatgttgatcagggtgatcttgaactcctggcctcaagtgatccaccaccccggcctcccaaagtgctgggattacaggtgtgaatcaccgcacctggccacatcttggtcttcttttctgttatagacaatgagataatttggagggaaagaaaaaaaccactgttctccttggtgggtctggattttaggcagataaaggaacttcagtttcaatgggagagacaggggtttggggaggacatcagagagaccttgaggcttcttcagctcagcgtgtccaaacgccagattttgggcttttggtttctgagctctaacagtaggaatagcttgtgaaatctccttgagatcttatgtttcatttttgaaaattcaaatatttgtcattccactttataatcacatcccaatattgggtataatataaaattaaaattataaattacaatcaagtggacaccttcaaaatgatgtactataaatgacttagcacttcctaatattgacacttcaaaaaacagaggccgaggagggtgaattgcttgagctcaggagttcgagaccagcctgggtaacatggtgagacccggtctctaccaataaaacaaaaaaaattagccgggtgtggtgttgcatgcctctggtcccagctactagtgaggctgaggtaggaggatctcttgagccggggaggcggaggttgcagtaagcccagatcgtgccaccactgcactccagcctgggtgaaagagcaagaccctgtctcaagaaacaaacaaacaaaacccagagccatagttatcctatcactttgtgtgctctggaacactctgacgtatgttagggacctcagtttgcaaagcatggtcctagaaaaacatgatcagatgtacatagttattcctgttcattggtatcaatcatgtacagcacacgccagaaacgagaaggcaataccacattacacaggagctactttctactagatttccagattcagcaaataaaaatatgagatacgcagttaaatttgaatgtcagataaacaactgtcaatgaaaagagtcaaactctgtaaaatatttgaaaagatttattctgagctaaatgtgagtgaccaatggctgtgacacagccctcagtagatcctgagaacaaggcccaaggtggcctggctacaattaggttttatacatttagggaaacataaggcatcagtcaatacaagatgaacattggctcggtccaaaaagatgggacaaccggaagcaagggcttccaggtcacaggtggttttaaagattttctggttagcaactggttgaaagagttattgtctaaagacctggaatcaatagtaaggaatgcctgggttatgacaaggggttgtggagaccaaggttttctcattcagagagaatagattgtaaatgtttcttatcagacataaggagccaattctattggtaattccaaaagggaggagggaatcttgatgcacatccagctccccttttctgtcagggccggaactagtttttcaggttaacttcggaatgcccttggtcaagagaaggggtccattcagatggctgagggggcttagaattttatttttggcttacacaacaaataatattttattatacacatgccccatatttacgtgatattcaaatttaactgggtgccctgtgttttgtctagaaactctatgactcttagggcttttcctgcccccagtcctgtctcaatcctctttcctttgatgtgatggggcttatcctttcatatgatagggctgtgttactgagaattcactgcattactaaacatctccttctgcaccaggccatggttaagaagagaattttgtggtaccccaagagtatagaggaggtggtggaagcagcacaggtgcaggtggttgaaaaataggataggactttccagggtcttccaggatgaaggtgatcctaggctacctgagagaagacaaagacaaggtgggggggtgttgctttgtcagtggtgtttgaaccagagtgactccaccttgaacaagggctgggtaaaatgaggttgagacctgctgggctgcactcccaggaggttaggcattcttagccaaaggatgagacaggaggtcagcaggactggtgtcaccagagacagatcataaagaccctactgataagacaggatgcagtaaagaagctggtcaaatccaccaaaaccaagatagtgacaaaagtgacctctggctgtcctcgctgctcattatatgctaattcaaatgcattagttgctaaaagacactcccaccagcaccatgacaatttacaaatgccttggcaacgtcctgcagttaccccatatggtctaaaagcgggaggaactctcagttctgggaaaaccccacccccttcccagaaaactcatgaataatccacccctcattcagcaatgatcaagaaataaccataaaaatagccaaccagcagcccatggggctgctctgcctatggagtagccattcttttgttcctttctttcttaataaacttgctttcactctactctgcagactcacccccagttctttctcgtgtgagatttaagaaccttctcttggggtctgaattgggagccctctccagtgacaattcctttagatcaaggtctgagctctaaatctcctgaccttgctttcttgtttgtttctcctggaacttctggtcactcctgcctcaagtttcttaacaaaatagagggcacccagttaaatttgaatgtcaaaaaaagtgttgcatccttatacaaaaaaaaaaaaaaagtttgttgttgtttacctgacattcaaatttaactgtgtaccctatatttttattcgggtgtgtgatgcttggccgctgcagttatcctgtgacctgaaggatagaagtcatgttccaaactcaatagtagtcccaagaaagagaaaggttctggttccattcctcaaatgtcttgtgcctctcacacacgttccatctctgcattgattggaattattattagcgccaggacctgggtgtcattgtttattgatttggaagattcttgtgttcctggtttatataactgaatggatggtggtcttggtcacagcaacagagaatgctcaaaaaagagccagacttggaatgtcatcaatttcattaaatattttttaacttttttatagagacgaggtctcgctatgttgcccaggctggtctcaaactcctggcctcaagcagtccttctgccttgcccttctaaagcactgggattataggaacaagccaccgtgaccagctttgcattatatttaaaagcaaaagcgtctaacacgaaggaaataattaggtagatttgttctactccataggagggaagtgtatgtagccaataaaataattgcatttgctatttctgtgtccgttcctaattgctgcagagccagccagtcagtataaatcagaaaatttaaggagcagcgctcctgtgtgggaatcttgaaactcaaagaagctcagctgaaagggaaggattccatgaacccttgcacctgtggacaggacccagacgacatccagactgcagtaccgggaggacgcaatcccaagataaaaaagatcagtcatgtcccttttcggttcttccctactctatctatagtcttagctgcagagagtaggttaaaaaaacaaacaaacaacaacaacaaaagacttcactatttaaaaaacctctctaatgaggttttgaaatgctaacttaaagatgtttaactcttttgctgcttcacacccaaatgcttttaaatcagtaaaaattaattcatcccttatctcaggaaatatcttatgcaagtagcttctttaattaaatacttataaataaacgcacaaatatgtgtgtgtgtttatgtgtgcaccatacataagttaagttcgtaaggcaaacttacaaaaccctgcctgtctttggtattgggcttggcaactgctttttaacacagttaaaaagccgagcgttcctggcaggcagatgacttgatatggagcagacagaggtgggcttacctgtgctccgtcatctgttacaatcaagcgtctgtcggatgatggattgttcttgccgggagggcttctcctcccatgattaaacgtgtgaggcgcgtgtttcagcagttcctaatcgtacaggtggaagcacacagattttcccttttctggcccctttttgaaagtgcatagctcatccattgtgcttggtaacccccatgtcttcatccttaaagaatccagtagccatagaggtggtggaggagccatgatggccgaacaggaacagctccggtctacagctcccagcgtgagcgacgcagaagacggtgatttctgcatttccatctgaggtaccgggttcatctcactagggagcgccagacagtgggcgcaggtcagtgggtgcgcgcaccgtgcgcgagccgaagcagggcgaggcattgcctcacttgggaagcgcaaggggtcagggagttccctttccaggtcaaagaaaggggtgacggacgcacctggaaaatcgggtcactcccacccgaatactgcgcttttcagacgggcttaaaaaacggcgcaccacgagattatatcccacacctggctcggagggtcctacgcccacggagtctcgctgattgctggcacagcagtctgagatcaaactgcaaggcggcaacgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaaatgtccctgtctggcagctttgaagagagcagtggttctcccagcacgcagctggagatctgagaacacgcagactgcctcctcaagtgggtccctgacccctgacccctgacccctgacccctgagcagcctaactgggaggcaccccccagtaggggcagactgacacttcacatggccgggtactcctctgagacaaaacttccagaggaatgatcagacagcagcattcgcggctcacgaaaaaccgctgttctgcaaacaccgctgcggatacccaggcaaacaggtctggagtggacctctagcaaactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacacaaaaactggaaactctaaaaagcagagcgcctctcctccaaaggaacgcagttcctcaccagcaatggaacaaagctggatggagaatgactttgacgagctgagagaagaaggcttcagacaatcaaattactctgagctacgggaggacattcaaaccaaaggcaaagaagttgaaaattttgaaaaaaatttagaagaatgcataactagaataaccaatacagagaagtgcttaaaggagctgatggagctgaaaaccaaggctcgagaactaggtgaagaatgcagaagccccaggagccgatgcgatcaactgcaagaaagggtatcagtgatggaagatgaaatgaatgaaatgaagcgagaagggaagtttagagaaaaaacaataaaaagaaatgagcaaagcctccaagaaatatgggactatgtgaaaagaccaaatctacgtctgattggtgtacctgaaagtgacggggagaatggaaccaagttggaaaacactctgcagggtattatccaggagaacttccccaatctagcaaggcaggccaacgttcagattcaggaaatacagagaacgccacaaagatactcctcaagaagagcaaatccaagacacataattgtcagattcaccaaagttgaaatgaaggaaaaaatgttaagggcagccagagagaaaggttgggttacccacaaagggaagcccatcagactaacagcggatctctcagcagaaaccctacaagccagaagagagtgggggccaatattcaacattcttaaagaaaagaattttcaacccagaatttcatatccagccaaactaagcttcataagcgaaggagaaataaaatactttacagaaaagcaaatgctgagagattttgtcaccaccaggcctgccctaaaagagctcctgaaggaagtgctaaacatggaaaggaacaaccggtaccagccgctgcaaaatcatgccaaaatgtaaagaccatcgagactaggaagaaattgcatcgactaacgagcaaaataaccagctaacatcataatgacaggatcaaattcacacataacactattaactttaaatgtaaatggactaaatgctccaattaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgatgaaacagactttaaaccaacaaagatcaaaagagacaaagaaggccattacataatggtaaagggatcaattcaacaagaagagctaactatcctaaatatatatgcacccaatacaggagcaccaagattcataaagcaagtcctgagtgacctacaaagagacttagactcccacacattaataatgggagactttaacaccccactgtcaacattagacaaatcaacgagacagaaagtcaacaaggatacccaggaattgaactcagctctgcaccaagcggacctaatagacatctacagaactctccaccccaaatcaacagaatatacatttttttaagcaccacaccacacctattccaaaattgaccacatagctggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagatgcaataaaaaatgataaaggggatatcaccaccgatcccacagaaatacaaactaccatcagagaatactacaaacacctctacgcaaataaactagaaaatctagaagaaatggataaattcctcgacacatacactctcccaagactaaaccaggaagaagttgaatctctgaatagaccaataacaggatctgaaattgtggcaataatcaatagattaccaaccaaaaagagtccaggaccaggtggattcacagccgaattctaccagaggtacaaggaggaactgataccattccttctgaaactattccaatcaatagaaaaagagggaatcctccctaactctttttatgaggccagcatcattctgataccaaagccaggcagagacacaacaaaaaaagagaattttagaccaatatccttgatgaacattgatgcaaaaatcctcaataaaatactggcaaaacgaatccagcagcacatcaaaaagcttattcaccatgatcaagtgggcttcatccctgggatgcaaggctggttcaatatacgcaaatcaataaatgtaatccagcatataaacagagccaaagacaaaaaccacacgattatctcaatagatgcagaaaaagcctttgacaaaattcaacaacccttcatgctaaaaactctcaataaattaggtattgatgggatgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatactccaacaacagacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgagtaggaagaatcaatatcgtgaaaatggccatactgcccaaggtaatctacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaaactgagaaaaacaagcaatggggaaaggattccctatttagtaaatggtgctgggaaaactggctagccatatgtagaaagctgaaactggatcccttccttacaccttatacaaaaatcaattcaagatggattaaagacttaaacattagacctaaaaccataaaaaccctagaagaaaacctaggcattaccatccaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcatcatcactggccatcaaagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatccagaactggaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgttgtggggtcgggggaggggggagggatagcatcgggagatatacctaatgctagatgacgagttagtgggtgcagcacaccagcatggcacatgtatacatatgtaactaacctgcacaatgtgcacatgtaccctagaacttaaattaaaaaaaaaaaaatccagtagctgggaggattaaagtgaggactaaatctcacgaaagagaacaaactgcctatttttggtcaggagtcgcatgaattatgccaatttaagaaccacctgcctaaagcacatttttttctttttcttttctttctttcttttttttttttttttttgcaatactagcctggcagaagctaagaggtatgaaggcgaacatgacacctttatgcaaatgtcacattttactttcaaattcctaagcacaattatccattatgtcccagataattggtaataacttaaaaaagcagataatggataagtattctggtggactaattataatgtatgccaaaaattatctttttacaaactcattctcaactctttggttcttttgatttatgcaaaccacggctttttatctctaggtttcattcctcattttaagagatctggtgaaaacttttacctttaaggaagtggaggaaatccaattgcttttccagctagacaagatagatttttatctttatcaacagtcttgaaaaagtgtggaaggaaaatatgttactatctgtgagaatccttaaaggagtcagaaaaaccataaaaccatagcattagataaagtaatatattattttagatttattatttattagatttattattcatctatttaataattatttaatatctatattaatattgtaaatataatatttaatgctatattaatattattaatatatattattaatattattaatctatttaatctataatagatacattattttgtgattccttaaagtcatcacaaaaaccatggcattagatgaaataatctattattttaatagacatttcccagtgcttataaaaaagacatatttattattacaactcggaaatcttattccatgaaaaaaactcaagaattctgaggccaggtgcagtggctcatgcttgtaattccagcactttggtaggccaaagctggaggatcacttgagcccaggagtttgagaccagcctggggcaacatggtgaaaccctgtctctacaaaaaatacaaaaaattaggtgggcatggtggtctgcacctgtagttccagctatgagggaggatcatagctcatatgatcgctcaagcccaggagggtcaaggcctgcactccagcctgggtgacagagcaagactctgtctcaaaaaaaaaaaagaaaagaaaagaaaaagaagagaaaagaaaaaagaattctggatattctggatagctgttaaagaaggaatcccataaatatcttttcaaaatgaaaaggcttgcatatgatcatttgtgtttggtatcattatttctgttggcatcattccttctatacagttgtgttaactgaaatcaagaagtgaaagacattctgagacagatataagggtactgtcctggaatactgagactataacctttagcctctcctctgtaaaataagaatcttcaaaactctttttaggggtcagcttcattcatagcttatactaggggatagccaactatggcccattggccaagcctggccctctgcctgtctttgcaaataaagttttattggaacacagccacagacattgcttacatattgcacatggcttttttcacactacaatgacggaattgagaagtggcgacaaggaccatatggctcacaaagagaaaattatttaatttctggacacttagagaaaacactgcctgacccctagtttgaggcaattacaggtgttgatgggaatcagcaacatcaggccagagtgaatgaagttgttctgcttcatcactaggcaaaattacagccagcaattagaagcactcactccagcttaccaaaattcagagtgattttcatgttgcagctgttcttgaagatagcgaagttggaggcctgactagaactccagactttggccctgtaattcatcactcttttactcctcacccactgattaagaactatgatggagtacctgctgggagccatcttccttgcaggattaggaaacagagacacgagagtaacaagtccctgccctcctaaggaccattgtttacaaactatctgggtgctcttgtttacaaacttccactcccatgtccctgcacaccactgttgactcctaagtgcagtggagccccaagtacaaagtgtgtcttttagaaacatgaaaatctgcaaaaaacagatatttagatatgtatttcaattttcactgagtgataagatcaatttcagagttggcaaaaactgacaaaaaccttatatattattttaaagcaattttatgacaaggccaagcccaagtgaagcaaacaatatcttgttgcaatggccctccctctttcccattttcttcccaaacttacaaacattgggtggtgacatagcatagatgttataatgctacaatagagtgtagtacagtattccttctgcaatccacttaatcaatggataaatgttgattgtgtatctactatgtacctaatgtgacatggtcagtggagatttttattgtaagagttgacctcttaagggaaggaaattccaatctcctcaccccatgctgactcaacctctaaaaaaataaagactagtcaagttcaaggatgataatttatttccagtttcttttttctttttcttttctgtctttttttttttttttttttgacaaggtcttgctctgtcacccaggctggagtgcagtgacacaattatagctcactgcagcctctacctcttgggctcaagctatcctcctgcctcagttgggaccacaggtgcacactaccatgcccggctaattttttaactttttgtagagacaaggtctcattttgtttcccaggctggtcttgaactcttcaggtcaagcaatcctcccaccttggcctcccaaagtgctgggattataggtgtgagccaccatgcctggcctggtttctattttctaaggttgagtcatcttgtggaaaataagaacaaaacttgggatttttttttccagctttattgaggcataaataacaaagtaaaaatgctgtatttatttaaggtatacatgtgatgtttgatatatgtatacattgtgaaataattaccacgatcaagctaattaatatatccatcaattcatgtacttactgcttttctgtgtgtatgagaaaaattaagatctactctctagaaagaaataatcttttttcagcaacatggatggaaatgcaggtcattatcttacgtgaaacaactcagaaacagaaagtcaaatactgcatgttctcccttatataagtgggaactaaacaagggctacacatgggcacagaatgtggaataatagacactggagactccaaaaggcaggaggagggaggcgaggggagggttaaaaaattacctattgggtaccatgtttactattctggcaatagatacactaaaagcccagaattcaccactacacaatatacgcatgtaagaaatctgcacttttacccactatatctataaaaatgttaaaaattaatattaaaaataaaacaaagttctactctcttagcaaatttcaaatatattgtccaatgttgtaatactgaattattctaatactgaattatatatttgaaaactttaatatttaaaagtaacaatttgctacatttacaagaaatgaaactagggaccaccacaggccctagtttcctacaatcttaagatgacagacttcctttacgtaatctgagacctatcagagaactggctgtccagatagggaaggataagttgctctttctgcatttgctgcttcttaattgccttcaggtcaaaataattcttagggccaaatggtgtattttggggtggtgtattctaataccttttaggtaccctaaggatgaatagtgtcccctaaaaagtgatatccacttggaatctcagaaagtgaacttatttgaaagcaggctttttgcagatctcatgagtcaaggatctcaagatgcaatcatcctggagttagagtcagccctaaatccagtaagtggtgtcttcataagaagtggggaagacacagagaaacacacacagggaagacagccacatgaagatgggggcagatattggcgtggtgtagccccaagccaaggagccaaggatggggccaccttggccacagctggaagaggcaaggtaacactccttcttagagcctttagagggaccgtggtcctgctgacaagagtgacttttggacacatggccttctaaactgtgagagaataaatttccattgttgtaagccacctagtttgcagtactttgcttcagcagccaaatgaaaccgatgcacccaaagaaacatctcatcaaccccctttagtaatcacctgccacatttatctctgtgcatggtgaaagtccttacccagtgcctcagaactatgatgtacaatgtaggaattctggaggccttaacataagcaggacaccatgaggggccttctatggcacgtacaattcaagactttcacgtatatttccaagttatgctaccaactacacatccccagagagccctcatcactagtacttctaaaatatttaatagaataatagaacatttcttcctttgccaattaacatttcagcagttactttaatatctaaaatattttaaaggtttctttcatctcggtagaaattctttgcagccagggagctgtgactcaaagatgtattttagctcagaagcaaagccattccatttattatcccagatttttcgttaatttgaatttttgttattatggttcagaaatttggaattgaatggaaattttgctcccacacttgatccagtgtgagatgttgaaaaagtaggcaatatttaccctaaatacaagacatttaggcagatatattgggaataaaaccctgacattctagaaaatgatgtttttattaataccagaaatattccggtaggtgttatctgtactcacaatatctaatactcaagagtatgatgttggcatttcaccagtaaagaaaagctgcttttctgctttcctcctaaatggtgctgcatttccaacacttcacaaagcattgaacacactgccactggaggcagccatgaatattttattccctctcaataaaacagttaaacacatccattctctgccgttcaaggatttgtaacctaaggccatggctgcacaattttaaatgaacagagttagaaaaaaaaattaaaaagaaagaagtccaaatttcattccttccatttggtcatttttgtggagccaactatctaagatctacgcacaaaagaatacgtggaattacatggtttggctgagtccccacccaaatctcctcttgaactgtagtccccatgtgttgtgggagggacctggtgggaggtgattggatcatgggggtggtttcccccatgctgttctcatgatagtgagtgagttctcacgagatctgatgattttataaatggcactttcccctggggttctctctctctcctgccaccttgtgaagaagttgcttgcttcctctttgccttctgccatgattgtaagttttctgaggcctccccagccatgcagaactgtgagtcaattacacctctttcctttataaattgcccagtctcgggcagtatctttacagcagtgtgaaaatgaactaatacatggaatgattccacattatttgaaaaacatgctatatatattgagagtgagatacatcagggacccctcttaggggcccaccccccacccatcccctgttcccaagcatggaaataaggcaaaatctagagttccttcaagggaaattccaggcacctagctggccctgagaagtaacagagcaacttgataagccagaagggaatagtagcctaaaacaatagccaaggaagctcatagccaagagttgtttgggtccctatagaaacaaaagataatatcttagcatatgttcctgagttgtttttcagaagcctggatccctgaaaaaatggatccactggcatgtagacctcagacaaggggcaactgaggactgagctccgactgcaactctttgttctaaatttcttcctgaggggcctagaggaagtcatgcccatggaccagagctcagcattcctttctgctgatcccaaatttttagacaaaactttccctccttatccgatcacaaatcagagaaactttgaatccacctatgacctgtaggccactcccctgaaatcgagatgtctcaccttttttaggtaaaaccgacgtatggcctccatgtattaacttatggctttgcctgtaacctctgcctccctgccttttaaaacctccacctgcaagccatcagggaggtcaggtcttaagcctgagctgcttgattctccttgcttgctgccctcaataaatacttcacttcctcttactgcaatcctgatgtcagtgtttggctttggggtaccgggtgagtggaccctagttcggtttgatgtcaacagtgtgttgtatgtggaaggatccagaagctcctagacccaacttggttacatcagcaagccacaaagttgaaggagagacttagaagaagcctgggaatcaggaggcagtgatttccaatgtgcacaaacatacctgtgttttttccccttttttgtcattaaaaacaaatatttagatgtttttctgtatatgctttaaaatctaatatgtttgtattttgtctgtctttaaactatagctacttggaaatattaatgaaaaagtggccaaggaaggtaaggcaaccattgatgaataaaatctaaatggtcaatatacacaaagaaatcaaagaaatgtttattaaaaagatgaaattactccttttcaatttatgaaaattgcaagaatgtttttaagagggttcccaagagttttcaggaaagcaccagtatggggacttctacaccttgcagaaaaatgcataaattgaaaaaaaagaaacacagaaaaaaaagcaaatcataaagttgtgcacacacttggactcggaaactcaaactttgggaattcagcctgaagagataaacatgaatatcgtaaactaaaaataaaattctaagccccacaactgacttaatgaaacatctcttagccaaagggaccccagaataaccttgaaaactgaaggccacgacgagacggggtgtcagacacacctcgttataccccatccctcgctaaccaccattagacttgcttccctaagggttaaatagaaaccagccctttccaaagactccactgctgatatcaaccaaccgcccgatgctgcccctaccctttgtgatttcagcacagcaaccaaccagtatttcttcctgataagagaccctgaccatggagtggttctggctcgtctatggagaatgtgcaatgagggtgttagtgtcttctgcttcaccttctgacatcagaaggctgagaactcaatcctgggatcatgctaacatcaccattccttgtacatgggacacatgaaggggcatgaagctccactgcaaatacacacgtttcttctttcatgaatatctgtgatgcctcttatagcttattgaatacgtatattcaaccaccctgctcagcataaattcctgttccctttgcccctccctcgaagtgtctgtttctgtcttctggccacaggctacatttcccagtctgtcagaacagccaccctacaggctacaaccctttataagaaataaagctcttctttccaaatttatgtaccttgttttcttcagttgacaatataaggaatgatttagctacaaggttgttttagcagaactgacaacaactttattgcccaatactgggacaggggaggcaaaatgtggaaagctctcaaatggagtaatgtgtacccaaaaccaatgatctcaaagaattatgtgtattatacagaaagacgtgaatcatatctgaaatgtaaaaaaaaatcacaaagcagcgattacataatgatcctgtcttatggaaaaacattaaaagttttgctacactgaataaagtatggaaggtcacacaaacatatatgaaacatgaatcattccagtggtgggtttgttgttagtcttcacagtgttctttatgcttataggtattttctaggtgtaaagtaaacatggattaatttgatgctttgaaaaagaaaagctgttttaaaagttgaattctatattgtctgtttttttttgtttgtttttctgtttgtttgtttttttttttttaattgagacagggtctcactctattgcccaggctggagtgcagtggtgccatcttggctcactgcaacctccgcctcctgggttcgagtgattcgcctgcctcagcatcccgagtagttaagactacaggcacgcaccaccacgccctgctgatttttttgtatttttgtagagatgcggtttcaccatgttggccaggctagtcttgaactcctgacctcaagtggaactcaggtgatccatccacctcggccccccaaagtgctgggattacaggcatgagtcactgcacccggctgaaagttgcattatatattgtcttggtctcaacaaatacacaaaaatggcatagttgaggagggtgcaactacaaatggcagttgggaatgaacagattcatagattgcttacattttatcactaaggtggacccaaaagttattaattgaagtagtaaccacatcaaatgtgctttaaaaaatattaagctgtatgaggctgggtgtagtggcttacgcctgtaatcccaacgctttgagaggccaaggcaggaggattccttgaggctaggaattcaagaccagctgggcaacatagtgagaacccatctctacaacaaatttaaaaattagccaggtatggtggcacattcctgtggtcccagctacatgcaaggctgaagtgggaggatcagttgagctcaggagttcaaggttacagtgcactgtgatcacaccagacgtagtgagaccctgtctcaaaaataaataaataaataaataaataaataaataaataaataaaaataaagctgtttgaattgcacataaatcccatgaaaattatataccatatcattcataatttgacagtggttaaagttatagacagatgctaaaatttgagcaattccatttgtcctttaaacagaacaagcatctaaccacaatattgtcctttgggctttcaaatgatactatctttcacagccagcctcttaaaaggaaaaacaaaaaggaggaatattagacatctaacatgattccctgcccttcctgcctccatgacttgtggctgcagataaaacaaacgaagaagttttagatagagtgaggcccattctcctagtacacaaaagcactatttttatattgactcaggagagaactcacctaaaattattctttggttctgacagctatttgcaggctttagaaaaggggaggaaaggagtgcctttctcaatcactctttaaataagtgcccttgggtgaaaccgacaccttgtcttctacgttactcctttgagactctcagagcatgcagaggctgagagattgagacactgcccttccagcccctcagtcagactcctaaataccaactctggtctcttttgctcgcttcccattttatcagtgggggcaactgatatttcatgtttcttatttgagaacagagctttttaaacattaatgtgcacacatatccactggggagttttgttaaaattgtagattctaattcagcagagctggggtggggtccaatggtccacatttccaacaagctcccaggtgaagcccacgctattggtcccagactgtgcctgaatattaaggttttagatgatgctaaagaaaacaagaatattttcttgtacatgatcattttccatagtttgcatatcgtgtgttcagctcaaggcagtgttgtggatcattttccatcccagaatgtggattgggtcattccaacacaatgaatgtctctgaaatggataaaacagtaaagacatggatgttccagggtttttcaatctagcgtctgtggagcataagggaactgtccacttccatggaaatttaaacaactaggctggtatcatgctcagcgaggaggcagaactggaatataatttaaggacagtggtgatgagctgtgttcgcaatgggggcacatgatgttggtgtttcctaagccaatcctttgccattgcacagaagtcagagatggtgacacattaggtcaacccatggcaccatgatatatcagaacagaaacataaatcatattactgaaatcatatatctggagttgggtggtccttgacatatacatacactatatcaacaacccagaaagaaggcggtctcttcatccgagtggcctgagacaaatggcatgcagaatttgttgtccttgctttccatgagaagtccactcccactaagtactttgagatttgttatgaaaactttattaaatgtatcacaagtgagatggaggggtttgactcagtcctccagatctttatcaccttgtgtgcttttcactatcttcttgctcctattctccctcctccttatccttttcctccttggatgatctgtatctttccagtgaagcacagcccttaaacccatatacaccactaaactccatgctccataaaaccaaagggtctgcttttctttaagagactattcagcaaccatgtattgttcctcttgtacatcagttaaggctcatctctcacccccaactgctaattgcttaatctttctgcagataactctattaaataaaatgttctttctttttctgtttataaatattgcttttcattacccttatgttaaatgttaatgtcaaaactccctgtattaattgtctactgctgaaaaacaaattacatccaaattttatctttttaacacaacacacatgtattatggtttctctgggtcaggaatccgggcacagcttagcccactaagtatcttcttctggatcattcatgaagcagtgatcatggtgccagccagggctgggatctcatatcatccatctgaaggctccattggggaagaatctgcttccaagctaactcacatggctcttgggaggatgtgattccttgtaggctattggcttgaagctaccctcaattcctggccatgtggaaatgggaccttgccctgtctccagtatggctgctcgcttccaatagaaagagtctggtaaaaatgatggagtcaggctgggtgtggcagctcacacctgtaatctcagcactttgggaggttgaggcaggcagatcacttgaggtcaggaatttaagaccagcctggccaacgtggtgaaaccctgtctctactaaaaatacaaaaattagccaggagtggtggtgcatgcctgtagttccagctactcaggaggctgaggcaggagaaccacttgaaccagggaggtggaggctgcaatgagccttgatcatgccactgcactccagcctaggtgacagagcaaagctctgtctcaaaaaaaaaaaaaaaaagatggagtcatagttttataacttaacttatttctcatcagttagtcatttcttttttttttttttttttttttgagacagagtcttgctctgttgcccaggctggaatgcagtggtgtgatctcggctcactgcaagctccacctcccgggttcacgccattctcctgcctcagcctccagagtagctgggactacaggcacccaccaccactcccggctaattttttgtatttttagtgtagacagggtttcaccatgttagccaggatggtcttgatctcctgacctcgtgatccacccacctcggcctcccatagtgctgggattacaggcgtgagccactgcgtctggccatcagttagtcatttctattggttagaagtcatgtttttaaaaatgagattaacatttaaataggtttggatggcagtgtcccgtaaataggtaggcttaggaaagcagatggcccactctactgtgggtggacttcgtccaatcaggtgaaggcccgagtagagcaaaaagactgacctttccttcagtaagagagaactccttctgcctaactagctttgagctgagaccttggttgtgtgttttttttttttcctgccttcagcctcaaactgaaacactggctcttcctgggtctcaagcctgcaggactttggaatgaaacaacatcatcagtgctcctggatccccagcttccaaactcaccctgcagatcttagaactggtcagcctccacaactgcatgaacccatttcttataatgaatctctatctaaatatagatataagtatcatgtatttaaaatctatctcatttatctacatttatctacctatctacccatcatccatccatccatccatccatccatcatatctatctatctatctatctatctatctaatctatctatccatccatccatccatccatccattatatctacccatccatcatatctatctatcgagccatccaacaaaatgctggatattttgttctgtattcttccaataactgataaatccttattctactcaactctttactctagggatcctatggctctagttccatgacatctcaagaggactccagcaccatattttgctcttcatgaaaatatctaccaaaggaatgggaactggagcttctatttatgctatggtcacattccccatggcctctaccagtggagggataatgacacctgaaaccatttagaagatgcctgcatgaagacaacctccccagctcagccaggcataaatgcaatggtggttgatgctcttgagtggaaatggcccatttctacaacttgctgcaaaccgctactgtgcacagtgcctggcttacaactgcagctgatgtgttatagtgctgcagtcggcatgccttccttggttgcagaacactctgaattggctggaactttttcagaatatctattcattagatcctaaatgtttataataaaatgtcaatgccagggatagctaacaatgacaacaaatgcttgttgcccttagtttcttagaggagaagaaagagtttgcagcaccaataacttcatgggaatttgggccctgtgggagaagacacatattaaaactaaaacctgggtagttaatttcactcttgataactgttaaatacaggagctacaactgaagtcatcccagaatattcctggatcactattttatttagggactcaataagctcatctccaatcctgctatatggaaacacccattattgagaaaatggaatatcacagaaagtaagtgttcaatgggcattacatatatttgtacagtccacagtggattaggaacaattttcttttccttgactcttttctcctttggtagtaatttttttagagtaaaatttctattttgaaataattttaaatgtacagaaaagttatgaagatagtacagagattccccatatatcttagcttcccctaatgttaacatcttacacaaccaaagcacattcgtcaaaactatgaaaccatcattgttacagaactactaactgcattacaggctgtattaggatttccacagtttttccaataatgatcttttctattctaggattcaatccaggacactgttacaattagtcaccattagtttcctctatactgtaagagtttctcagaattccttgttttgtgtgaccttgatattgctgtggtctgaatatgttctcccaacattcacatgttgaaacatagttgccagtgtggtggtattaggaggtgagatatttgggaggtgattagatcatgagggtggagccctcatgaatgggattaatgatcttataaaagaggtggtaaggagctgttccccccttttgcccttccaccatgtgaggacacagcaagaaggcaccatttatgaaccaggaggtgagccttcaccagacacagactctgtcatgtcttgatcttggacttcccagcctccagaactgtgaacaacaaatgtcggttgtttataaattacacagtctaaggtattttgttatagcagcacacatggactaagacatattttgtcttagtccctctatcttggtttgtctgatattttctgatgattaaactagagttataggttttggggaagaagatcttagcagtgaggagcacttttcatcatatcatattaggggttcacatgatttatcattatgatgttagccatgatcacctggtaaagacagtgtctgtgaagttttcccactgttagttactccttgtttagttttgaccatgaaatttaaaagaaatgttaatttaaaaatatctggtgttatatttatatcttacttcaattgagtttattttttctgttttcaatttatttctaattcaattccatctttgttcttttctttcgtctagaaaaaaaattaaacatcacatttttcatagaactctcctgcttaaacctggaggctgttcatggttgggataaaagaaaacccatattttgagcatctcaaaaggtatgagggagtctaataaatattttatatacatttcctacttacatttcataagaaatgtaagttaaatattaatacaccactttttttttcaaatgaagaaaccaatttcctgaggccatagggaaagagaggaagtcataaaataggtaggatagaacccagattgtttagccagaggttcaagatcaaccataaacttttcaaatttgattcctggagttctactgcacggacacactcctacagaaatgccagggtctgtgccctgcagcaagaacattccctaagcagcagtgcattgaacattcacccctatagcccccattctccaagttgcttctccaaatgtcacttatcctccaagcctggctgaagcccacctcctccagaaagctcttgttgatcactatgcccttgatatggttttgctgtgtccccacccagatctcatcttgaattgtagttcccataatccccacttgtcatgggagggacctggtgggaggtaattgaatcatgagggtggttatctccatgcttttctcaatgatagtgagtgagtcctcacgagatccgatggttttatacccacttccctttcccacttcccacttccctttgctctgcgcttctccttgctgctgccatgtgaaggatgtgttttcttccccttctaccatgagtgtaagtttcctgaggcatccccagccctgtgcaactgtgagtcaatgaaacctttttcctatataaattacccagtctcggtatgtctttattagtagggtgagaatggactaatacagccctcaacaactgttccttttacactgaacacattgtttcttacattctttggcacttgataatattctgggctcctttgtttcccagtttgttaaacagggtcagtccatgcatgtgccatactgtagaggggatgaactttccagtcctgattgacagtgctgtgctagaaacccccaggagagctctccagcatcctggctggaaccatgcactgcatccttctcaccacatactggctcctctcggcttttacccctcttgtggtcactctcatatagatggctccgtgtcagtccgtgtcagccaactgcaaggttagaggggcagtcctccaggctggcttgcttctcacaatcactccaatttcaagtaggttcacaaaactaccctgttttaataatttgctaaaaggactcacaggagtcactgaaaggtgttatgcatatggttatggttcattacagctaaaggagacagatttaagtcagcccaggtaaaaggcatacagaaaagagtctggaaaagttgcaaatattgagcttccagatgtcctgtccctgtggagtcatgggcagtgttgctttccctgcattgctatgtgacagtatgcatggagtatgtccaacctggaaaggccacctgagaattgagtccagagatttcactggggctctatcacacgggtattgatgattgcccatggggcagatctccatctccagcccctcaggaggtcaagctgatgctgcatgggtcaaagaccctgcccccctacattccactgataagactctggcatgaccagcctcctacctgacatcacattactaaactatgcagtgacccaaggctatcaggcagtcaatcctaccaggcttgacattccaagggctttgggatcacctccctgggcagatttcttgctgaacaagattaaattctttactacatagtgaggtacttctgtctatcttggagacctttgtcctcttttaacttttagttccttttttttttttccttttagagacatagtcttcctctgttgcccaggctagagtgcagtggcatgatcgttgctcactgcatcctccaactcctaggatcaaatgatccttctacattagcctcccatgcagctgggactacaggtgcatgccaccatgcccaggtattctttttgttttttgtagagatgggtcttgctatgttgcttaggctggtcgacttttagttctttatatgccttcttaacataaccagattatgtttgtgtatgcagacaccaagacattgaccgtgatgtttctctcagtgctaggatcacagacaattttttagttctcattatgcttttctactatatccatattttcaacagaaattgtcgcttttataattaggatgggaaaacagattttaatgaggcttttttccctaaaacatattgcttaaccagttttgctcacaatgagcaccagaatttgtccactcagtaagtcacttatataacataatatttagaggatcctatgcttttatttctgagttatgtaaaaaatgacagaaaaatatgttaagaataatttaaactccattcattaattaaactacacatagtttaaactatagggcttgtatattacccctgaacaatataaacatatacacgacacatatatgcaaacaataattagctacttgtgtagatatatggacattttgtgcattgtgttactcaggaacatataagactctgtagccagtgtgataatgaagataaatctcctttctatctggtctaaattccttttctgcccattcaatgctactatttcttgtttgtttgtttttggagatgaaatctcgctctgtcgcccaggctggagtgcagtggtgcgatctcagctcactgcaacctccacctcccaggttcaagtgattctcctgcctcagcctcccaagtagctgggactacaggcgcatgccaccacgcccagctaacttttttgtattttagtagagacggggtttcactgtgttgtcagtcaatctgccagcctcagcctcccaaagtgctaggattacagcatgagccaccacgcccggccactactatttcttgttaagtatgcatcttcagtgggggcaaacattgctccttagggaacaaaatagatttttagggcaaaaaaaaaaaaatcaaactatctttatcagtaaagtatagaaatgcatgcagtacataaacagatatgtaatatatctgtattaaacttttgtggggaggggaaaatgcccaaaacacaggaaagatgttgaaaaacatcagtctgaactatctgggctggaggtggtgaccctgtttgcagaatgttcttagcttctgtctctgcaactgtaaagtgttcattttcagcaaattctttataaatacatttttagaaagagaaggatgctttgctgttacggtgtacaaaatgcctaacattaagtacttcttgaccaagactgaattttatccctctgactatggcccaacctagctaggcacaactctgtttgtcatggactttgcaaccaaaagccaccatagaagggtcctgattccattcttaatggcaggagtcacttcctggtgagttatgtgttttgtactctgttgggtctgctttgaaaagccccctcctttccactgcctggcatcttctacacagcatcacctatgtgagcctaagggcacacatctctcagatgagatgagaatgagaatggattcacctcatcatgtccaatgaagccatgactaaacaatgaaaggcagatgaaaaatttaaagaaaaccacttccataatgggaaattctcatctatccttttactagaagtatcagtgttgtgccttatcccaaataactgctgatgcatgcagcctgagcccaggggaggagttgaagataaggttaaagagagctagatagtgttccatcagtcaaggtcggctatggtttgaatgtgtccctggaagttcaggcattggaaagttaatccctgatgcaacaggtttaagaggagggacctttaagaggtgattaggccatgaaggctctgcccttatgaatggattaatgcccttatcatgggaatgagtttatctcaggagtgggtttcttattaaaaaaaaaaaaaatagttcagctctcttttccactctctctcaccttctctttgctcttctgccttttgccatgtgataacacagtacaaagtctctcaccagatgccagcctctcagtcttgaacttcccagcctccagaattgtgagccaataaattcctcttcattataaattatccaggctgtggtattctgttataacagcacagaaaagactaagacagaaaactggtacttagaagtggggttgcttctttaacaaatacctgagaatttggcagtggctcgggaactaggtaataagtagaggcggaaagaatttggaagagcaggctagaaaaagtatacattgccataaatgtaatgttaagggcaattctgatgaaggctcagaaaaggagagttgtaaaggaagtctggaacttgttagagattacttaagtggtggtgatcacaatgctggtagaaaagagtaaagaggctgggcgtggtggctcatgcctgtaaccccagcactttggaagaccaaggtgggtggtcaggagttccagaccagcttgaccaacatggttgtttgaaatgcttgttccccagtgccataaggaaatagcacttgaacataaatttaatttactcagcaaggccatttttacttcctacagaaagggtacacgctccagcagttttgtcagagtataccgaacaaaggagatagggtcatttataaccttacgcgtccaccctactgctgtgtccggtttccattggctggaatgggacctcatattctgtatttgttccaactggctagcaacttataactttttaaaagaggcaaaggtagaggagaacaaaggaaggcggaagtaacttgtggaatgctgagaaaggtaaaaacaccttcaaagaaggaagaggagcaggctatgacctaatgcttgcttggaccagtataagtatgccaggtcaaatatttaggctaaattgtgggagctaagaacataaagtacactaatttccttatcatggctagccggtatttaagaatgttagcacaggcctttgaataaattttgcttctaagagaagttactatttattcctaattaaatggggaggaaagtctttgaagaggaacctctactttactttttacaatggtgaaacccagtctctactaaaaatacaaaaaattagccaggcatggtggtgggcacctgtaatcacagctactctggaggctgaggcagaaaaatcgcttgaacctgggaagcggaggttgcagtgagctgagatcacgccattgcactccagccaacattgcactcttgggcaacaaaagtgaaatgccatctcaaaaaaaaaaaaaaaaaaaaagagaaaaggtccttctgatgaggtctcagatggaaatgaggaacaacttattggacactgaaggaaaggccatcctttttaccaagtggcaaagaatttggctgaattgtgtccatgtcctaagactttatataaggcagaacttaagactgatgagcaagaaattcagcaaagcattcaggatgctgtgtggtttctcttaattgcatataatacaatgtgagaagaaagaaatgatttaaatgcagactttataattaaaagggaaacagaacttggagatttgaaggattctcagcctggctaggaggtcaagaatgaaagagcattttcaagagaggaaaacaggggtgtggccaagagataaggaaattaacatgataaaacaagccagaggccattcagcagaacaatgggagaatgatcctgaaggtatttcagagattagcaattctgcccctcccatcacaggcccagagtgccaaggtctggggaaaggaaatatgtcaaaagagaggcccatggtgcccatgggaccacagtactcactgccctgcaccacctgaagtgtctgcttcccacattccagtgcagtgctcctcaggtgccccagctgtggctcaagtgagcctaggttcagcttgactccccactgcagaaggcacaagtcatgaaccttggtggtgtccacgtggtgctaattctgcaggcatactgaatgcaagcgctgtgcaggcatggcttccgccacccaaattttaaaggatgtcaatgacaacctggggacccagaaacaggcctgtgacagaggaggagctgctgcagacagtctccaccagggcaatgcctagtggagctttgggagaagagtaaccccctaatcctgagaccccagaactacagagctaccagcatttaatgccagcccagtaagccacaggcgcctgaccccaactcatcagagaaactgtgtgctcttcagtaaaatggtggggattgggcccctagggccttcaaggcccaacttccaccccagggtatctacaaggtggaatatagagtcaagaaatactattctggagccttaagatttgatgttgttcaccctgttgagttttggacctacatttctgtaagtccaataaatttctgttctttacaaatacctatttcttccttttgagagaatgtgtctcctatgcctgtcccaccattgtatttggaaagtagatatcttgtttgatttcagaggctcacaactgagagaaatttgcctcagaagaaatcaagcttcaaatcttacctgtatctgatttagatgagactttggacttttgacttggtgctggaaggagttaagactttggggctattgggatgtaataaaagtattctgcatgtaagaagaacagaaattcaggaggccctgggcagaattctgtggtttgaatgtatccccaaagttcaggtgttggaaatctaattctcaatgtattacaatagtgttaataggcgggacctttaagaggtgattaggccattgagggctctgccctcatgaatggattaatgtcattatcacaggagtgagttccttatataaggccaagttccgcctcctcgttctctctctctttgaggcagggtcttgctctgtaacttactgctcttgctctctctcaccctctttgccctttcactttttgccatgagatgacacagcacgaaggccctcaccagatgctggacccccaatcttggacttcccggcatccagaattgcgagccaatacatttctgttctttataaattattgagactccagtattctgttatagcagcacaaatcagtctatgacagggtccaaccagaaaaccaggaatcacactaggtatttccacagaggacattgaatgtagggaattgattacacaggtgttgacagctacaaaagcaaaaatgaaacatcaggtcatgcagagacagtagctttagaaatcagctgccaccaacagagtatagaacacaggttggccagcttttttttgtgtatgtgatgggtcagacagtaaatattttaggcgttttgcaccatatgatccatggaacagctgctcataccttgccactatggtgggagagcaaccatacacaatatggaaataaatgggcatgggtttgttgcaatgaagcttttttttacaaaaacaagatgtgggctggatctggattccacacatacaaaactcattttaattacactctccttatttttttctaataactatttcctataccaaaatgccacctggcaaactcctattcatccttcaagactcaccaaaagtaggccaggtgtggtgcctcatacctgtaatcccagcactttgggaggacgaggtaggtggattgcttgagcccagtagttcaagcccagcctgggcaacatggtgaaaccccatctctacaaaaaacacaaaaattagccatgcctgtagtcccagctgcttgggagactgaggtgagagtatcacctgagcctgggatgtgaagactgcagtgagccatgataatgacactgcactccagcctaggcaacagagtgagaccctgtctaaaaaaaaataaaaaataaaaaagactacccatgtgttggtgtctcctctcaagcatgaaatccaccaaagcatgcttgcattcatccctgtatttgcaagaaactagcatagtctctagcacacaggagtgctaaacaactgtttcatgaaaagatgaacaaaccaggtaataagcaaatattaaccaaaaaattacccacatgtgttaagcatttacaaggagtaaagaactgtttaatgactctccttaaccttcccagaaactctaggaaggagactgtgattaccatttatattttatgaatgaggcaaatgaggcacagagacttcaagctacatccctaagtttatatagatggtcagtgcatgacccaagaacagaacttgggagtctgagtccagagcctcattcttgcactgctctggaattccatatccgtgcatggtctttacccgtgatagcaacacagcacatgcaagaagtcttctttatgctaagaaagaataaacatacccttcataaataatgcaaaaaacaagttaactgcttctgaagagtggaaacctgctttcaaggagtctgaagtatggtaggaattaataaaacattttaagggtactctacaattcaaatatgaaaaggaaaatcaattagtgatctgaaagaactaacaagtaaaacaatcattttaattttccatgtatggagaatccacaacattcttgagagtgttgagcatacaaaattcattccctgtgctatgtaagtataattttaaccagtggtagaaatgccagtcactgtggttggatcactgttttaatttagcatggtctgcctctgaggttaaaaaaaaagccaaataaaatagcacacactttctcattaagctgcataatttcatcgaatttgtttgattgaaatactacaccccggtgtttgagtctacaaacacatttacacacaataaatttaacaagctcacaattgtaggtattaatcccttatattctgtctagttttcaatcttccttataaaatagaagacaattccagaaagtcccttgtttggatttgattctattatttctacagcatgaactcattttctatataacacagtcactttggaaaggtcttattttgttaaaggggtcccggagcatatgtctaagtaattacagtctcttcaaaatgcaaacttttatgccataaaattcagttagtagaaaagtttcctttatgtgcaaagaaacattttgattttactttttgttttttgagttccatacaatgttaaagtttagatggtttaaaattggttttatatggctgttgatttctttgtaaattctctaaaaactacatttctaacaccattctgtgtgaataaatctagagtttcaaatatatctgataagaaattatttctcacatctctcttaattctaacaataggtgttggtataacaaattaacactagaaagcattttacatgcattatttaatttatttttggtggaacagatgttggtgccatcatcttctctaatcggcagatgaagctctgagactattttaccagagctagtgtcttagcacaggctaagttgcagcatcaaatagatgcaatcaattctggctcagacatagtcagtctcataaacaatgtgatcatgtactgcagggcactgggaaactcagatccacacagtcattcaggtatccaacttgtcatgcttctacgatctttaactcatgtcttcaagggtccctgtgagcatcaccatcacagtcagctggaagaaagagtagcaggggaatctgtggggtacttttataaggaggttctggcttcatttctgcttggcttcttcctgggaggatgtggtcacatgggcacagctaacagaaagggaggctggaaatgggaatgcctgaggagcatttattacctccttcaggtaagaaaaagcctggctctgacatgactgagccaagtcctcagccctctgtctatactgtctgaatgccctgtgggattgagcccttaacctgcagggtcccactctaactccaggcagacagtgtcaggatggaactgaattataggacacctagtgggtattcattggagaattgcttggtttatgggggaaaaacccacatacatctggcatcagaagtgagtaggggctgacataagagaaaaatgaccttcttgtttttcacataaacaaatatgcaggctgtaactgagagatccgcaggggtgtgtttgtgaaacctctaaaggtgagaccaggtggtctgagagcaaacaatggggaccttgatgctagccaccaaatgctgtgctcaaagtgagacgtcagaagtgattttccaccatgccaatccttcggatcatatgcacaatatttgggctattggttttaatccctcatgcccaacattttgcagttgttctaaagaaacatacaggttctaaagccagcactataaaaaactgactctatattcgtgggaggaattgactcttcggtgagtgtttgccaggtttttcattcgtcacattttctaacaagaagaatgcgattgttcaaatcactcagggataagtggcttgcattagcacgcctattcagggactttttctagaagcattctaggaagtaaaatgtgggttgatatctttattataggcaacacggggctttatttacaaacaaagtgctttagacaaggtcttttgcataatacaaatagcaagttattttcaaatggccataatacttgtagtcaaaacctctttcaattgaaatagcatcagcatatgtcttattttctggaaaatgtacaggaaatggtgagaaatgcacattctatatactttcaggagaactaagccattgaagcaaaaggaaaaccaagtagcaattaaaagattcgattccctactttgggaagatacaccaatttgattcaagaaatgggtattgagatgggcacagtggctcatgcctataatcccagtactttgttaggctgaggaagacagtctgcttgagcctgggaggttgagaccagcttgcgcaacatagtgagactctgtctctacaaaaaattttaaaaattagctgggcgtggtggcacacaactatggtcctaactacttgggaggctgaggtgggaggattgcttgagccctagaggttgaggctgcagtgagcagtgattatgccactgcactccagcctgggcgacaaagcaagactatgtctcaaaaaataaataaataagtaaaaaagtcaataaatgaataaataaataaataaaaagtgttgagctcctttgaggtgatgttcatgccgccatggattaaaggtcaaataagatacgatcctttcccccaagaaatttataatctagctttacaataattcatttaggtattctcaactgctatgtcagataataacacctttcctaagttttttccccctcctagtaccatctcaattcgtaagaaccaaggaaacagtgatatctacttaagcccaggcaatcatccaaagaattaaaagctaggtaacattgtcctctgtgtgatatttgcttgattattttaacaaacagaagtcagtaactgtttttgcatgaaatagtcataggccaaggctctcttctttgatttaaggctctttggggtcactgaagtgtcatttggaaaatgacttcccaatgcataatgatcccctaaagcctgtcgtaagtgctcttccatgagagcagcgatttattttcttccaagtattgttttaaaacagtaagcagccgaaggtcagagaggctctggctcatgaaaacaggcttaacgcaactctaagatattttttaaacactggagaggagaaaaatttttcataaatacacatttagagaaatggttcaacagacatggaaaagatacgtttctcttacccccaagcacatggttataacccatgaaacaatatacataaaagaaaagaatagatggctttagaatatcacagagacctggattcaaattccagcctttccttgcattgattatgcccattttgtttgcaaatcaaagtttttgagctcagtcgcctcatataatacaaaactacctgcctcaaagattgtgacaattaaacacgatactgtatacaaatgctaaagagcaaagccagctgcatagtatacactcaataaactgcagtgatgagtgctaagattattgttaaacaggagttatacacaaaataattaggcatacagtatataaaacccaatcctctcttcatttgtgggattatgtcaatcggatatctaatgctatgttacttgtgaaataatcattttcataagcaggaaaaataaaaacctatgcagctataaaaatcaactgtattaaagactttatttaactcttgagttaggaaactggttgtaagatgttgcaaccagttcaaagtcgactccaaacagacacatttatagatcaggaatattgaaacctcagaacataaaactaccttcttccaccgttcgggaaggaaataattgaaactgtaccagacaggacataatttgcatatgaatagacaggaatgattttgcactcagttatctacaacttatgaggatgtaagtttggtcccacagaatcagaatctgataatcctagaggctgtactcttccaggaaatgcatcattgtcctttaaagcacatttttctacaattatcacatatatatattttatatataatataggaaataaaaatatctattttgtgtagatatgtttgcatgtaagtgttgttcaattttgcttgctgttttgtataccacatcatacatattgtctttcacatacacacccacctgtaaaagttaaaattactaaaattgagtgaatcttggttctatgcctgttatatagaaactaagtaaatgatggagtgcatcaaagaattgtacaatttgagcaaaaagattatctcactctgccatttctcttaatcattccaccaacactttatgaacttcttgagttataagcaataaaattccaaatattgaaagttgtgtttgagtcctttagactggatcgccttcatatttttttttttttttttttagagacagggtctcagtctatcacataagctggagtgcagtggtgcaattgtagcttgctgcaaccttgaactcctgggctcaagagatcctcccacttcagcctcctgagtcgttgggactacaggtgtgcaccatcacagctggctaattttttgtattttctgtgaagatagggtcttgctatattgccctggttggtcttgaactcctggcctcaagtgaccctcctgcctcagcctcccaaagtgctgggattacaggtgtgagccactgcacccacccagccaccttcaggcatgttaaggatggtgaggaacagggatgctggttttaacaaggttccctgatggtggcctcatgtgtgctgctcccacagcgtggctgagggtggaagctgattcccggttggaggaaggtaagggaagtgcaccactgccttctctctggactggaaagagacgggctgtgtctagggagggtatgtagggggccgtgtttcaggggttgagggtcattggtaattggtcacgttcctcctttcaggaagcaggagttggtcctgtaggactcctttcccagagagcggctgccacaggaggacagaggcatctgcagccgccctggccttctatctggtgcagacccacgcggttcctcccccatgctgctagacctggctgtctcctgactctggcttcctgcctggccctttcctttccatcctggccctcaccccttagctggtgtccccagcatgtttttcttgcctgaagacatcagaactctgcttcttctttctgttctccttcctcttaggcaggctgcagcctcgtccctgtgaccctctggagctctgagaggatccaagagaatacagctctgccatccaggtctgcgtggcagcagatgctctccctcacccagaagtccatttgagtggccgctttgcacctatgccgtgaaaatgtccccaccttcattaaaaaagaaccagagcaatcactaactcctcactaccccatgttggggctcagaaaacaatgccccaaaatgcaggtctcagcagtggccttggaagcgaacttctctctgtgaccttctcctgccctcctgtctctcagtcccatccttcccagaggcctcagagaaactagaagccctccttcccttggctggtcctagaaaccagaacccttctctccaaagccagccataaaacctaaaaataggactttaactttccctctgcctttctgtgtaaaaactagccataaagaaattccctgacctaccttatttgactgtagatcctaaaacccccattccagagagggtcccacctcacacccagaaggaaagagcgctgctcagagaggccaagaagaatctagacagacaggctggctgggtttccacactcagtccattagctttagatcaggccctttttgtccaaccctgtttctacatgctgtccatgctttgttgaacctaagtataaaaatggatagtttcccctgtatccttgggccttcattctgaagtctcctatttgtacacattaatttgtgtgccttttctcctgttaatctgccttttgtaagtttattttccagtgaaacttcaggggaccccttggcccctacaccccacacacttgcacacaggcacatactcaccaccatccgtgtagtacacagtggatagaaataaggtgggatgcagagacgcaaatgcaaaattctatttctatctgatggatcagtggaagggaaggtttgtgtttaacaaggatgtgtccgtgcctttcccagtttcaggagcaagtgaaccatctgggaatctcatgaatgtgaaaactttggccctgtgggtctggggcaggggggtgtgagtcactgtcttcactgtggctcagagtctgtgatctggagagctgatggtggggccgatcgtctctctgcgggagagtttggtgtcaccatcatctcttaaagctgcagtgtgctggctgagcaggggtctgtgttttagggggttggagtaattagtttccaccttcttcatctttctctccttttttttttctttttcctaggttggagtacagtggcacagtctcggctcactgcaacctccacctccccagttcaaggaattctcctgcctcagcctccccagtagctgggactacaggcacgtgccaccatacccagctaatttttgtatttttagtagagacagggtttcactacgttggccaggctggtctcaaactcctggcctcaaatgatctgcccgcctcggcctcccaaagtgctgggtttacaggcgtgagccaccgcacctggcccttcttcatctcttatgtttccaagggcctaggcttcattgttgccagtatcttctcatagatctagtgttggtcaacgttgttcagtcacttctaggatttactgagaccagcagctccccctgtgcactaactgccttccttatggccatgacatggccccacagacagggggccaagcctctctaaaccatctgtgaaaagaaggcaacagagtgtatgtgagcacggtgggtgtgaatgactcccaaaccaccctaaggctgagatgtcctatgacaaaccttgctacccacatgaactccgctaaaaacatctatctgctcttaaaatagtcatgggccggcatttcattgtccatagactgcttgacagcctggagctccacctccacccaagccataggtgtcctcgtctcttggctgccacaccaaggcagactgtgtctcagggagcaacccaaggggtgaggtgtgaagaaatgttcccacatcaggccctgctgtaggaataaaggtagatctcttatgtttttcagaacagatctctttgcaaaagctaatcatcccttaaacactaataacaactgcaggacacaacctattgtgtctgaaaactgtgaagggttaatcacattttctaaacacaaagtactttcccctaagcacatctgggcccacagggcagtggctcatgcttataatctcagcactttgggaggctgaggcaggaggatcacttgaggctgggatttcgaaaccagcctgagcaacatagaaagatccagtgttgacaagaaattttcttttgaaattagccaggcatggaggtgcacacctgtagtcccagctactagggaagctgaggtgggaggactctttgagcccaggagttcaaggccgcagtgagctatgattgcaccactgcactgcagcttgcatagagcaagacccagtctctttgtaaaattttttggaaggtctgctattatttcaagctaaaagtttatacagtaattgctttgtgttgtgtaacattctagaatatgacatacatacaaaagggtgttttaaataaattattccttttgggcataaaacgtgtggggtttaggggccacggggtcccctgaagtttcactgaaaaataaacttacaaaaggcagataaataggagaaaagacacacaaatcaatgtgtatacacgggaggcttcagaatgaagatccaaagaaatatagcaataataaaataaataagtctgagtttgaattaacacaatttagcaactgagtcattctttgtcaatcatttagccattttgaaaatcgctttgtaaaattttttggaaggtatgctattatttcaagctaaatgtttatacaataattattttgtgttgtgtaacattttagaatgcaatgactatctgcaaagggccttttaaataaattattccttttgggcataaaaaataattttgtggtgctttatgggtagggaggtgagcagtagggggttgccggatggatgatggatttgagcgaacccaagattaggaggatctatctggggtaggacctggcggtacgcagaatagactggactcctatttggccataagcattgagcccctttgcattcatattttgaaacaaaattgccctagagaataattattcatcttttcaaagactagagtaatgattgctctccaggtggctccaaacacagactttcgggatctcatttagatgtattaatattaacttagccagccaagctttttatccataaagttatacaagaggaggaaaagagaggactgcctgtatgatggataaggtcaatagatgtcagaacagctgggtgcagtggctcacacctgtaattccagcactttgggaggctgaggtgggtgggagtttaggagttcaagaccagcctgatagtgaaaccccgtctctactaaaactacaaaaattcactgggcgtggtagcaggtgcctgtaatcccagctactcaggaggctgaggtaggagaatcgcttgaacctgggaggtggaggttgcagtgagctaaggtcacaccactgcactccagcctgggtgatagagcaagactccatctcaaaaacaaaaaacaaaaaaacaaaaaaaaacagatgtcagaatagcttcagcccctgtcttatacctgctacaggtaaaggtcccgctatggacaagaggatgctgcatgttcatgcgccacctgacagatccatttatacagacctgactttttttctgaggcctctgttctgttccattggtctatatatctgtttgataccagtaccatgctgttttggttactgtagccttgtagtatagtttgaagtcaggtagcgtgatgcctccagctttgttctttttgcttaggattatcttggctatatgggctcttttttggttccatatgaaatttaaagtagttttttcttttctcttttttcttttctttttttttttttgagacagagtctcactctgtcacccaggctggagtgcagtggcgcaatctcggctcactgcaagctccgcctcactggttcatgccattctcctgcctcagcctcccaagtagctgggactacaggcgcccaccaccacgcccggctaattttttttttttttgtattttcagtagagacggggtttcaccttgttagcccggatagtcttgatctcctgacttcgtgatctgcccgcctcggcctcccaaagtgctgggattacaggcgtgagccactgcgcctggcctaaagtagttttttctaattctgtgaagaaagtcagtggtagcttgatggggatagcattgaatctataaattacttttggcagtatggccgttttcacgatactgattcttcctatccatgagcatggaatgtttttccatttgtttgtgtcctcttgtttccttgagcaatggtttgtagttctccttgaagaggtccttcacatcccttgtaagttgtattcctaggtattttattctctttgtagcaattgtgaatgggagttcactcatgatttggctctccgtttgtctattattggtgtataggaatgcttgtgatttttgcacgttgattttgtatcctgagactttgctgaagttgcttatcagcttaaggagattttgagctgagatgatggggttttctaaatatacaatcatgtcatctgcaaacagacaattgacctctcttcctatttgaacatcctttatttctttctcttgcctgattgccctggccagaacttccaatatgatgttgaataggagtggtgagagagggcatccttgtcttgtgctggttttcaaagggaatgcttccagcttttgcccattcagtatgatattggctgtgggtttgtcatagatagctcttattattttgacatacgttccatcaatacctagtttattgagagttttaacatgaagaggtgttgaattttattgaaggccttttctgcatctgctgagataatcatgtggtttttgtcattggttctgtttatgtgatggattatgtttattgatttgtgtatgttgcaccagccttgtatcccaggaatgaagccgacttgataatggtggatgagctttttgatgtgctgctggattcagtttgccagtattttattgaggattttcacatcgatgttcatcaggggtattggcctgaaattttcttttttagttgtgtctctgccaggttttggtatcaggatgatgctggcctcataaaatgagttagggaggagtccctctttttctattgtttggaatagtttcagaaggaatggtaccagctcctctttgtacctctggtagaattcagctctgaatctatctggtcctgggctgtttttggttggtaagctattaattactgcctcattttcagaacttgttattggcctattcggggattcgacttcttcctggtttagtcttgggagggtgtatgtgtccaggaatttatccatttcttctagattttctagattatttgcatagaggtatttatagtattctctgatggtagtttgtatttctgtgggatcagtggtgatatcctctttgtaattttttattgtgtctatttgattcttctctcttttcttctttattagtctggctagcagtctatctattttgtttatcttttcaaaaaacaagctcctggattcattgattttttgaagagtttttcatgtctctatctccttcagttctgctttgatcttagttatttcttgtcttctgctagctttggaatttgtttgctcttgcttctctagttcttttcattgtgatgttagggtgtcaattttggatctttcccactttctcctgtgggcatttagtgctataaatttccctcgaaacactgctttagctgtgtcctatagatttttgtatgttgtgtctttgttctcattggttttaaagaacttatttatttctgccttaatttcattatttacccagtagtcatttacaagcaggttgtttagtttccatgtagttgtgcagttttgagtgagtttcttaatcctgagttgtaatttgattgcactgtggtctgagagactgtttgttatgatttccactcttttgcatttgcgaagtgttttacttccaattatgtggtcaattttagaatatgtgcgatgtggtgttgagaagaatgtatattctgttgatttggggtggagagttttgtagatgtctatcaggtctgcttggtccagggctgagttcaagtcctgaatatccttgtttatattctgtcttgttgatctgtctaatattgacagtggggtgttaaagtctcccactattattgtgtgggagtctaagtctttgtaggtctctaagaacttgctttatgaatctgggtgctcctgtattgggtgcatatatatttaggatagttagctcttcttgttgaattgatccctttatcattatgtaatgcccttctttgtcctttttgagctttgttggttcaaagtctgttttatcagagactaggattgcaacccctgctgttttctgctttccatttgcttggtaaatattcctccatctctttattttgagcctatgtgtgtctttgcatgtgagatgggtatgttgaatacagcacactgatgggtcttgactctttatccaatttgccagtctgtgtctttttattgggacatttagcccatttacatataaggttaatattgttatgtgtgaatttgatcctgtcattgtgatgccaggtggttattttgccagttagttgatgtagttgatgcagtttcttcatagtgtcaatggtctttacaatttgctgtttttgcagtggctggtactggtttttcctttccatatttagtgcttccttcaagagctcttgtaaggcaggcctggtggtgacaaaatctctcagcaattgcttgtctgtaaaggattttgtttcttcttcacttatgaagcatagtttgactggatatgaaattctgggttgaaaattcttttctttaagaatgttgaatattggtccccactctcttctggcttgtagtgtttctgcagagagatccactgttagtctgatgggcttccctttgtgggtaacccgacctttctctctggctgcccttaacattttctccttcatttcaaccttggtgaatctgacgattatgtgtcttggggttgctcttctcaaggagtatctttgtggtgttctctgtatttcctgaattttaatgttggcctctcttgctaggttggggaatttctcctggataataacttgaagagtgttttccaacttggttccattttccccgtcattttcaggaacacccatcaaatgtaagttaggtcttttcacatagtcccatatttcttggaggcttgttcattccttttcattcttttttctctaatcttgtcttcacactttatttcattaagttgatcttcaatctctgatatcctttcttctgcttgatcgattcggctattgatatttgtttatgcttcatgaagttctcgtgctgtgtttttcagctccatcaggtcatttatgttcttctctaaactgattattctagttagcaattcctttaaccttttttcaaggttcttagcttccttccattgggttagatcatgttcctttagctcagaggagtttgttattacccactttctgaagcctatttctgtcaattcatcaaactcattctccgtccagtttggttcccttggtggcgaggagttgtgatcctttggagaagaggcattctggtttttggaattttcagcctttttatactggtttttcctcatctttgtggaattatctacctttggtctttgatgttgatgaccttcagatggggtttttgtgtggacatcctttttgttgatgttgatgctattcctttctgcttgttagtttttcttctaacagtcaggcccctctgctgcaggtctcctggagtttgctggaggtccactccagaccctatttgcctgggtatcaccagtggaggctgcagaacagcaaagattgctgcctgttccttcctctggaagcttcatcccagaggggcacccgccagatgccagccagagctctcctgtatgaggtgtctgttgacccctactgggaggtgtctcccagtcaggaggcacgggggtcaaggacccacttgaggaggctgtctgacccttaacagagcttgagcactgtgctgggagatccactgttctcttcagagccagcaggcaggaatgctgaagctgcgcccacagccgccccttcccccaggtgctctgtctcagggagatgggagtttcatatataggcccctgacttgggctgctgcctttctttcagagatgccctgcccagagaagaggaatcttgtgaggcagtctggctgcagcagctttgcagccagtgagctctgccccatctgaacttcccagcagctttgtttacgctgtgaggggaaaaccgcctactcaagcctaagtaatggtggatgcccctctcccaaccaagtttgagtgtcctaggttgacctcagactgctgtgccagcagtgagaatttcaagccagtggatcttaactagctgggctccatgggggtggtatccactgatctaggccacttggctccctggcttcagccctctttccagtggagtgaacagttctgtcttgctggcattccaggagccactggggtatgaaaaaaaatctcctgcagctagcttggtgtctacccaaacggctgcccagttttgtgcttgaaacccagggccctggtggtatagataccggagggaatctcctggtctgcgggttgcaaagaccatgggaaaagcatagaatctgggccagaatgcaccattcctcatggcacagtccctcacagcttcccttggctagaggatggagttccccaacctctcgcacttcctgggtgaggcaacgccccaccctgtttctgctcaccctccatgggctgcacccactgtctaaccagtcccaatgagatgagctgggtacctcaattggaaatgcagaaatcatctgccttttgcgttgatctcactgggagctgcagactggagctgttcctattcagtcatctcgccagccacccaagaggatcttttctgagccaaagtttagcacctctgtcccagctccttccttagagaattctgaatgtgggttccacttaaagaacaacacagcatcaaggggcatctgacctctggtcatttggagacttcaaccccctattactttctatggatgaaaatcaaagcttctgctgtactgttctcagagccaaagcctgaggtgaaactcctctcctctgattttttgagcatggaatataaacaaaataattagccactcaagaggcattgcaaacattaactaacatgtaaccttgcaaaacagggaaggttcttatttgtaaatgccaatcactacacagaaaaactctaaggatttatatcctaggcaacagaaaattgctctgtaaaagaactcttcccacatgttttactaaatttgcaatatttgagcttgcatttaaataaatacagagtttcctacctctctctcaagtgtctcttctgcaaatccatgctcttttctccatgccactccaggaacaggcaggaagaacccaatctcacaacggggaccagagactgccgccttaccttagaggagcagaaaatgtagtatcaaggacaccttcaggatgtagacagtaaggtgactgctggaatcatctaagaggagggagttttaagcaaaactttgctgccctgcaagtctgaaaatgacattgttgacctagaatcaatagtatacaccttcaaggaatttgttctccataataaagaccatttctgtgttgacatgtacctcttctagtttaaagaataatcaatggaataaatttgagacatcagactgtatttttgcacccatggaacaaattattattttcttccattggggtttgaatttgtgactttggacaccttgactattaaaggcaagtgatataaagctgaaatcaacattactaaagtgagagcatcccaggagtcccacctgggacctctgcttaggtctccatgtgttgttgctactcagatacttggacagtgacttggcaaaccaaaagccaggaaaaagaggctctaccagctgaggctaaaatgctgatacctttatctggcctggccataggaagctccgccatggcagagaaagtcagcacttgcatagacaatgcatgagctagctccacagtctgaatctgagcctgtgctctgccattttgtaatatggacttgccaggaagatgttcaagaacatcatgaaacctctttgggttccaggtcttggctacctcctgtccttgcaaaacaagtccttcacatggtccagccctgctagcctggacactggagtctggggccagagtcccaggttatcataaagtggtacatggcactgatgattcctcacacagaagatgccaattaaacaatgccttaaacagtgtgtgtaggatttgaacaaattccatggctatgggttcaagggcagtctagtaacacagaaccttaccataaactctgtttgccttctttagtttttcaacccaattctgcagggcactctgtggtcctttgtagatcatgtatccttggagacgttttgagacattaatgatctctttgatggaatccatgatggtttttgtgctaagtcccatcttcagtaggaaatgccatgtaatgttctttctaaaaaaagagagagagagagagagaacaacttggatttacaatgtaaacactatttgtattcatttttccctgtgctgttaacatttttggaaaaaagtagctatttgtttaattttagtttaatttgtttttaatacatgtgtatcgttgtccagattgtactcaccattaaggaatgagaaaagagcaatagttgactctattaggtcaaaggttgttaaaaatgtttataataacagacagatgacgtaacaaaaaatgaacaacagtcatctcagacttaaacaaaaaagacataataaaataaaagaataactaaaaaatctttcaagaatcaattctgggccatcttagccaatgaatatttttacagataggtatggtcagtgatcgtggtactgagaagttgccaaaagcaaatgggaagactgttggtgcagcagaaagtgtgaattgtattctacaatcttgctttcttgtctcttgataaaactgctccattttccattcccaagtccattcaccagcctcaggacatccagatgtggacctcaaagcaactgctaacactaatagaatccttgcttcttaaaaaacccaagcaacttaaagcagacaccatatacgcagaaatcaaggagcatgtgcagaggataaaacatttttgggcaagaaacaaagactggtggctgagggttgtttctcgattaaaattattttaattaatacctaatgttatataatgctataacacaatgttatcatgcataaaatgtcataatttgttatgtcgcgtaatagtatggtaccctccaaagtgtgtctccttacagctaaattagcatgcattcaacagcacacattaacataccatgattaaagtatttcaaaataaataccatgcaggatctttgtttattttgtttagctcctcgaattataggtggtcactctctgtcccccaccacctcctccacacacatctgaaggacacttagaaagatactctccatgaacatactggtgaaaaaaagcaagtgaaattgccgattatagtgttctagatcctgagcaagtttgttccacaaaatccttgtagataaaaaataaaatgaataagctgctcccactttggaaataaagacaatagcataaaatggtaatgaatggttggtctataggcacaaaaggcatatttaaggaatgggatatgagggggaagatatgtataatagaatcattttattggaaaatgaaacagggcacctagttcctgctaagccttttccagagacggataattgatgctaggtccctgcagaaagccaatagggcattgctgataggcgaggactaagcaaagcttggcttccagtgcttttttttaattaattaaataaatatgtttattatatttaaataaaattttaaagcttgaaaatatcaaaaaggagaaagaattgataaaaattgtcaaagcaattctttaaaaagaggcaaatagtagctctagaattaaaattataataatcagtatgaaattttttttctatagttgaactttggcttctgcttttaaaaaccatattttttctttattttctgacttattttagattgaggggttacatgtgcaggtttgttacttgggtagattgcaaacccagatcatgagcatagtacccgataggtagtttttcttcttttcttttcttttcttttctcatttctcttctcttctcttcttcttctttccttccttccttccttcctttcctttctttcctctcctctcctctcctcccttcctctcccctcccctccctccctcccttcttccttccttcttctcttctcttctcttttcttttcttttctctgagacagggtcttgttctgttatccaggctagagtgcagtggtaaaatcatggctcactgcagccttaacctcctaggctaaagtgatccttctaccttagcctctgcaggagctgagactgcaggcatgtgccaccatacctggctaatgttttaaatattttgtagagaaggggtcttgctctgttgccgagggtggtcttgaactcctgggctcaagagatgctctcgccttagcctcccaaattgctgagattacaggcatgagccaaagtgcctggcctccttttacaatattaacttcctcctttgttgttgaccattagcacctccaatggtagctctgttatcagttttgcagcactcaaggtgcattacagccggccctctgtatccatgggtttcgcatctgaggattcaaccaactatggatgaaaattaaaaaaaaaaaaacaacaagaatgattatgtctgtactgaacacgtatgtccttttattcttgtcattattctgtaaacaagagagtatagcaactatttacatactatttacattgtatgaagtattctaagtaatataaagatgatttaaagtatatgggaggattgtgtagtttatatgcacgtaccacgacattttataacagggacttggacatctgtggattttggtatccacagggttcctggagccaatcccccacagataccaagggaaaactgcactctctcctttgcatggtgctttatttcccactagagaaagcatgaaaaacagatgctgtgtgatactcatctccacatcacccacacaacccagcatgagaccgacaaaagctcaaggctccataaattgatgttgaattggattgaagctgagcttcagcatcaactaaattcaaatcttcacccaaatcctatgtggcgcagaaatattgatggataagatgatgtgatgtctgggaattacttcaaaatgagccagttggtggggggtaattgaaacaagattggtcagcagttgagaactgttgaagctgagttacatcatgttcattgccattattttctctatgttgtacatgtttctgttttttgatttaaaaaggttaggaagaaaccccaatgttttaaaactggcaggtgtttaataaaactttctctatatacttattgctatggcttatctactaatgagtgcttcttaccgtggttattcccatattcttgaaacagccgatatagcatttttagtgccattgttagtataaaaaaaaattaaaagtttcatcagagagtctcgcttgaaaaatgccttctgttccaagaactggaaataattacaaagccattttttaacctataaatcccaaccccgatttaaaagttattttttcattttccctatgttttaagggaaaagtaacctcagccccatcatttcatatattttacttcttgggccattttagaaatcatctattccagtccaaaattttagagatgtgaaaattgaggtcaagaaacatttttgcctttccccaaatcgtagagtcaatcggaaaaaaggcaaggattggacacagaccttcagattaggattttaaaattcgtatattcattttacaagagtttggtgcacatctgctggatgccgggcagaataaacaatgcagccaaagtccaggccttcatggtgactggcaattctgttcctaggattacacccaaaagaaatgaggacttacagacacacacacacacacacacccccaagagaaatgagaacttatggatacacacacacacacacacacacacacacatacacacacgcacatacccaagagaaatgataacttatggagacacacacatacacacacacacacaaatacacacacacaagcatatacccaagagaaattagaacttacggagccacacacacacacacagacacaatgtgtacacaggtgttcatagtgtaactgcctaatgtgttcctcctgccaactgcaaatataaaataaactcacccagacatggcactgcagtaaagaaagagcttaattggcgtgaggtcagccattccagaattattactcaaatcaatatccccgaaggcttggaggttggaggtttttccaagatagtttggtgggcagggactagtgtagggggcatgctattggttggggatgccatcataggggtgtggtaagtggtcctcatgcactgagtccacttctgggtggaggctacaagactggttgagtcacgggtccaggtggagccatctgattgtcagaaatgcaaaaacctgaaaagacatctcaaaaggccaatcttaggttctgccatagtgatgttatctgcaggagtaattggggaagttgcaaatcttgcaacctccagaatgatgcctggtaattatttggaattcaagcccctctcatccttctaacttggtggcttttcatcagttttccaaaaacagtttagtttgggggaagggctattatcttttaaactataagccaaatttgtcccaaagttagcttggcccatgcccaggaatgagcaaaaatggccaacctgtgaggctacaagcgggacagagtcagccatgtcagatttctctcactgtcatacttttgcaaaggcagtattattcataatagccaagaggtggaaacaacacaaatgtccattgcccggcgaaaggataaacaaaatgtggtccatccatacaatggaatatgatccagccacaaaaaagaatgatgttctgatacattggcaacatggtggaaccttgaaaacacgaggttcagtgaaagaagccaggcacaaaaggtcatgtaactgcccaaggggttcgccttgcccgctgcctagacataggcgatttatcaagacagaggaattaccatagagaaagagtaattcacacaaagatggctgtgcgggagaacggagttttattattactcgaatcagtgtccccaagaacttggggatcagagtttttaaggataatttggtgggtagggggacagtgaatcgggagtgttgattggttggcttggggatgaaatcatagggagcaaagccgttctcttctgctgagtcagttcccgggtggggaccacagaactggttggcaggtccagatggggccatccggttgttagaaatgcaaaaacatgaaaaaaaatctcaaaatattggtcttaggctcacaatagtgatgttaccttcaagagtaattggggaagttgcaaattttatgatctctggaataatggctggtaatatttagaactccagcccctttcatcttgacttgttggctggtggtctttcatttgttttacaagaacagtttagcctttcgggaagggctattatttaaactatatattaaattccttcccaaagccagttcagcctacgcccagtaatgaataaggacagtttagaggttatgaggtaagaaaatagaatctggaggcaagaaacagaaggccgattcacacttcagctatgacaggaaatatcctctccatagggcataggccaagtaaataactttgtaactttacttcatcctcttcatttacatagggcgtaccccaagtaaccaatggaattgtctagagggtatttaaattcccaaaaattatgtaacaggaccgttgatcccctatgctcgggcccactcccacactgtggagtgtactttcgttttcaataaatccctttattccttccttgctttgtgtgtgcattttgtccaattttttattcaagacgtcaagaacctggacaccctccactggtgacagttagaaataagatgatgtcagctaggtctgatgtctttcactgtcgtaattttctcagttatgatttttgcaaaggtggtttcagtcacaggttgtatgattccatttatttgaagtgttcagaataggcaaatccatcaagacagaaagacagactattggctgccagagactggagaggggaaggaaaagaaggagctaatgagtatggggtttattttgggcagtgatgaaagtgatctaaaatacactgtgctgatgtttgcccaaacctgtgaatatactaagaggcattcaattgtacacatgaaatgggcgaattgggtggtatgtgaatgatatctcaatatagctgttctattttttaaggaaaaatatagagtgccataagtgctatacaaaaaaattaaatggggaggagatcagggagtggaggtgggttaagttttagttcaatgtcttcccaaaattccctaaattcctataaattagtaaatcataaaagattccttgaatcaggagtcaagtaatgccacacccagagccagccaccaccctcctggtacattaattagattgtactacatcagtacagatttaaaaaccattcaaatgctttgtgactccaggaaattcagggtgtaagcaggagaatactgcctccgaatccatggaaaatcctgccttcagaacaggaattttatctaaggattcacgcaatttgggtttcacactatttgtacactcaggggctgtgctttgcaaatataatgccagaaacaccagaaccaaaattaggtgattcaataccaactggcccactgaaagcatagagtcaagaaatcagtgcctgagccattatggggctggtacttttaaaaatgaatggacttgatatttttgcaagttttattatggaaaagtgcttttgggttggtcaaaagccttcagaaatcgttctacagcccggctgttcccacaccaaactaagggtcaggctgcttattctagaggaccaatgaatgagatgcagatgaactgggaaagaagggactttttacttctgcagccagttacagggagaaggcctagaaattatcaccagaccaactcaaaattacaaagttttccagagcttctataccttctaagctatacatctatgtgtaaagtgtgcattcatctaaagatataagcaattaacttcatttaatctataactaagatttgagtcctgaagaccttcctctggagcctcagtaagtttacttaatctaggtgggtccaagtgctggggtgattgcccttattttgtctcctgctaactcatggaggtttggggagttcctttagtccccaataaagcttgtttgtggaaacttagggagtttcttcagacccctaataaagctgtttaatcctaaataggtcctgctaagaattactttgttaaaatcttcatgctttaaggcccaggaaaggcctgggcagaactcttggtgggcttttgttacattccggcctttgtatgagggcaccggctctatcagcttttaatatttaacttcaccactcggtcagtgctgaaacagttgttgtggaagcctgtgttagtgagacctggccttccacacggcccatctggaggcagcctcttgccccgtaataattctcagtgcccaccttcctggaggggtgactcagtggttctgtcagaggcatgtgaaccagagcaactccatcttgaataggatctgggtaaaataaggctgaaacctactgggctgcattccctgacggttaaggcattctaagtcacagggtgagataggaggtcggcacaatatacaggtcacaaagaccttgctgatgcaacaggttgcagtaaagaagccagccaaatcccaccaaaaccaagatggtgaagagagtgacctctggtcgtcttcactgctacactcccaccagcgccatgacagtttataaatgccatggcaacgttaggaagttatgctatacggtctaaaaaggggaggcatgaataatccaccccttgtttagcatatcatcaagaaataaccataaaaatgggcaaccagcagccctcggggctgacctgtcgatgatcagagtagccattcttttattcctctcctttcttaataaactcactttcaatttactctgcagatttgctctgaattatttcttatgcgagatccaagagccctcttttggggtctggatccggacccctttcctgtaacagccctacaaaccgccctcagcgggacctttcacgttcactgagaactgcatttggagtgcacctaccacctccaaccccacacagcccaggggctcggcgcaggctcttcccagttatgctttcattacagtgaaaaaccacagcagatgacaatcgccccctccggccacagaagtctgaaagaggcacccctgtattttaatagaaatgtaataaattgtaccccgaagaggagacacctttgaaagcattctaaaggcttaacttgactgcaaagtggaaaactcaagaagttgcccagggctcgggtctgacatgaacctttgatttttgctatttctgtcattgtgtttgactctgaatttagtgtctgctctctccccggcttccagggaaacttgcatcctggagggccatcagccccaggcatccatgcaatccactgctcagaggtgataaaaaggagcaagtatgaaatatagttttagaggtgtcagaagaaaataaattgggttcacgttgcgttttcttctgcatccgaatatccccaaagcagaatttcattgccaatctcagacctgttaagttgcttcatgcaaattaaaaacgtttgcatgcaaccctccctccagctgcctgccaagacccaccccatttcatccaccatccagccgaaataaaagtaaaggctaagaagcctgctccagagcagtcacctctgatgtgggaaacctgaaaaactggaaatcaccagccaagaagaattatacgtgtgagcttcacgtaggtgggatgtgatggatgtggacagagcagcagagagaaagcccagggagcatatgctaaaaaacctgggaagaaaaatgcaaaatccagcagccttagaggtggcctgaggaaagagtttaggttagaaatatctgtgccctaagaataatgggcatctatgttcctccaagaacatcaggataaccaaggagcattaaacaccaagttaagaaggaaacacgataaggaaaccagcttaagctcaaggaaattagagactcgggggttcattttgcagtaactgctgagtgtgtgaatggaaatgaatttcttaacatcactgagctttcgttgtaaaggagaggcagtaatacctaccttgcagggttactggattgttatatatgtgacagcaactaagacagactgcttaatagcatacattgtatatcgtgacccacagaaaatgttctaaatgggggtcggcaaactatgctcatgggccaaatgtggcccactgctcatgtttataaatacagttttattaaaacacagtcacgcccattcatgacatactgtccacggctgttttcctgctgcagctgcagaattgagccattgagacagataccatatggcccaaaaagtggaatatatttactacctggcttttacagaaaatgtttgttgatccctggtctagaacatcagttaatcaccaatcacttgggaatagcaataagcttccatctgttgaccatctgttatgtctggtcatatgtgatttcatttaatcttataggtattacgatctccattctaattttgagaaaactgaggttctcaggtgttattttcccaaagtcataccattgaaaacaccaacattctgatttcaaagtcaattctacactgattctcagtggcatttttatgaaaaagtaaggatacaatgcaggaagaggggaaaaatgtcctagggcaacctcgtgggtctgcatagtgttctttctttttcatctgccatctgcagtggaaccaccacgaaaaggcagattttcaaagacaaaactgtgaacctgatttctcgaaacccagcgaggtcaggctcctccaacctcatctcttttggtgctcccactcttccctcagctggctggctttggctctctcctatatccccagcccctaaacatgcatattcctggaccaaaccaatggtcaggctgcttattctcgtggcccaataatgagatggagatgaactgggagagaagagagttttcatttctgtaaccgggtgcagggagaagacctagaaattatcactagaccaactcaaaattacaaacttttccagagcttatatgccttctaagctatatgtctacgcataagtgtgtattcatctaaagctttaagtgattaacttcttctaatccataactaaggtctgagtcctggaggccttcctctggagcctcagtaaattgacttaatctaaatgggtccaggtgctggggtaattacccttatcttatctcctgctaaagaatggaggtttggggagtttcttcagacccccaataaacttgtttgtggaggcctggtgagtttcttcagacccccaataaaactgtttaatcctaaaagggtcctgttaagatttccttcattatcttgtcatgcttcaaggcccaggagaggcctgggcaaaactcttggtggacttttgttacattccagcctttgtataaggacactggctctatcagcttttaatatttaacttcaccactcagtcagtgctgaaacagttgttacggaggcctgcctgttcagctgttagtgagacctagcctgccacatgcatacccaagtattccctagttaactcttagttaacactttcaaaatatcaactggaatgtcgcttcttcaaatgaaccatctctcccccaagactgagtcaaatccccttataagatacatatacatgcatatatatttgcatgtataaatgtatacatattcatgtatctgtatccttcactgcacttagaagagttgtaaattcacatttatttgtgtaattatttaactaaccactgagataagaacccatctagttttgatggtccttgtattcctagcaaatgttacagcacctgcctcagagtgggaatgtaataaatattttttggatttttaaaaatgcagatctttgtaaaaatggagaagaccatcattctcaacattgaaccattggatacaatagaaaatgtaaaggccaagacccaggataaggaaggaatttctcctgaccagcaaagactgatcttcgctgtcaagcaactggaagatggacgtactttgtctgactacaacattcaagaggagtccactcttcatcatgtgttgagatttcatggtggtgctaagaaaatgaagaagtcttatgccattgccaaaaagaatatgcattacagaaagaagattaagctggctgtcctgaaaaactccaaggtgcatgacaatggcaaaattggttgccttcatgggaagtgccttttagatgaatgtggtgcaggaggttttatggccagccactttgacaggcattattgtggcaaatgttgtcttattgcttcaacaaaccagacaagtaatcgtgtatgagttaataagagacatgaactaagaaaataaaagtcataagttgaaatagagattgttcagccagttgacataaggtagagcactgacaaagagaagctgctcacctttagtggtggttatgttcggagctagcagaaaagcctcctgacttcctccaggactcagggaaggcaggggaaggaggactttggtgtcttagtcccttctcacctctttggcattacttccttccctcccaacgtcgcaccttataatctactaactccaaaccaacaggaactctcctcccacgccctacattcaaacaccctaggtttacatgtgcaggcgcgcatgcacacacacacacacacacacaaaggctgttatctcccaacttcctgagaaatgcttatgcaggattctaaatcctgagccccttccaggggttgccttgagcctttgcttcttcaagagcccctccctaacccgaatgcctcgatactgagctctgggctgtctgtgtgtactgctgtttgccatgtaaaatccctccattgaacacatctgtctacttgcccatctatcccaaaggtctaggggtacatcaatatcaagggccatgtcttttcttgggattcccagggtagcctctaattaagaaaaattcacttatttgaaccaacttccccaaatagaaagttctaaaaaacgaggaatcaacagaaaattaagttccagtttcctccttcacctctcctgccccaaaagtactctttttggctggactcttcttccattttccccttctaactgcctccaatgtctccagcagaatgagagagaagctgtccaggctgcagagaggagtggtagcaactggatctcgcctcagaaggtggggacagggtaggcagagggagaatgcatctcgctggaaatgccaatgccgcatgggccgggaactgcagagagagcttcccttattgaaggaacgaagtcagaaaactgggaattggtaccttccaagagagggagagccagcaggttggagagagggtgtgtgaggtggtgtcaggctagtggacactgcatataaagaatgtcagaatataaatgtttatttgttacagagtcctggtttcgggtgactccagatggaaagtgcctactggcgggtgttttgcctctctgcacgggcacaagagtgctgatagttgcttctgtcacttgtttcattcccacgggagcatgcttgcacttcccaggttaggcttttggtcaggtttgggcttgtggaattgtttcaaatttttgacattatggttttgcaatacctagcttgccaggacgcttgcccccaagcaagttcttctctatctgccccacacagatgaggttgtgtgcatttttaccattactctccagcggaccattcaaatacaaacatactatatttgtatctcaatcacttgcacttgagtctcttttaagatttttttttcttgcccactcagcaagtaaatgccttgtttgtgatcaccaaagtcaagtgtttagacaacctgctcaggcccattattttccccatttatttgatgtctttaaaaaaattttttttaaatattgggtatagtggctcacacctgaaatccagcactttgggagactgagacaagatgattgcttgagcccaggagttcaaaaccagcctgggcaacagagtgagaccctgtctctataaaaaatttaaaaattagctgggcatggtggcatgtgcctatagttccagcttcttgggaggctgaggcaggaggatcacttgagtccaggaggttgaggctactgtgagctatgattgcaccactgaactccagctgagtgagagagtaagaccttgtctcaaaaaaaaaaaaaataaaataaaattttaaaaaataaccacttaagataacctgctaagtcccattattttccccatttgtttgataacttaaagagaatcatttagaatagaaaaaagtaagtgacaaaaaaagaaaaataaataaaaaggaaaaaagaaagaaaaatttttaaagaaaaacaggaaaaaaaagaaaatttaaaaagtgagtgacaaagtgaaaatatttggcttatcttctgagaggggaggaatttgagactgtaacaaacataaagaaaggacatctatgcgtaagaaaaaattatataattaattacccagatgcatgaggtctaaatgttcctgagtttgcctaaatgtcatagttatgctaatgacatgtattctattttatttttacttagagacagaactgaagtttgggtggctgccaacaagttgttgagcttgaaagcgatgctataaatttccaaggacatgattgcagttgcatcggatgtacttgtctactcagctgatgttcaagttcaaaatagagctacattctgaacatgggcaatgttcttaaaggagaattttcagggtgtctttttttttttttttttttttgagacggagtctcgctctgtcgcccaggctggagtgcagtggcgcaatctcggctcactgcaagctccgcttcccgggttcacgccattctcctgcctcagcctcccgagtagctgggactacaggcgcccgccaccgtgcccggctaattttttgtatttttagtagagacggggtttcaccttgttagccaggatggtctccatctcctgacctcatgatccacccgcctcggcctcccaaagtgctgggattacaggcgtgaaccaccgcgcccggcccagggtgtcttaatattgtttgacctcaggcagaatgagccaaaggcagtggggtgtaggaagaacgtgagacttgatctctgggaaatgagctccaccactcaacagcgtaagaacttgttgtgatggttaatattgagtgtcaacttgattgaattgaaggatgcaaagtactgttcctgggtgtgtctgtgagggtgttgccaaggagattaacatttgagtcagtgaactgggagaggcagacctactacccttaatctgggtaggcaccattcaatcagctgccaatgcagctaggataaaagcaggtagaggaacatggaaaaactagactggatgagtcttctggcctccatctttctcccatgctgaatgcttcctgcccttgaacatcagactccaagttcttcagtttttgaactcttggacctataccagtggtttgtcaggggctctggggcatttggccacagactgaaggctgcactatcaccagcttccctacttttgaggttttgggactcagactggcttccttcctccttggcttgtagacagcctattgtgggacctcaccttgtgatcatgtgagtcaatactccttaataaactcccctttatatatacctctatcctattagtcctgtccctctacagaaccctgagtaatacacctgggcatgtcccttagcaccttggatgaatccttaggtctgtgaaataagggagctggagttgatggtctctagaatgatttcttttcccaaagttccctggtattattacttacagaaagataacaaaatgtaacgaaatgtaacaaaaataggaagcaaattataaccaaggctgagcctgttcatttccactgaggtatctctggggtttgtgaaaatataggagagggtattaaagaaagagtgccatgaaaactgaaacagaggaagtccagagtcctctcagactctgggaaagccacacacattatgtgacacacacttctttatattcagatagaggcaatctgacatgcacttcatacatggatttgataacaggccattttgaaaatggggaaaaatagccacatagaattatatacaatgatgttaactgtactaatattgttaatcttataatattgttaaaaataaatatgttcaaatttatgttgctgcttccactccaaggactaccacatttttgtatcaaaggagcagagcataacaccatttctcttactgagtcaattggactgagctcaccccacatgtgctagaggaatcaatcttcatggagtgggatgtccagtagggcacgtggatctaagggagaatattgaaagccaatacaaaatccatatgaaattgtatgacaattaagacagaacaaattggaatattagatttcttttacatttcagaattttaactgctattgagtccatcagaaataaacctacaaaaataatgtcttcatattgatgagctttgttacagatatctcctgtttccagaccaaagcaatggaaaacaatgaagaaaaggaaaaaattaggccaggcacagtggcccatgtcaataaactcagcgctttgggaggctgaggtgggaggaccacttgaggccaggtgcttgacaccagcctgggcaacactgtgagaccctgtctcctcataaaacagaaaaaatagctgggcatagtggcatgcatctgtagtcgcagctacttgggaggctgaggtgggaggattgcttaaacccaggtgttggaggctatatgattgcactactgcattccagcctgggtgacaaagcaagatcctgttccaaaataaaataaaataaaagtctgtctttgatgaggtgaagaaccatagaaatactaaagcacaatctatgaagaaagactgtcaagccaaataaaagttgaacagtgtgaaggggaggtactaagacagggagaacacctctgatatgttctccagaattggtggcaaaacccctaaggcaaaactttgcttgaaaagacaaagtggggattcaaagtaagaatgcagaaaagaatgagggaaagcaggaatgatcatggaaactttcagacatagtgagatgtaggctacaaacatggtgtgacagaagagatatgacaaacggcagctgcttggcaaggctggtttactgagcagaaaagagttaattttttcaccctatcgaaaaaacataatggagtttcttttgaggcagagaaactccttcctaactgtgagctatgtcatgtcataacagagaactgatggggggaaaagtgctaagagatgacaaaataatggcataggggatccaaggtatgtataattggtactctcataaaaagaagggaaagtactataggaaaaaagtcaaaatatggaaaaaaagaagatgtgacaagaaatgacaggaagggcacaaaactgtgaaggaatctgaaatctttgcatagacttatgagaatattatgaggaatctcagtttcaaagaggcatggctttcttttttttttaaagctcaaaataataaagaagtcatttatttacatgtggaacaagaacagagaatggacatgcaattctcaaaactgaaaactagacagtacaatggcaaatcatcctaatgaatacaagaaggctgacatttcaacagaaattatcatgaccacaaaaaaaccctgtaaatgaacctaggtatgacaagtacatgcaccaaataggaaaggtagagtgcacagtcaaccaaaatatcgaaagcctttgcagaaaagtgtagaaaaagtatcaggaagtcttaatcccagaatgaggtaagggatctaaaaatatgaaaggaggctgggcatggtggctcacacctgtaatttcagcactttcagagaccaagacatgaagattgcttgagtccaggagttcgagaccagcctgggcaacatggcaaaaccccgtctctaaaaattatacaaaaattagccagttgtggtggtgcatgcctgtagttccagctacctgggaggctgaggtgggagaatcacttgagtctgggaggtggaggttgcagtgagctgagatcatgccagtgcactccagcctgggtgacagaacaagactgtgtcacaaaaacaataaaaaataaaaataaaaatatgaaaggcatcaaaaggggctttgagttaatattatagctagaagaacaaggagaaaaacctcatcttgggtcttatagcatcagccaaatatgagaggcgctcacaggtccttctctgaagattattctcaagccctttcttcctcagggccagagagttaacagttcttattggttctttctagctaccactgtcttttccatcttttgatgttctctttttttctttcccacaaagccaagctactaacagtcattcctgattcccaatacaatactcctgtgtaaaggtatacactgctgcttagttatttgagggcttaggtgctaatccatatgggcaaatacatacactgtaatgaacttgggatataaaacattttccccgtccaaaggcatctaactacctctcctctgccctggggcacttcacagctccccttttgcacacatttgtgtttctttaggtaaagctgacactgtttttagttattttgtgcaatatggagagaggagcatgagaaacaaatagtggatttcactgagtttttcctcccaaaaggccattaatcaaagggtagaacaataggtgggaactactgtgctcaggtaactgcttgtctgagaatttgggcatgtgtgggaatcattccaacttccaacacatagcttgtcaggtcccctgtgcactaccaagatctctttgggtccttgcttctaaaattatggaatggctgtggtcttttcacaacctacccaaattcattggaataaaaaaatagtttcaatttccattttttcctcatatatatatacacatatatatgtatatatatacatttttatacatacatatgtatatatatatatgtgtgtgtatatatatatgtgtgtgtgtatatatatatacattttttttttttttgagatgcagtttcactcttgctgcccaggctggagtggagtgccatggggtgatctcggctcactgcaacctcaaacctcctgggttcaagtgattctcctgcctcagcctcccaagtaggtgggattacaggtactcaccaccacacccagctaattttttgtatttttagtagagacagggtttcaccttgttggccaggctggtcttgaactcttgacctcaagtgatccacccgccttaacctcctaaactgctgggattacaggcatgagccaccgcacaaggcccctcccataattcttttacttaatggtttgacatcctctgcctttgctggtttggaagtactaactgaaaaaaaataaataaataaacaaaatgcaacaattattagcagaaaatcccacaatgggataagtttaacaacttgttttgagggcagggctgggttgtgtatttgtttgtaactataattctatatattctatagaatacttgtcatatatgctagctttggctagccatattaatcataaaatgaaaatagctatcaataatcatagtccttcagaatatcaaggtgtcctatagggagtactgcaaattctaggtgttccatcacctacataatggtaaaaaccatttactagttcttctacagcaagacagaatatctcctggacttttattttcctgcttcttctctttcagaatagcctgcagagaggtgattgtgaagttaaaatatagaagaacattaaaatcctaaaactatgaggaagttacaagagaatcaagttgtgaaagaaatattttccagcctgaataagctgcttcttaaatttgtgaaaagcttacaatttttctggacttatcattgataatgttgagaaatcatttataaaatagtgcagatttccatctagaaaactgaaaattaaaatgaacaaatgttctgatttttcaaagattagaagaacatgaattgcacaaatgtgagagcaagaagatggggtgttgggcagtgtcaaatgcgtgccacagagaagtcaggcagagggagttgagagaggacgctgagtttggggattagaagttacgtgagattgctgagaaagcaatttagctttgagaaaacatgagcttaatgtcatccctgaggatactttgaaaatggattattttaaggatcattggtgagtacttaagtcagaaagtggaggtcatgttgagtcagaatgggctcattttgagtaagtcatgccagactaaactcatttcactggactgataagtacaagaaatgtagtagactagaaggattgtatctcctttggagctaaaataattgacaagctttttcatcatagtcttgtggacctggtgaggatacaattaagatcagcttacaagtattgacactgaggattaagagatggatgtccacctggaggggtgtttctcagggtccctctctggctgtctcctgttggccattttagctaatgatttggatgagtaaaaggatggtgtgggaatcagagctgccaatttggggaagctgggatgacgagataataatgccttgtatgacacaattgagaccaaaagaaaccaggaatggaaaagagaaatgaagaaacaagcttcaaaggagacttgctggactagatcaatggactgaagctaacaagatgaagactgatagcagcaaagtactactcttgttcaaatataccagctacacaagtaccgagtaggggagacagggatgaggggctacacaagaaaaataatcagggcaattgactgtcagggcaatatgagactttagtctttctccagccgaaaaaaaaaacctcacaaaaaacaacctcatataacttccaacaattgcagtataaatgtagtgttgagcataatgaaagtaacctcaatttgtacctcactttgagtgatggttttcattagaataatcgagagcacatgctaattactaaaaagtatctttgatatttatgcaaattcacaattaagaataaaatttgattaaccatgtaactttggggttggaaaaatgaatttattcagtgtgagtggtattatagtctctgatgaacagatcacccacagagctgtggagttttgtcctgagtgcccaacaatatgttttcagagaaagatgactactacggcaaagaaccaaaatgcagacagatgaataagtaggagaaagggagaggagggaaaagaggctgggaactggtggggaaagggtggggaatgaggatcaaagactaagcacggtagagggacacgctctgtatttgaactttttttgatgatccatatagctgggtgacttttctctatgtctgtgtccagacttctgggtacagggagtgataagcgccatgcaatcgccatagtacctgatctcaggtaacctccctcatcatacactgtgctttgtaacatttcacacagcaataactagaccaccatgtgagtacttctctttcccctctaaacactaagataagtccatgggagcagggcgactgtgttggtcactttcatcactatgtctttaacgccacctatatagccatacgtaagcacatatgaaacactctataaaaaaagtttgaatttttgaacattgctcagcgatttaatagattccctacatggtggaaatttaaaaataggaaatataagaagaagaaacacctcaagttagtatcacaacattgcagcctgagaagaaaaaatacattctttcaatacaatgaggtacataaaatagtaatgaaaattgaccacttattagttcataaagcaggttttcaataaatttcatcaggttggtgtatagacgtcacattttttcccatatgcactaggttagaaatcaagaaagcagagatgactattttaagtgaaattttaaaacacacattttaaaaactcaaggggctgcacttcaaatagggtgcagtatatactgctggggtgatgggtacaccaaaatctcacaaagcaccactaaggagcttacttgtgtaaccaaacaccacctgttctccaatagcctatgaaaataaaaaataataataataatttaaaaattaaaaaaaaaaccctcaacggtcaaaaaagaaactgtaatggaaactgaaaatatgtgtaaacaataatagtattaaatattttttaaaaaagagaataccattagggcagtacctagtgggaaatttaaagccttgaatgtagagattcgaggtgaaaatagggcaggaatcaagacattgtgtatccaccaaagggagctagggaaggaacaacggattaaacctctgtaaagtagaaagaacaaagtactaagactgaaaaacgtctagcaagactgaatagaagcgagataaaaagagagcgagagcaagagagagaggaaaagagagagagagagagagaaacaaacacacactactggaatttgtaaaacccacaaatgtaaatactatagagataaaaatgatagccttgacagctctacaccaacaaacttaaacttaaatgttcaaaatcctagaaaaatataactgactcaagaagaaacagataaactaaaaaaacaaacgaacaaacaaacataaactgagtcagtggtttaaaaatctttccaccaaagaaaaatctaggcccagttggtttaatatgttaattctcacaaacaatccacaaataataccaaaccaatgtaactcctccaaggagtgaaaaaataagaaatttaccccaattcattttatgagactagttaactttagtaatcaaattatccaaggaaagacatttttattaaatataggaacaaatatgaatagaaacaaatacatttataaaatataaataaaaaatatataaatagaaacaaatataaataaaatagaaaaaaaattacaaagaccaactcattaatcaccacagaaaaacctataatgatcattttaacagatgaagaaaaagcatttgataaggtcactatttattcctgattttttttacagattcttagcaattaggaatagaaagtaactcccttactctgataaataatacctagtttaagaaacataattgaaacatcatatttaattgtgaaaaggtaaaagttttcctatttaacattgttagtgagattatattatattacatataatataatattaaataattgtatcaagcttcatcttgggggaaaattctagctcaataaaataagaaaacaataaagtatataaatattacaaagaaaaaagctgttatcattgcttgcttattcattgtctacctaaaaaaaccctcaaacctcaaagaatatttagatacattattagaattaatgagggtttttgatgattgctggatacaacataaatattcatatcacttgtatatcttaatactggcaaaaattagaacatatattttttagaaaatagctttcatgaaagccacaaaatataaagaattagtactgaatagaataaaatttgttcaaaaacactttattgaaaaattatagaaatactgaaaaataacaaagtaaaaataagtgacaagttatagcataatcttgaataggaagacacaacattttcaagaagtcactactcctctattcaatctgtagatagatttaatttcagtcaaatgccaagaagatttttagggaaaatttgattctaaaatatatatgaaagaacaaagagccataaataaccaagatacttctgagaaaaagaagaagatggaaaaacttattctattcagaattaatataaaattttggtggttaaacccatgtagaattaggactggaacagacatactagacaattcaaaagataaagagccatttgggtcatgaacagacgcattgaccagtgaaaagaatcgagatcagagaaacagacttaagtcccttgaattttcatgtataacggaaagagattttctgatgtgtgggaaaatacaaaataaatggtactaggacaaggggttatttatacatacggaaaaaaggagagctcaaactacatctcacactctacacaaaaataaaatccagatgattgaaaaatttaaatgccaaagtcaaatgcttaacacttcacaagacaatttaggggacaatctcatgtcctatggataggaaagcacttcttaaatcaaataaaataataatcaatagccataaataaaaagagacacaaacttgactatattcaacaaacttcagtttgtcaaaaaatgccataaagagaaaaaattaagccataaataaaagatgatatttgcaacacgtaagtcaccatggctcagtctctagactacatttaaaacgtctagaaatcaatataaaaaagataaaccacccaacagaaaaaaataaagaaaatacctgaatgaagactttgtaaaagaggaaacacaaaatcatatggaaagatgttcaatctcattaataatcaggaaaatgagacatagatattgttttatactcatcagattggcagaaacttaaaaatctagaaatatcagctgaggtgcccatatcagctaccaaggtaaatgtggaggcaaaattgcatatggtgggttttcaatgggaaatgctgacaatgtactggaggactctaaaacttgcttcaagactggcaaatgttttcaccgactttgagaatattaaaactagatcaaatgtgatactggtgaggagatttctttggagaaatctgttgccatgctgtgagtaacccaaccttttggaggggagagtgggttattactggtcccttgcctaatgggtgagcttcaaggagatcctcacaatgctttgaaatgatccttgcagttggaagacatggagaaggggtgtctgacctatttctgggaaagttaaattggattgtggactaggttctgactcacctggggagtgtagtgtgcagaagagaggcagcgccaggaggggctgcataatgggatcaatccacatttcctaaattagatggaactcatcagagggaagccggagtggaattcctttgagttcccggacattctgggaacaggacagaactatacgcacccagtggaatacagacactctccctcatcccctgtgaaggggctcagctgaaacccaccaaggagccccggaaagcaccgagaaaaaggaggcaacctctgccctctgcaagctacctagggacacagagggacctctctgtccacatattcaggtagggaggactgaactgaaactgaaaatacgtagaagacgtaatgtcaagccagttttgaagtattggctattatgtgggactggatattccaattcctgagacgaaacagttttatgaccaaaagtggctggaggatagtttagttttttgagtgtgacgatctctccaagtgtttgaaatgggtggtcggagaggataataaagttgtatgcttggtcaacattctgactctatattgttttcatagagggtaaaactataaagaaaagccagagaatgataccaaaaaaattggggagatcatttatggtgggcagtagagtgagtaggatggaattcaggaggcggcacaccggggctgtagatgtgctgatgacattctgtgactcaaggtgttgggtgcggtggccaatgtattgtgagtcctgattccctgatcatttttgcaagtattcaatagttagtataaaacaacacttaaagggaaaccataaaaagctagaagacaatatatgtgcctatttgatcaaaaaatccttttaatttttccaccctattttcatgtcccttgatctaaaatatactttttatgccattagcagtccaggttcctgctgcttttagacttttgaaaaagaaaaggaaggaatttttttctcttcatgccattcttttgtacatctctgccccaggcaatgagcacatacctgctgagttttttgaaagggggacagcgttgtggttgggaaagagagtatttatggggaggctgaaaacttcagtaaaatttcaaaaatatccacaattttgatagtgatgacctccagatgggcaaattactggtgacatttttttaatgatgtcctattggttccatggttttatttttattttttgagatagggtctcactctgttgcctaggctggagtgcagtggcacaatctcagctcattgcaacctgtgcctccaggctcaagcagtcctctcaccttgctctcctgagtagctgggactacaggcacacaccaccacgcacgcttaatttttgtattttttgtagagatggggttttaccatgttgttgaggctggttttgaactcctggactcaagtgatccacccgccttggcttcccaaagtgcagggattacaggtgtgagccactgctcctgccggtttcatgctttttataataagaatgaacatcttatgtaataataaataaataaacagaaattatttgctttggatgtagcaaatgtagatttagattgtccagagtcaggagctaagcctcatttttttttgttttagctcagtgtagagtgcattgaaggtgtcctaaaaataattccatatagtaagccaactttaaaccctgctcacagccagatctgccaagtatgagccaggtaaaattaccaaaaagggtggttctgactgacttcttaacaataacgtggcttacaaagactgatatgaaatagttgatccaacccaaacactttgctcatttcccgaaattttccatacaaacatatacaatgtaccacaacataaagatcataatgaaaggtttgccttttattcctttaaatgaccatatgtttagatctgatgtactgacagcgataattctccattaagcagaaacctaataaaatttgaaaaatagtgattttatatttagatgatactcagatcttctgctacatatgtggaaaatggaattattgctagaaacactgtttaaagattagggtatgaaaggagtattaggaagtcaggaggttctttctttaggaagcagcttatctggattcattcaaagagctttaggccagtttgaggtctttctgcaaaatgtaaattgctatatgagaaaccatatatagtccaatgatgaaagaatgcaaagccttagaagcacaggagacaattccagtatcttccctaaagttctgacaaaaaggaaaataactatcaaattattcgactcgaatgcttattatgtacgtataagtcagtcggcagatgaagagaggagggaaatatgacttctacccctagggaactcacagtcttgtgggggccactaggggtggtggtgtgacctgcctggagcagcgctaagtatagacttgtgagtcaagggctatcaaaacctaagtaaactgatggccattcagagaaggtagagttccattccacagtttccaagaagggctgtttcatggaggaggtcatattgaactagacctttaaaagttggtataatttaaaagcaaggatatggaagcaggaagaatgaaagtgagcagaggtacaggagtgaggcaagggtgagcagttttaactttttaatggtggtattataaaatacacatcaaaatttgccatattattattattattattattattttggagacagggtctggctctgttgcccaggctggagtgcagtagctcaatcatggctcactgtagcctccacctcctgggctcaagcaatcctcgtacctcagcctcctgagtagctgggaccacaagcatgaaccaccacgcccaactaatttttatatttttgggagtgacgagatcttcctatgttgcccaggctggtctcgaactcctgaactcaaatgatcttcctgccttagccccaaagtgctgggactacaggtatgagccactgcacctgaccgcatcttaaaaatttttaagtgcacagttcagaaatacatttgcattgtacaaccatcagcgccacccatcttcagagtatttttcatcttgcaacagggaaaattcatatccatgaacactaactcctcattcttcctcctccccaccccgggtaaccactatttcagtgtctctatgattttgactgctctagggacttatataaatgagatcatacactgtgtatctttttgtgactggcttatttcacttagcataatgtcctcaaggttcatccatattgtaacatatgtgaaaatttttttccttttgaaggctgaataatatttcattgtatggatagaccacattttgtttatccattaatctatccatggacacttgggttgccttcactttttggctattgtaaatagtgctgccataaacgttgaggtaccaatatctgtttgggtctctgctttcaattattttgggtttatacacaggagtggaatggccaagtcatacagtacctctagttttagttttctgaggaaccaccataatgtttttcatagtggctgcaccattttaattcttatgaatagtgcaaaagggttccaatttttccacagtctcattaacacattattttccggggtttttgctttgtgtttgatagtagccatttaaattggcataaggtataatttcattgtggtttacattttcatttccttaatgattagtgatattgatcaatattttatatgcttgctggctacttgtaaatcttctttggagaaatgtttattcaggtcctctgcctatttttttaaattgggttgatttttttttgctgctgtttaggtagagaaggcaatctttgaataccagtgatgtttcactaatgctgggccattgatttcacgagaagttgtatgaggtattagaatgtgagtttggtttcaatcatggctgaggttgagtgccttttccaaaattcaatgtgaatttcatcagaagccacaaagggtccaggagcaagaacatggtgtgactgctctctgctaaagaatttcagcctgatgacagcaggctatacatgagactgacacaagaacaggtggaaagggagactttccactggaaaaaggtgattctaacatgcagaatcactttcaaggagcaagtaagcagaaaaatagataatggcacagtggccaggcaagaagacactaggtccagaatctgaggttcaaatcctggctctgtgagataacaacatgccttggtttccccatgctactgaaatgccagtggttgggtctaggtcccactgctcactgcacagaaagccaaccactgagacaatgagcattgccagggaagaatgctttatttgggtgctgcagccaaggaggtgggagatcagtcttaaattcatctctccagctgactaaaattggagggtttatatagctgggaagggaggtagctacctgcagggaaaacagcaattaaggaggggtaaggaagcaatcatgataaatgaggagtctggtgtctcattgtctgatggtgatgtggtgagtttcagtctcttgcctgaaggtccgtttcctaactcagatgactgacaaatgttaagtttcaagttttaagaccagatgggtcaatttctatgtttattcaaaaaccctgtaaatatcagttctatgtggaacttgagctggtttcccccagttatcacagttagggttaaatgatgcaatataagtaaaacaccagcagtgtctgacacacacacagagtgcatgacacaagtggtgtgttgggacaatatagctcagtgaactccctttgtctactcagttatattgagcaatgaggcatctctgaagatgccactttgctacctctcccctgataatttcaccagatccagccatatgagcactgcaagtgggggcttagcttaaatcattcctcatatttcccttgcaggcaaatcatttggcaccaaaacaggcacagaagtccaagtcctgctgccagctccacgactgatggcacagacagacttcaggattagtcctttaatctctgtcctctattaaatgaaggtcatcatgctgctgcctaatgtaaaaggattgtggggattttcatcattcattaacgattatcttattctttgaaaccccaagaaaactatataaattccaaagtctaataggtacacaagggctttattatggataataataaaattttttttttcttttttgagatggagtcttgctctgttgcccaggctggagtgcagtggcgtgatcttggctcactgcaagctccacttcctgggttcacaccattctcctgtctcagcctctggagtagctgggactacaggcacccaccaccacgcgcagctaatttttttgtatttttagtagagacggggtttcaccatgttagccaggatggtctcaatctcctgacctcgtgatccgccctcctcggcctcccaaagtgctgagattacaggcatgaaccactgcacctggccaaaaaaattttttttaatgcgctctcttttccatataatcccaaggtcggtgaatcacctctaagccaggtgtttattttagctgatactgccttagtgttggcacaacttaaatttagttcaactaatatttgcatgatctttgcacaacacataaacgcccaggaacaggtggtgctcttcggtggtcaacaccagggtgggtggctatggcagggcacattctttctctatagcccaggtcactggcattcaaagaaatatttttcaatctctgatttttctctggaagtaggaaaatgcttccctaactgctttacttataagggtgtttcttgctaattctgtgcccagagtaactaatggggacatagacatagacatcattcaaatggcattttctctttaccataacccatgctttaaaatgaaataaaccaaacccatgccttaagacaacaatcaagaaatacattctgcctaaggaaaagtcctgcgtttgaaggtttttgtccaaataatctgacattgtggtcatgaaacattgaaaatagcatttggagcagtaagtttaaaaaatttagaaggactaaaactacttgaatgcttgttgggaggtttacaatgtagtcaaacaccagttaagcaaaaataaaatttactacttaactatttacattttctaatgtgtggtttcatggaattgttgagatagaagtagacactgaaataggagtacttaaagtaataaaacaaagatttttataaagtcatttctgacctaattaagaaaaatataatctctatcacatatgaaataaacatctttagaaaaatgcaatgtcaaagaaaacacttggaatggccaacaaatatctactacagatagaaatgaaaatatttatgttatgtaaatgttgggcatcaaattgtctccgaagttgccttctagagaactttctttagttggtatattcttcctatgaatcaaaggaatacagtgttatgatcataagtaatgagggacatgagacaattttaaggattttaggaaagtagggaagcagtgaagtgaagggtaggcagatacttcggagggtaaaaagtgtttttgattcaaaagaaaagctaaggtagtttgaagaaaacatgcatcatctactagttaatctgaggtacaacgaaggtggtgttattttaacagtgttcaaaaaagaccaattaattcttcggccatacagaaagaatggaaagattgcataaaacagattctgaggaatacaaatcaatctagcaaggaactttatgatgaaggaccaatgtaagcatagaatgcactgggtttttttttaattattattattagcagcatcattggtatggtgatgttacctacttttggagtggagctagatatgagagagctgcatgtcctttgaaatttatttggggtaaatagtgaacacagtatctatgacgagttaatgggtgcagcacaccaacatggcacatgtatacatatgtaacaaacctgcatgttgtgcacatgtaccctagaacttaaagtataacaaaaaaacgaaagaaaactatatctaaataaaaaagaaaacattctagaggtgcagaattcaagctagaagaattgtgtccttggatgtcccaaggtcaaattttaatatgtcattgaatgaaggttccaatgtttggaataatgaaaaaagtcatattgaattttgtctttgctttcctccctccccagtgtctaccaaaaaggctgggtaaacattcatgcaagtcaatacactgtcacagccacaattcgtcccagcaatctttcctggaatagtcacttaatacatatctggtgaggacccattggcacttttagagcaatcagaaaacacctcaaattgctcacatctagtgtaggagaaggctaatccatccctgtttcatgaagcatcacttcaatgtcctggaacagtcattctacccaaatcttctgtccctagagcccaacactctctgcatcttcatccattcttcacagggcttgatttccaagactctctaccatcttggccacacaccatgttacacattcactatggacactgcaccactgtggatgctgcaccactgcggatgctgtaccaagagttctgaatccaagggcagattgttatgaacagcccctttaaaagtcttaaacttgatacactggtctgtcagcagatgtgcagagcctcttatgggagacacaatttttgactcatgtgattcaatgtccataaatcttcatccaaaagatgcccatagagacaaagagcagagtaaagtccttgcagcagtgtttctcaaacttagccacccaccagaactgcctggggaactataaaagatacccatgctgaatcccacccaccacgattctggtgtaatgctatggggtgagatctggacatcaggatgtttggaatctccccaggctcattgaacatgcaaccaagactgaagcccactgtcctcagtaatgtgcccagcccggccttcctggcatcccctcatgggtacaggatgacagtttctcactctgaccctttcctttattcaatacagcacagcacaatccaagagggtgagcactgttatgacagagaacctggagtcggacctgattaaatgtcttcaacaaaaccagtgccaagccttggccattcaactatcaattactactttcaacccaggttctaaaggctcttcattagaaacatctcgggttggtaatgattggggcaaatgtgccctttggatttgattgctaccatgattattaattaaccaaattgtagagatattgagtacatttctccctcttgtttgtaagaacccatgagagacaaggccaattgcagacaatggggacgtcctcatgatagtgagatgaactgcctagctatcttccaatatcgttacttccctccagttttgttgcttgcaaaacaacagaatcttctctccatgaaatcatgggtatcagttaggaagtagcccacttggttctggatttcgtttagagatttaagatagtaacagagggtgcaggatgacgaacagcatttgtacactgtgtctggtagtggaaaatacccaacagtgtactgtatgctgactctgtcatttcctgccttctctcctcctttcttccctccctcgctccctccctctctccctccctccttccttccctcatgaaagcatagctcctttgccattctttcctccagtcacaagccatctacttatgcacatcaccatgctcatgccattaccaggggactttctatcagcatgaagacatgaaaatgcctggggaagaaaaggtgtggggagcaggcagcacccctgcaactgcccggtagcatttatacattgctcttccaccttggtttctatccatggctttcctcgtcagagcatgttcactttaacctcctctagagcaatttcttggatccttcaagggcttgagaactaaacacaatttcaaaagaaactgagtaggcacctaccttctggaaacaacatccatagaaaagacttgattgctatggtctgatttatgaacctgtggctcatatcaagattagcatttgcactagcattaaggtattttcattgagatcatttatgttttgaaataaatactacaacatcaaggaactgtatcagttggagaatagaagtgtgtatgatttgtgtatataaacatgcacatcaaagcatttatttatttcagagagttgtataacaccgttagagtaaaaattgagtgattctcttctatttctgaccctacttctaatgtcttctctgtccctctgtgcaaaaccatttaaaccttttatcttggtttcctttgtgagaaaatggggataatagatacccctgagccattctggagacgtgttttgatgccagcccagttatgtgattataggagaaaaaagctttgagcttttggcacttaggtgctacataaatattattagcaagctgctgagattttatctttggaaactaacaagcatttctcttctaaagcctcatatctttagcccctggacacatgttcctgatagctctctctttacagagatccccttggctccacaaggatagagagttctttgctgagagagtcactgccgcacgctcagatgaaaggtattcattctgcttggcagagtcatcggtagagtagctgctgatcccagcaaggcagggtgggtgatgggaagggattagattaggaagaaaagggatcctcttgttctctcactgaggggactttaaacctgcagaagcacatcagtgagcggactatgggtaagtgccaatgtgcaaagtcgatggtgcacacgttacaggttggtgagagatgatgccactcagacctgagtgcaccgtggaactctcttgacttctctctgcaaatgggttgctcctggatgtatagagttattctacaggagtcctgctcctaactcatcagaaacgtaatgtcctctgttgatctcaaaggcattttcttctgttaaaagtattatccattcagcaatatggagaaaggtcatttgtgaaaataaaatagaaatgtctgatggtagtgggggtggggggtgtaatttcctccctatgtgagtagcattaagttcactcttaatttttttcttcatttctgtaattggagactgatttatcaagaggatatagaattcaatgactaattccattaaatgcttaaagaataaaataaaggtagaactcaaaaggcttattcctgattagttttcaagatgtgtctaggcacaggaagttaaaaataataccacagtgaatgctctgacccagtgctaacaaaagcttctttttttcggtgagacttggcatagaaaagcacacatgtcattcagcagtcctgaaaaatgatgactgagatttggactggttttccagggaataaaattgagtgactttttaaaaagttctactcctagaatccgggatctaatcaatccaatatcaacttcaagggaataggccaacaaccagagatgaaattagaagaaaaataattagaatagcaagcataggttggttttccatgctatgattctgcagcaaaggtggtaatttgggaatactgatttggggaatctcttgtcatgggaataagttgtcagctttgctgagtgtctccggtgagctaaaactgattaaaacagagtgctggccctggtatgtaagctctaatctatactccatatctaccactagccattttgaaggaggagagttccctgatccacctcacaggaagtgcaacaggcgtgtggctcgcccgcttggtcgctcaaacccctgatgggagatggagcacacagatgggcaggtgcgggggctggagtgagtgctttgggctccagccccgcagtagtgtctggggagggggggtgcctgcagcctaaggtttacaatgctcttttagtcttgctgtctgcaaatggcttaagtgttaaccagctcaatagaccctctgccttttcacaagggcagagggccagtgtgacagctttctgtattcccagcttttgcccagtgtcccagaagaattgggtcacacacacaggcttgaaggatgaatgtggggttttactgaatggtggaggtggctctcagcaggatggatggggagctggaagggggaatggagtgagaagatgatcttcccctggagtttggtcatccagcagccaaaattccctctgaccacccccagtttaactcctggcattcacacgttccttcccttctctctttctctgccgtgtcatctgccatttgtctgcttgtctcctcatctcctcatctgcttctggagcctggggtttggggtttatatgggtacaggatagggggacatggcaggcaaaaaggcaacttttcccacttagggccgcgggtctccaggcttgagggtggggactttgctggggaactgccttctttacccagtatttccctgtctcctgtccatatcaatttcatgaatgtgtggtcacaacatgaacccagaatttggaggttggaaagtaggagtgaatgcactcaatctactagggtgccaattcgtagcatctaatttggtaatgatgaattagcaatagaatcttttggtaggggcagacttggcgaatcttcaaatgtagcaggattttaaaacgaatcgaatactatctctcagtcaatacaattacctccaccactccccagttcctaattcaagggttatattttcagtaactttatgtattcaaaactgtattagatgctagaaatacaaagatgagtaagacattattaatctctgtccctaaaaagatgaaaactagtgtggaagacagccaaaaaattagagattaatcttatctagaaaattctagaaacagaatgaagcacaacagaggagtattttaggcaacctcaaggcatttaacccaacctggagcctttagttaggttagaatatggccaggaacaggaagtcaagattcaacaaattgcaacactgcaataataactaacatcactttttaatagtgttttctaatatgaaatcaaaatctgcctttggataacttttactcactccctggtcttgtttctgttctctgggatgacacagaatatatcgaattcactcctactccgcttagtactgagaaggcaaaaattaaataaggcattccaaattcttgtctgtataggggccaagggaaagcttccccttcacgctctgaaggtttgctgataaccaactaacaaaaggaagattcacaggagaaaaagcttaaatatttatttgatcacagttgtatatgacatgagagcctttagaatgaaggcccaaagatacaggggaaaccgtccatttttatgcctaggttcaacaaagtatggacagccatgtagaaatagggttggacaaaaagggcctgatctaaagctaatggactgagtgtggaaacccagccaggcctgtctgtctagattcttcttggcctgtctgagcagtgcttcttccttctggatgtgggaaaaattcaccatattccttaggtcccctcaaaggcccctctattcattctatttcaggaagggcgagaggaccaatgaataaccaactttctggaacggaggtcttaggacctacagtcaaacaaagtaggtcagatcatttcttcttttgttttctcttttcaagaggcagggtctgattctgtcacccagggtaaagtgcagtggcctgatccatggttcaccacagcctcaaattcctggactcaagcaatctgccagtctcagcctctcaagtaggtaggactacaggtgcatgccaacataccagactaattttttaaaatgtttgcagagatggagtcttgcaatgttacccaggctggtcttaaactcctgggctcaagcaatcctcctgccttggcctcccaaagtgttgaaattacagatttgagccaccacacccaatccagataatttctgtatggccagtttttacacaggaaggtagagggaaaattagagtccgatttttaggttttatggctggctttggggaaaaggggttctggtttctaggacccgtcatggggaagagggattctagtttctaaggtgcctccagggagaatgggactcagaaacaggagggcagaagaagctctgagagaaagttttgcttctgaggctctttcagaaggattgcttgagctcaggagttcaagaccagcccgggtaacattgcaagactccatctctgcaaaaaattaaaaaaaaaatagcctggtatgtggcatgtacctgcagtcctagctacttgagaggctgaggcgggaggactgcttgaagccaggagtttaaggtgtggtgaactttctgaggctttgattttggggtactgctttctgagccttagacctagaatcagtattcaggtcatgggggaagttcatatgagaatctctattttttaactatcaaactgtgactcccacatgggccacttggagatgctctcactgataggcctgtcatacacctttggtgggtagggacaggaaaagagattgggtagcataagataaagtcctccccaccccacccatttcaataatggggtacacatttatcatatgccaatctgagacccttcctgaacttcacaattcatatagtgttagagagtggtctatacctttctctatgacctccagcccacacgaggttcagtgaccctaatgccacggaggccaggatgctgtgattgagatgatagcaggggtaaggagggtcttttctctgctcatggagcactggaaggaagtatctttttgggtgctggacagtggggaggtcaaggctgtgggcagaggaacactggagccaatgttgggaataattctcatgcaagcaaagacgtggtgtttggctggccacaaccccagaccttgagactccagttccacatgggtccaggatattgtttccatgtacaatatccatctgcgagaatccagcactttccaccacctgccgtggtatggctgtggtcccatgcaccatcaccttgggcttcaacttctgcaatgaccccctaattgataacctggctcttgagttgaccttacagcaaacattctttttgaagaaaagtcatagggcttcaccccactgcccgaaaccctccactattagctgccactgcacacagagttgaagcctaaggcattgcacttacacattttcatgttatattattgcatacatgttattagtttctgagtagccaggagagcattttttctgaaattaaacatatcgaatgcaccacattctttaggtcccctcaaaggcccttctattcactctattttgggaagggtgagggaaccagtgaataaacaaaggtccttgctttaaaggctgttatgaccataaagtctgtgtatttcacagcccatgagagcagcatcctgagatattatttattgtcaaacttctcttctcaggccacacatcccactgcaatggggaatgggactgagcaaattgcaagttcttggttctatgttccagttgcaatcttgctttcagttttcctgctgttaaaacagcctttgctggtaggactgtgggaagtgagaatagatttcattttacctgctgtgcatcagcagaaaaaacaagtctttcttttctcctggcagctgagatttctcagagttcttcctagaattggatgttatatatgatctactttactcatgcccacctgcatacacaccaaagcctgatgagcggtgcaaacccacccaatgttttcccaaaacagaagtaacatgagcacatgtggaactgtcagaggtgtttgaaccagagcaactgcatcttgaataggagcagggtaaaatgaggctgagacctactgggctgcattctcagatggttaaggcattctatgtcacaggatgagataggaggttggcacaagatacaggtcataaagaccttgctgataaaacaggttgcagtaaagaagctggctaaaacccaccaaaaccaagatggccacaagagtgacctctggtggtcctcattggtacactcccaccagcgccatgacagtttacaaatgccaaggcaacgtcagaaagttaccctatatggtctagaaaggggaggcatgaataatccaccccttgtttatcatattgccaagaaataaccataaaatgggcaagcagcagcccttggggctgctctgtctatggagtagccattcttttattcctttactttcttaataaacttgctttcactttatggactcgacctgaattctttcttggcgagatccaagaaccctctcttggggtctggatctggacccctttccagtaaaagaactattcattttatcttttggtcatcaccaagcaaacacaactataaataaggaaaataatatatgattgtaattttactcataatcccaaatgtctttcatgaccagcacacctttggtgtattgggtctaaatcaaagaaaaatttgaggagttgaatgaatgaggttttgatatcttaatgcactttggagaaaaccaacggttgcaaaaagctaaagaaaacgaaaattcattgtttacagatcaggccatgtgtttttcatttctgcaatggcgatgtggttgattcccatggaacacaatgagagtgtggtcttctcctttgagattgtatttattgataaatgcaaaaatgctaatgaatgctaacttgctggttctccatggccttccttcctccctccctttccaagaagggtgttgtatctgtcagaggcatttgaaccagagtggctccatcttgagtgagggctaggaaaatgaggcttgaacttgctggtcggcattcccagaaagttaggtgttcctagcctctagatgtttacagttaagggaatagattgataacgttcactaaacagacccagaattgggagtgtcctgatatcccgatatcttgagaacagaagcattcctaattttgctttaagataataatgttgattcttgaaaaatatagtaattaagaaaattaatcctttatcacaaacccttgtagcagagcacatctccccatgaccttttttaattctctatataaacaagcactgtacctaggggtgggtgtgttccttctcttactttctggaatgccctactctgtctatggagtcgctgtactttcaccactttactcttttaataaacttgctttcactttgcactgtggacttaccctgaattttcttgcccaagacctaagaaccctctcttggggtctggatcgggacccctttcctgtaacatatccacctggtcaatttagaaggcagctgttatgtttatcaggatgaagaaaataaaactcttttacttcaaaatgtatttctatgatacagtttgagacggctgttcagaaagccagcaaacaggaggagccctgcaaagctgtcttgtatggggcgatttgcgtctgcagataaattctgcatggaggcagccaggctttctcggagaccatcctccctcgtcttactgtaggaaagatggacagagagtctgacatctttaaaggtctgaaagaaacatttgccatctattctctctgacgcctgctacccaggaggtttcatctatatgacaagaccacctctgctagcttggcctcttcttctcttcctcccatagcctgtgttgtcacaatgcaagcctccattcttcaacctcaagatggtgtgaaagcttctgcactccatccggggcatggggttgggtaatcaccctattagtcaccctacgatgctccctgtgtgcaggatagtatatttgtttgatttttctccaactaattttgcctttcatgagttgattttccagcaaaacttcagagcaaaaatgaatgttttcccttggcctctgcaaggataatgaattcagatgtaacatgaaaaatttaggaaagattgggagaatttttttttaaagatccaggaatttatcttaggggaaaaaaaaggaatagtattggaaggaggatgcaggaagaatgagagagagagagagaaagggagattggggaaagtgaggtggaaggagggtttgtggacgtctgacatgctggagagatagtgggaatatgagcttaagaggttctagtgtgtgcctattcgagacactggtgaaacaatggaattattttttagagcttctctggatatagaagatggtttccatttgaatgggatgccaccatgttgagccaggaaataaggctttctttaaaggggcctcatagttcgccagccttttgaaaaacttgccactcaggtgaccatgctgggtctccactcaactattcaggttggctgtagtaattacttgtcttaacctaaccttcagctctttctctcccaaactgcaattatttgtccatgagttagagctgtcctcagcacctcaccttcatcccctgactcccatctcaggcagtttggctgctcaaacttattatcactgatgccaaaaggtgaagacttctcatgtcttcagcacccagggtagcaaactgcaggaccagtttaaatgttaatagcatgtctgtaatacacgcacaaccacatataccaccatctttatgaaggcttaagatgatgtattcattttccctgtcatttccataggaagctgctctttgtcactcggggaaggccccagttccctatccaaagtggcatgaaggagatgctctaacaaaaaatgaaatgcaattagggaactgctgttcctgtttgaatgcttaacatcagcctcatggctggcactatccatcccaaatactggccaatgtagcaaagtgtgtgggtgatcccagtgtctgaacccagcccagagttggctagctcatgccccctgtctattagcaattggatgtgggattacttcaccaccgtggactggccactgagaggtggcccagagccattgtgagaggcagcctgttgggttttgagaatggctcagccaattcatgcacatgtctgctggaatcgccagggcaggggctttctggctcttctcctgaccttcagcatatatagagaggtcatgaagacagaggaatgcttgatgaagctctcagggtctttttattgaaccatggccagtatcttatcttttctagctgcaaatggtattcctgctcaaacacgtgtccttttattatataaaaaagtaatgtgttgtctttttattgaaatggcaagtgaatgggaaagttatttttgctttggaacaaactgatagggaagaaaaatcatcccaatgggccgcctcaactggtgtctaactcctttgcgacctgaaagtaattggaagaaagggcttttgctatagactagagaccctcagagaccaaaatgcatatagtgttcaccccacaaatgcctttaatgcacccccccttagtttctatcacattgccatcccaattactcaacactgccagagaagatgtgctctgtagaattgtcatgaactgttggttaaaccgtgatgctttgaagtgtcaatggcaaaagtttgttgttgcaaatttgctcaaaactatgcacatgaaacttttgtgggtgggctctcaggtttatcattaatcatgtcttagtgatttattattatggatatgagtatgtcatatccatatgcgtatgtcaaaactatagctataaatgcagatgtgcacattggtgttgaggatggaaccagcaatggctgggtatgatttctgaggacattcgctggaatgttgcattcacaaaatgcctgtaatcctacctcgatttctgagacttgctgtaaactcataaaagcaagtgaaggatagactaccacctaattttcagaacaatatagtatggctgattttatgcaaaattaattacagcattacagactgaattgttctttgcccaagtggttttctcatccacctgcaaagtcatttcatcccttgccattgtcagcatccttgggctttatcagtatcattcaaaccacttcatcctcatcattaacaaactggactgtgggcaccatctcggccaggtcggtactttcctctgccttccttctgctggtactgagataaaggaggaactctgtcttctaccttaagaatccatactgaaggaagggcatggtccgaagtccacagctgttttaaccatgccaagagaagtcctgagggcaaaggtgatgcagcacatgatgatctcagagcccttctgtatgtgtttgagatgtccgagcttaccaatattgcatgaagtacatcctgtttctcaggctctggattcatgaaatagagctgggaaaatggagctctggaaatgactaagacttgatttaaaggttaaattaaaactaggagtacagcaagggtaagatttcccatggtagctacatgatgggctaaatgtatcctcaagtttcctctgtagaggttggtctcatttttaatcacaaagcgattcacaggtccagtcaataaggcgatgggagcagtcaagaccaaagcatattaggatgtgagaatcactatggagcacatgcgtatgattctggcctccactgccagaatccctgggttcaaaatttgacactgccaggaactgctcatgtgaagaattacagcaatgccctgggcttctattgctttctctctgaaatgagggtatttagagcatgctattgtttctggaacattacatataagtaaaggagggatttcctcttctggccaagaaggaataacatagactggcttaactctcgtacctgaaacaaccagaaaaacaaacaaaatatatgaaagagtggtttcatgactctggaaataaggcagtgaaggacagtgctccctgagagccaggaaactaacaaggtgaacaccatgtttgacacagctgactgccttgacagggctgtagggcacacaaaccactctggggaaagaaccatctgaaatagagaaaatagtgcatggtgctcacacagggctggaaagagtgcctgtttccaccagccagactgaaaaaaaccttgtaattcatgagccatttggctagactactcagaaaggtcttgtgtgaatagtggggaatatttagctccaggctgagtcctgctctgaatctccctaatgattcacaatagcaaggctccaatgttgccaattgtctccaggtaacttaacccaaactgagcagatcgctcaaaaatatttgcaggaatataaaaatatctggcgtcttaaaaagaagattcacagtgtttggcatccaatcaaaaatgtctaggcatgcaaagaagcaggaaaaaatgatacataatataaaaaactcatcaacagacactgactcggaatggatgcatatgtgagatcatatttttggtctcaagattttgctgtttgtttgcttctcgaagtctcgtggttttaggttttacatacaggtctatgatctatcttgagtaacattaggatgcatgtatgtttatttgtatgtattatttgtaggcataaaccaaagttcattttttttgcatatgaatatccagttgttccagcaccatttgctgaaaagactatccttttttcactgaattgttttgtacctttgccaaaatcagttgtgcatatatatgtgagtctatgctgttccattgatctacttgtctatctttatgccaataccacactctcttgattactgcagctttctaacacagcttgaaatcaaatagcatttgtctttcaactttgttctatttttcaaagttaaacatcttaacattattaagtcttccaacgtacgcccaatgtatatctccccatttatttatgtctccttttatttctctcaagaattttttgtagttctcagagtacaggtcttatacatatcttctcaaatttatttcgaaatatttcatatttctgaagctactgaaaatagtattgattcttcattgctagtatataaaatagtacatgatttttgtatattgagcttgtgtcctgtcactttgctaaactcaattaataatagttctagtagcttttttgtatattcaattggatttttgattatgttgtctaggcataaagatggctttaccacctcttttctaatctgagtgccttctgtttatttttattttattactgcactggttctgatctcttgtaaaacgttgaatagaatggtgagagttggcatttctattttgttcttaaacttaaagaaaagtattaagtttttaccattaacaagaattttagatttttagtagatgccctttatcaggttggttgaaggagttcctttcaattcttagtctgctgtagggttttaataagggctggagtttgggttttttaaaaatgctttttctacatctactaagatgatcacattgtttttttgtttttgttttttcgtcttttttagtttgacaatattcaatattgtgggtaacactgattggtcttcaaatgttttgaaacaatattatgtttcaaattactttttacttctgtgacataacctagccttctctctttttttttttttgagacagagtcttgctctgtcgcccaggctggagtgcagtggtgcgatctcagctcactgcaaggtccgccttccgggttcacgccattctcctacctcagcctcccaagtaactgggactacaggcgctcgccacctcgcccggctaacttttttttttttttttttagtagagacggggtttcaccgtgttagccaggatggtctcgatctcctgacctcgtgatctgcccaccttggcttcccaaagtgctgggattacaggcgtgagccactgcacctggccgacataacctagccttctttgtctgagtgtgtgtgcatgattaaatagatcacagtatcacattctgccaggacccacatggctgcaatgtattcttttactagcagagtagcacctgaatcttagcaacgcctcagaggtgatggaactgaacaggagtgaatctgcccaggcatgaacggctcccttacaaaacagtgtgattgcagtttgtgttctcgggtgtaattacctaggaggatttcttcagtcttccataagagaactgttgtaggtgttcttcctgcttttttaaaaactgagagctgtggccagcctgtcagagcacgtcctcttctttcgggcatattcaggatgtgcttactggtctgttcaccctgatagaagttactcttctctgtctgctatatagattaacaccactcactggaacttccatttcccaaaattccaattctgtcttaaagtcttttctaagcatggcttctctctacatatttggtgcacccttcagtgattacaaagatactccaaggtcctgccatgatactgaacaaaattcagatgtagcaaaagtgatcaaggtaggcagcaaagggttatcattgtggggatgtagtacaacctcccaactgtgaagccttgcacacatcactgcatatatctgtgcttgacttttctgaacctgaattactcggtgaacagggtaccttgcagtttgaatgaccctcaagctctcagaacttctccaactttaaagcgccctattctaagagagaactgtatttgttaaccccaagggagacaagcttgtcatttcagccttccttatttaaaaaaggtaatttgtgctgattctccagtacaaagcacttaagtcaattcatcatagaaagaccattaggtgtaaagtgataaatatactatgtcaactttgaacatttatttagcacttttcactgtaaaaacttcagatttcacaggtcagcaaagagagggttttgtttaattgttttgcatcatcagatatcaatctgcagggtaggggacatatcatttagggaaacatgaaagggaaggtaggcacacctcactttacagaaatttctgctgaagccctaaattagtgtgttggtctcccccataagccttctggcttttagagaacagagactgcttattcttatattaaactggagaaggtgttctataatgcataacctcttagaactataaatgtgtattgtttctctttatctcgaccttccaagggccccagcagcctgcccaaggcttcactatccttgcaacaatcatggcacggtagtgatgggaagaaaagctgcaggctcagtgctccttacctacagggaatagtgctgattcctgttgcaaagcagacccattatcagaggcccatcaagtcacaccattcccttccctgctgtctcttgggcctgcaatgacaaagacatggcagaaacgccactatccctgctcctctgctttggccagatgccactgatggattgttcaattcttccctgcagaatcgtgccctcagatccttctgacagtgtgccagatatccagcatcacctttgcagtttgggaagtggcacccagcatccacccagcgtgcctttcttgatcttgtccatggtgctgagattctgtgtggcccccatgcggttggtctcgctccatgggtctccatccagggtgatgcccaccctcctaccacctgtgaacatttggtaatatctagagacattgctggtttccaccattgggagtgggtgcaactggcatctagtgggaagaggccagggatgatgctgcacatcccatgttgcatagacccccctcccacagcaaagaatgatcttgttaaatgtcagtagtgctgatggtacacagacgatgtcccacagcaaagaataatctttttaaatgtcagtagcatcaaggttggggaactctcgtgtgtctgacaaggaaacctgcgattctctctcctctaggattggactctgtcccatggtgctgtccacaatgactgagattttgacacctagatcttcccttaggaagaaatctttcctcaggaaacttaattatcccgccaatgctcaccagctggagtttgacttcatatttttattggtttcctggaaacctctcattgcattccctcaggtatccacgatacccaaaccatgcacacgtgtgacacactgtgtttagcttgcacagcgtctcatgccagaaccatccccagcagattcagctcattctcccatcgcagccctgctcccctatgcccagttaccagcaggtctcccagctgagcctgctgcatcaggataaaaccgtggccacgagccaacactgaaaacttccacctgcagaagttggctcaagtgctgcctgctaacaaccgaataagtaaacctttgctgcaggacctaccatgtacgcaggtgtcttctaatatttctctgatttttctgagcttatcctaagataactttttcacacttcacttgcaaagcaggaatacatatatatgtgtgtgtgtgtgtgtgagtgtatgtatatacacatatatgagaatatagagagaatatatatatattcacacatatatgtgtgaatatatatatgagaatatatatgagatatatagagagaatatagagagaattatatatatatgagaatatagagaatatatgtaaaggagaatacatataaagagaatatataatatatatagaatatatcctatatatttagaatatatagaatatagttattctatttatatagactacattatagtctatatatagactatatatatagaatatattattttctatatatagactatatatatagaatatattattttctatatatagactatagaatatactatattctatatatagactatatatagactatatatatagaatatattattttctatatatagactatatatagactatatttttctatatagtttatatagactatatatagactatattattctatatatattttatataaagtttatatactgtctatatattgtctagactatattattctatatatagtttatatatagaatgatattgtctatatattgtcctagcaaactcatagactttattattgtttgatatatagtctagtacagatagacaatattatcattcaataaaaatatatagatatatataatagatacatagtctagactatataacaaatgataatatagtctttctgtactactatatatagtctatatattgtaaggaggaagataatggctcattttttatccagggtgagactcataaacatgtattactgagtacagatatctcaatagagacaagaaaattcaaattactggcaaggtactgtacataattgtatccaaaaaaatcgggctattttgcatcctagccaagttaccctgcccagtcacaagatcacacaggccaagtcacgtgatcactaaagctggcatgagaggccccgactcatccagggagtaagagagtgaagtcagcagtgggaatgtgggagcagctggtctgtgtaaagatgttctggggaaaaactgggtcaggcttggaagacaagggaagcggtaccagagaaataagcttgactggaacgaggcagcaacagaggcattaatgcagctcagttctagagttatgggaactaaaaggtactccgcttggccagccaccagatgaaatgggtaaaaagggctgcttgaaatgtacaaaccacgtgactgggaagatttcataagcatctatctgcatgggtttgcccggactgacataacaaagcgccacggaccgggccgcttaccacagacattgattctcttgcagtcctggaggctggaaatctgagacaaggtgtgagcggggctggttcctcctgaggcctctctcctgggcttggagatgctgtcttctccctgtgtcctcacatggtgttccctctctgtgtaggtctatgtcctcatctcctcttcttataaggacaccagacctgttggattagggcccactctagtgaccttgttttaccttaatccaatcttgtccattctgcagccctagggccacatgcagcccaggacagctttgaatgttgcccaacacaaattcgtacttttttaaaacatgagatttaaacacggacctgttttttcactcatcagctattgttagtgtattttatgtttggcccacaacaattcttcttcttccaatgtggcccagggaagccaaaagattggactccgttgccttaatcactcctttaaaggccctacctgcaaatacagtcacattctgaggtcctgggggctaggacttcaatgtatggattgggtgagggggcctcgactcagctcatgacaaaatacttctaatggtggttctcagtctttattttgaggaaagtggtcgcttaaataacgacatatggaaaagatacaatttaagtaatagagacttcccaggcaaaccccatgtagggggaggaatcgaacatatcaagggcattccccaagtccaaggtgatagaggtgagaaatgctcacttattagtgccaatttcaatctcctgatagattttcatttagtatgctgtaaaagaaaatatccctgcagacactggcacttgagggattacagtggtggggagaaattcccttatttatttgtggaattctatgaagcatttcacaggccaccttctggggataacctgttcattgccatggagtaaatcaatagccttcatttagattcttaattggcaatttaatctcattcactttacccaacactcattggctggagggatgatggagattgggagcaggctcctaaaaagggtcttgaaaatgttatttcaacaaagattaattttgaggcattgagagtttcagaaaggttcacattttttttctaaagctcttctaagccaatcttaaatgaatcctcagaggactatttctgtgggtgtgtgtctgcttgcgtgtgtgtgcatgtgtgtgtcttgccccattccaattctccatccccatgctgaggaggctggaggattcagaatgcagaatcaggtgtattttttaaaaatcattatgtcagtcctcaccaaaacactggctatttctatctttccttctcattttactctgctataggaatctaagtaaatcatctttaggaaataccaagacctaccaggggctttagattcatggcggccaacacaacctagtattgataacccatgtaaatgtttgccatccagatgacaagaataatgacaagagaaaactaacatgacctgccccatggtgtgctagatccacatctctcggggaatgttttgaagcaagttaatacaagctacttgataaaaggcttccgcgatggaatgagattggggaagctgagttaaacaaaaccagtgttctgtgttggatgcttctcaaatccttaaccatgctgaaaagcttagagtatttccaggagaatggcatagcaccccacatcccagacctgcacagcccctgctcaggtcatcttgtgggatgaacagtatgcaaaacacacatcccagaacatgcttggagacaggggaggccactctctagcctgggaacagttctggctctggcacacactgacaaggtgacactgggtgactcatttagtccctctgtaaactgcccttcctcatatgcaagaggccatggaatgttggcctctcagacgttactggctctaacattattttgccaaaaataaaataattagggtggatgtgttataggaaaggggtccagatccagaccccaagagagggttcttggatcttgccaagaaagaattcaggtcgagtccataaagtgaaagcaagtttattaagaaagtaaaggaataaaagaatggctactccatagacagagcagtcccaagggctgctgcttgcccattttatggttatttcttgacgatatgctaaacgaggggttgattattcatgcctcccctttttagtccatatagggtaacttcctgatgttgccatggcatttgtaaactgtcatggcgctggtgggaaggtagtagtgaggatgactagaggtcactcttgttgtcatcttggttttggtggagtttcactggcttctgtgcaacctgttttatcagcaaggtctttatgacctgtatcttgtgccgacctcctgtctcatcctgtgacttagaatgccttaactgtctgggaatgcagcccagtaggtctcagcctcattttactcagcctttattcaagatggagttgctcttgttcaaatgtctctgacagatgtaataggtaacgctcagacactggcatcagaggcaatgcaacctgaacagaattggctgacatgtatctctgggtataaagaaagtctcagctttcccctgagacgtaatgatgattgtccctaaagcttgcttcacccttccacgctaaactcgctccactgctccatcatctgctttaaagccacaaggacagccagttaggtctttgtcatcatcacttttaacttttgtttaacttttaacaaagattggcctttttaaaggctcaattatattttaaaaaacaaacaaacaaacaaacaaactgccacttacgcagtccattgattttaaacaaagctggcaatgcaagtcaatgggaaaataatagtctttttcaacacatggaattggaaaaactggatacctatatgtataaaaatgaactttgatcccttaccccatactctgcacaagcattaaattaagattaactgagatttgacctgaacgtaaaatctaaaattgcgaagcttttacaataaaacaaaggtagacaaagactccttctacaaatacctggcactaaacattaaaaaatcataaattgtgcttcatcaaaaatacatctgctcttcaagatagatgaaaaggcaattcactgactttgagaccaagtatttgtgttcagaatatgtaaaggaattctaaaactcaacataaaaagacaaaaataaaacaaaaacacatgcaaaaaataaaaaaacaaaaaatgagcaaattatttggacaaaaagttcccaaaaaaggaaatgcaaatagctagcaatcacatgaaaagatgctcaatattattagttatcaaggaaataaaaagtaaaaccataagatactcatacccattagaatggctacagttaaaacgactgacaatactaagttttgatgaggatgtggagcaattggaatgctcatgtattgaggtgagaatataaaatggcgcaaccacttttaataactaccctatggctcaacaattccacttatagatatacaccaaagagatatgaaagcatatattcatccacacaaagacctgtacacagatattcattgtagcattattcatgataacttcaaatggagcagaacccaaatgcttatcaaaggatgaatggataaacatactgttacatattcatataatgacatactactaacagataaaaaaaggaataactattgttacctgcaacggaaacacatataaatctcagaaatagtatgttgttaaataggccagatacaaaatagaatatgttgcatgattccatttatataaagttctagaagaggcaacatgaaagccatggtaataagaacagcagttgcctgaagttttgggggttggtgatatgaggaaattttctggagtgatggaaatattctatatctttattaggatgatgttttcacaggtgaatatatttgtgtaaactcatcagaatatataaaaagatcctacaactcaaaataaaattttaaaaaaaccacaaaaagttattgtgatggttaatattgagtgtcaacttgattggattgaaaggatgtaagtattgctcctgggtgtgtctatgagggtattgtcaaaggagattaatatttgagtcagtggactgggagaggcagcctcttcctcaatttgggtgtgcaccatctaatcagctgccagcgtggtaggataaaagcaggcagaggaacgtgaaaggactagactggtttagtctactggcctacatctttctcccagctggatgcttcctgccctcaaaaatcagactccaagttcttcaactttgggagtcagaccttggaatacagactgaaggctgcactgttggcttccctacttttgaggctttgggattggactgacttcctggatcctcagcttgcagatggcctattgtgggacctcaccttgtgaccatgtgagtcaatgctccttaataaactcccctttatatatacatctatcctactacttctgtccctctagagaaccttgagtaatgcagttatgcatttttattaaatgtaaattatgccttaattaaaaataaatatcttctcaacctccaaaaggagactttctgtctgaaacttgagaataagtctaaagttttcatttaataatgaatttgtaaaagacaggaaaattgattttggcattaatttgttcaacaaatatctgttgagcatgtcctatgtggcagtggctgagtgtagggtgtggagtgggtgaatgtaaggaacatatagttcctggctccctagagctcatggtctaggggttggagagaattggtacattgggattttaaagggggtgccaaaggtggtgatgacaaagctcagggaagaacaactggagtggagggagggcatcaacatggatgctgaaccaagccaatgtactgctaagagtgaggtggaaagtatcatgcgaaccccagagcttcaattgtcaatacatattggggtgtgaccagtagattgatagaagacagcaaagagagaggcgtaaatgccaatacagcacaatagcatgagttgtcaagagacaggacttttcaaggtgaaaggaagggagatggtactgaagcagcagtcatgtctatgacccacccaagccctaagcgatgacagataggaacagagtcagggtcctcagaggacaacctagttttaactaaggcaagaagttgaaaagaatattttaagaaacatttgaggacatattatagtttgctggctatggggtagggtagggtggaagagagagatttggaataaagggtatggatgggacaagacaaagcagggcaccagccctaccttggacctttccttaacttgagaaagctatgtccatgttgattcagccaatctgactcaggtattatgtaacttgaagttgaaccatcccaactgatataagtggtgatactgagtaacacaaatgtgctttctggattcacacatgcattttttttacatgaaaagttcaaacttctatgtggacatttttttcaacagtatcctcaagaagtattcatcatgcaactctttctaggaaaggtatttaaaaaagaagaaaaatgtcatttctggcctggaatgtcaagacatacatctcttagagatttagttctaattattattgtagagtcttgtgggtatttcttataattttaatttttacaaaaaacaaatctgttcatccatgcatctatgtatgtatgtatatatgtatgtatctatcttcatcatcatcataattatccatctatgatctatctattgtgtatctatctaataatctatctatgcagaactgcaaaatttacaggactggcccataccgccctctgctccccactttgtctaatcttcaaaatcaagtttctggacacagggctatgaaatgcaaaatgaaacagctcatgtccaatggtctgacaatctgctgctcatgaaaacctgaaacatccaactgagtttttcataaacatcagcaggtctagttctctatcttcaaagagagttatttttaattttattaggggatacattctttttttataaagaaattattaggtatcaaaacaccacaatctctttatggattcaactagattatgtgtatgggcaaagtattttcaagttaagaataacattcctgttccttgaacactattttgaaagtttggattaagggatattaacttccttaagacaaaacagactcacagttgaaaaccacccaccttctgtatagaagttgcttaattaatatcaatgatttttattgtattggaacaaaatagactataactttttatacgatatatatgggtttattactaaatattcttaaaatgaatataatgctataatattcttattttgaggtaatatatacatagtctgcaaaaattaggtttcctggtgtcattaaccacttatgcaattatttttctgaaatgaatacacatgctgtacatgcagttttgcctgatataagttttaaaacaatgtatattggaatcttggaactaaaaatgagaaaatcagtgtccccttgatgtcaatttcagtttcaactgcacttgctattttatttttaattggttacattatctctacattgtcacagttgatggtatttgttttcttctctgggaccataatttccacagatttaaccataatgcatccttaaagattacaagaaatcttttagacacagctcctctcagttgctgaggatccagcctttactcatttgttttcttcatgaatatatatttcctgagttgtatgtttgtacatagctatttgtagcctttgaagtttatggaagtttgtttggttgcattcttggggcacattttctttccctgaggactgttaaggtttggatatttgatccttccaaagctcatgttgaaatttagtccccaatattggaggctgggcctaatagaagctgtttgggtcatggggacagatccctcccattgaatagattaatgtcctctcctgatggtgaatgaattcttcctctattagttcctgcaagacctggttgttaaaagagcgggccacctccccggtttctctcttgcttcctcgctcatgtaatctctgcacatgctggcttcccctcctcttctgccatgagtgggagcaggctgtggccatcaccagacaaagatgcccaattttgaactttccagccaccagaatcataagccaaatcatcccttttcctttataaattatccagcctcaggtattctttatagcaacacaaaagggacaaggactttttatatcttgccccactgtcttctagcatttcatgtgtcacataaagaaatcttagcctcctaggtttttgttttttttgaatatccacagaattctttccataacttcaaataccaggaatttattgggatatttgttaattattcaatataaacacagccttgtaattcttgggctatttctgtctgcagattcaaatttcattgtatttcaggaatttcaccttgaattgtatctttgaaaatttgttttcatgttccattcattttttaacccatgcaaggcatttagtgttatagatatttgatctcttccctaccaccccctcccatccccctctttttctctatctctgtcttccatcttttactttttgttcttttccatctcacatgctcattttttcttctcaaaaccatccttcaaattctttcagtggtgtctcatctcctttttgctgcttctatcatgacctttgattttggtctctttttgtgtctctctctctgagattctgaggctctgcctattccgtttttattctcatttgtttctaatttgtttccaagactctgtctgctcccttttcattctcatttattagtaatttatttctgaggctttacccactcacttttcattcccgtctaacctaatgtattatcagttcttccttaaagccttatattgcttctttaaattctcatttcagagaaacaatattgtctttaattgattccttagaaataactttgttcacggtttttggctgcgttgtggtatacaatctttccggttctcatcttcataaatcatgttctgttcttcttttttcatttcagcatcattttaaaggcccccggctggctccaccctttttaagtagcactgttcctcatctttttggactagaattttgggcaaagttctggggaaaggggaagaggaatgtgctaaacaaatgggaagattggtttcagtctgttatctctgggatttttctcagctggacttggcctgtgggttatctggtccagcatagcaggacatcttccaggctcacaaggaggctgtgcattttacagaacattttaatgtgattattttaccttgacttatcttcaccaggcagctttgggcaaagatggccaggtagcttttatcttattgactcttccttctatcctatgccatgattgaaacatgatgtaggcttccaaaaccaggacatgaaccttgatcttaactttctaagcatgggataaacacatttcctttcaatgtgtgccacccaaccactttggataactatgaactgggtccactctgcctgagtcacacatagacagacaccttctcttggagttcccaaatacctccatccacttttcatacacttggctatcttcctgcatctactgtgatccagggttataggggatctgtagcttcatcaaagataacatttgtttgtttcttattctcttgtttgctttggattggtttcataaaggaaatgagacaaaaatatacttatactaccatttgaaaagaaaagataaattccttctttcaaattcattcctttttttttctttccaatgaatctcatggggtgaggggaggactgaagagaatgtctaatctactcaaatccaaaaagtcacaggtataaggcacagaaaattttaccagtataatgatggcagttttaatgctatataaggacagactatgcaaaaatgctgttaatgaggatgaggagctacagaacaaacctgatgaggaactgtaattctatgagaatgatgtatatagccatcattttttttctttaatccaaaacaattagattgcttatatagacagccacattcaattctaagctatttgattgaaatgcaccagaggatgcagatatatatatatccttttaccttaatttccattttattctttccctcccattttatctgtgctatagagtacatttttcccacttgagctcaacatgctgttgtgcagaaagccttctcttgggagttcccaaaatgttggcccagatgagtggagcagacatttggcccaggtgagcatagcacatatttacatgaaatattagggagcatccatctgggctatgtgacgtaggctggcaatacacgaaagaggattctgatttgttgtataaatcaccttcagagcccccaacagtgaacacatagggggttcttttcattttcatgatgcttaatataatccttaaaaataattaaaattaggtgaagtgtgtagatttctgagagattacagaaagacactagttttgatacctcttgcttgtagcatttgactgatgtaaacaaactaaaaggtttaaaaagaacagggattcttcccagtagtatagtgcaatgggtagggaaaaaaagctcaaaattgataaatagaccaatattattctcaaaactcataccattgtgattgggaagaaattaatacatattacttagtcacttcatgttactatatacttctattaaaacagcaaaaaggaaattataggaaaaaagtcatacatttaaaggatggaagaaaatcctaggtttactcagagctcaagatcccattgggatgaatatcgttctttcctcggattgttccttcatttcattcattcacttatgtatgcatttatttatttagagatggggtctatttctgtatttatttatttattgattgatggagtattgctctgttgcccaggctggagtatagtggcacaatcatagctcactgcagccttgaactcctgggctcaagtgatgctcctgcatcagcctcctgagtagctgggactacaggtgtttgccaccatgccccgctaatttttaagtttttttgtattgattgggtctccctatgttgcccaggctgaccttaaacttttcagctcagcgatcttctgccctggcctcccaaagtgctgggattacaggtgtgtcccttcatttctaatgaaggaaggttttcctttgaatatctcacaacagatatttttaaaagaaaggcagatttgaagcaaccatcaacaaggtttatttgaaaattaatctgatatttacaagtgcattatataacagaaatgttacagactgaattgtgccacgcctaccccaaaactcttatgttgaaatcctaacacccagtacccggaatgtgattgtatttggagatgggtcattaaggaggaaattaaagtaaaatgaggtcacatgggtgggccctaatccaataggactggtttccttacaagaagaggagatgaggacacagacacacacagagagatgaccctgtgaggatgcagggagaagacaccacctacaagcccaggagagaggcctcaggaggcaccatccctgctgacaccttgatctcagacctctagcttctagaactgtaagaacaatttcttctgtttaagcattcccatatgtgggactttgttatggctgcccaagaagcctaatgggagtgcaaagactttctttaaataatgtataacaatgttggtttggaaatgactatccagtgttgagttcaaaactttatctttataggtgctgctatgagtaagtgtctaatttgggggcataatattgacattcttcgggagaaatgcagactccaatcagtgcagaaaatggcacagaatgtttaaaaatgccctccaggccataacatggttgggttaggaggaggaatactaaccattccaatcctaaaacagaattttgggtttctttctgtgagttcaccacctctgaccttcacaggtaagggaccatcacacagacatctgccattttcatataactctctatccaaacaaaggctgaaaattcagcatggaagaactctcccagcacccgtggtcagccccttggcctgcatccccaccctgggcactggtgtgggggtgggattctttatgaacttgggccccaattctgcttcccctggaaagctggacccacacaacatcaccctcatatgcagaccctcatgtctgggcacctgtgcctacccggagctgggggtctgctctaggagctggttcaggacaggttactcccatccaatctgtgcccaccacagaaaagagccagccaagtgcctgctactgcagggctcttcacacatggaaaagctgccctggggaagtgtcccaggaaagggcagggggacaaaaaacagtcacagtgatttgcctccagacactggacactcttccctggagagtacagggatgctcctctccaaacctgatcttgctacatttgtgctgcccacagtaggggcgccactgagttttcaaagaagacagcaggccctgaattgtgcaaggaaaataagtgcttgaattttgtagaatgcatgcagcgttctacttttaagaatggtactgggctcctctgatattcaagaaaggcccccgacagctcagatggtagtttcctaatcctgtcttcccacatgcacatttacctcctccacccaagaactgagtaacagacatgagtgctcgggacatcatgctgtctactgtcatccccttcctaagaccccctctccccatctcttgacacccctgttcttagctccctctttctttctggcctgttacactcaacctctccagcgtcctaacaagtacccactcaaacctacttcctctcctgctgtgcttcttcttcaaaagtactttgcttctcatcctccccttctttccttgccctcttccctgcttccctcttcaaagcacttctcagctacaaatgagaaggaagcgatctgattaaacaggcgatgagcagagtcatgttctgaggggatttgcatttttaaaaggagattaatgacgacgtctcacaatgtcaccctggaatcttatgcagagtgacaggggagtggggatgagctccgttcagggcaggaagcgagagtttggatctgaagtacttttcaaatgctgaagtcataggagcttgcagttgcttcctgggcggggccataaacaaacatctcttctgctgagtggggtctgagaagatagagggaacggtgacccaggagctctggaattatctggctgtgttacatttgcaggactgcacaaatttaagtgaaaaaaacatgcttttcgtccacctggctggcctcttagcctgctctcctcttactgttccctcgaaggcatcattttttgaaagagaaatttaaactctgtccatctcatcccctttggaagaaagttaagattcctttctgagctctttcatcatctggagtttaaaagcttcccctcctctgtcaactctctttgaatccctcatgtcacagcaaacttcaaaagagacaaatacttttgcatgactccctgcaagctccgttttgacctgtagtgacagacccatgtcttggctttcctgattggaaaaacttctcaagctttctgcattcatgatctctgcttcttcagtgcaaccttctccagtttgtctctgatctccaatggtccctgcattaatcctgtccaagccacaggtgaccctcatatcatctcagcttctacttcccagtctctctctctctcttttttttttttttgagacaggggtctcactctgttgcccaggttggtctcaaactgttgggctcaaaagatcctccggcctcatcttcctgagtagctggtaggggtgtgagcccttctgcttggtctccagtcctttgcttttcctttttgacctgtacaacatttggtggttgacgtccatgttcatgtaattgtcttctctggtttgtcggggccaccatgcattcccttctccctcttttcatttattatcttttcatctagtaagacccatcttcccctaaagatgtatatcttcctcaaggcaaagattggcttaccttcacaaactgagtctccaatgacaacataaactgaaatgcaatataaatcatggacagaagtgagctcatcttctacttcctgtgtcctctgctggttcttctcaccaacgtcacgtattgctaagtaagcgagtgatgttaagttagaaaatggactgagtccattaattcatttggcatgctccaaagtcctcacctgagatctatctactctccaaattacacttgttagaaatacaggaagatccttttcacatgagctaattagggtgaatacaagtaagtgttggtaagaagtactagaaacactggaatttgtgagatttcattgaagaaccaacttccacccagcccttcacattgttctcttttggtagtttcttgtcatttcctccttttgttatcaatagagctgctgtgaacatgcatgtacaagtttctgggtggacatatgttttcattttttggggggggtagacatcaaagagtagaattgctgggttgtatgatgaatctgtgttctaatttttcagaaactggacttctactgcttcctgatttcaccttccatgccatttctgcagtgaggcccactccttggccttacaagacctgaattaagttaggtgcccagagccgttctgtcattgactctgttctttcccttgctagcctgtgtaataattggcaatcagacctttaagtgagcagtggtttcatatgtctccccaactatattacaagttccacgggggcagggctatgtctatctccttgacctctgtatttgcgatgcctggcagagggctgtgaacaccggccaccctccataaacagtgggagacaaacaagggagtcagtagagttagtttttgcttttttacccccagaactcttagaatatgatttgagctattccttcaagaagtcctggggcaggtgatcattcacagatgacatgagggagtgcacagcacgtgagtttacaggaaaatgcaaaacccacgttgaaatttgatccccaatgttggagatggggatttataggggggtgtttgggtcatggaggcagatccctcatgaatggcttggtgctgccctcatggtaatgagtgggttctctattcaatcctacaagagctgattgttagaaagagcctggcaccttcctctcctctttctcttgcttcttctctctcaccatgtcatctgtgcacacagcagctccccttcccgttccaccatgagtggaagctccctgaggcctcaccagaagcagatgctggtgcaatgcttcttgtacagcctgcagaactgtgagccaaataaacctctttttttaataaattatccagcctcactcaggtattcctttatagcaatgcaaaactgattaagacagggtatcaggagacctagctttgcctgaatctgagaacttcatcaggactcttggaacaatttagcccacaggtccaaggctgatttttgtcacagtgaagttcaagtagtaagaattctcactggtggctgttgagggtggtggtggtggggatgggttatatggagaattagcagtgggagacaagaaattaaagtggagaaagggaagaattaaaagtcaaaaacagtgtgagggaggaaagcaatggatataacacctcggatctttatccttgagaggccttaaaaaatctacttaataataatcagatgctattctataagaactttgagactagacatgtgatgacttttaggaacctgcactgtggctgaaaatgcatgcaaatctaactgactcagatccagtcttaactggctcataacttgcttcataaacatgactgtatgttagcaaggaaatgagagagaataacagcacatcacataggcatgaaaagtatttgcaaagcagcagttctcaaaaatgacattttgcagtgttttccagaagcagattcagaaaactgaagaccaaagtaatgagggagccgtttcatgcctagatgagcagaagcataccaaaggcttagtatttccccaagtagtaggcatctcaaacttatttaaggaaaatactcttgatgaaacagatactgcagttgaagcaggaatgtgtttggtgtgctgccttaaatagcatgggtagatgttcaaacatgttaggactcactggccctaggaaagacccgcaagtatctggtctacaccaggaaagtgacaatgaaacaccaaacaccttttctcctctaattaccaagaaaagtatttctttcccaatggttgaagacaataatgttgggaatgatgaagttttctggagtgtgaagtggatatgtcttataagtttaatccatagcttcaccacttcataagtggataatcgaattgtgccccagtttcctcagacttggggatattaagagtaccctcagtcaccacaaggtgggtaccaacataagaaaagagtgtagcaaaagcccaggggcgcatgttcttaaagtgcctagtgtgggattagaatgacaagtggtaggtgacctacttgtgcagaaatttagagttattttgtcattttcaaatgatcatcagcatatgagaatactttatactaactgtttcctgtgagttttccctatttcagcaactatctcgtctgtgcctttctttgctaggtaagcacttttctattggttggtgggcttagcagctcttggttttgccttcatgggagacaaatagcatgcacccgagtagtggtaaaggaatggtacccttcagggtgttctgtcctgggcctgacagatcccctgtggtttcgctctgtgtccccccccaaatctcatctcaaactgtaatccccacatgggattggtgggaggtgactggatcatgggggtggtttcccccatgctgttctcatgacagtgagggagttctcatgagagccaatggttttaagtctggcacttcgctctttcagtctctgtcctgctgactgtgaagaaggtacttgcttctccttccagcatgattgtaagtttcctgtggcctccccagccacacaaagctgtgagtcaattaaacctctttcctttataagttgcccagtctcaggcagtatctttttagcagtgtgaaaacagaccaatacacgctggcttttggttctctgggtttcctggatttctgccctactaacatacttgattcctggcagtgaggggttggtctccacctggctggtatctgcatgccaggcttctggtctagcttgcagtctaactctttccaggtgcatatgctcagattcaagctccccagtcgtccccttgtcctcttggctggtggcataacccatgcctgggcatgacttcctgcttatatggactgcttggagtttgctttttttctgtttggttgtgtggaagtgaccctaagagatgagcctgggcatattcgaagagataatgactgagaggtttagccatacataaaacaaagcagagccccagggaaatctaaaaagtccaaacaagatcaacacaaagtaagccacacctcaacagaccaaagatcaagagcaaaacctgaacggtagctagaaaaaaagagactgccttaaaggtgtgactgcagcaccaagagctggtttttcaatggaaaacaggagtcaggtaaaaagaaagctacatatttaaaagatgaaaaaatattgctcttaaactggaattgaatatgcagtgaaatgcagtgaaaacatccttgaaaagaaagtcaaatacagacactgtgagacaaacaactgagatgatttgccatcatcggatccatatatgtaaacactaaatgatgttattcattgactggagtttctagaagaatgataattaaaattgatagtgaaaattcttttttgtttgtattatgaactcaatttgctccacctccctccaattcctacactgaagctcattaaccaccgtaatgtgtctgtatttggagctaggacctgtaaggaggtaattaaggttaaacaaggtcattatggtggactctgatccaataggactgaactccttgtaagaagaggagatgaggacacagacacatacacagaaggacaaccatgtgaggacacagggagaagacagtgtctacaagccaaggagagaggcctgaggaggaaccagccctgcccacaccttgatctcagacttccagcttctggagtgtgaaagaataaatgtctgttgtttaaatactctagcctgaggtattttgttatggcagctggaaaagactaagacagttcatttctgacttttaaatggaatgactattttaccactatgtacagtattaactgttggtttacaaacagataggtattctttatatttatctatttattctcagtttattttgactctgaatatggaatactgccaattctttcctaaagtgaattttgaaaatacatcattttaagtgactttgcctatgtgaaggatgaattcaccatccctttcacacggttttgaaataagcagtgaatgaatatgacttcatgcttcccaagccttcatcttcgctcagagattagggaatattaaaattctcaagtagtttttaaaatacattttgtcccctagagaaataattattaacattttggtaaatatttgaaaatattttcatgaaaaaaattcatttcatataccatgttgttgaaattaacgtagaacttgaaaattatgggcattttgcaatgaagaatatccaatgctttaatacaagggtgatagttttacagtttcaaaaggactctgtgagaagcccctgccatactgttgggaaccaaggaaagggaggcaacgacttaatccttcacaaacaacttaggtcaaaagatgtacagaaaaaaatgtagttaatttgaggagcaattaaatcggaacaggtaacacaatgatctcactgcgaattccaacatttctctctgtcccttgtgttttccatggtgctggaaaaagatctcgaaaccaaccccaacatgtcatgactaaagtttaacagacaaaataccctaagttatgttcttattcagttttgtacatctacaatgactgtcatgtaagtaaacagtatttcctgaattaattctatctggataacagtttttctgatgaaaacaattacaatccatggaaatattgtgtggctaatgaaggagaaaaaaataatattgcttatgtgtacaaaatattatctattcaagagactcataaagaaccagaatattttgagccatcctgaagatctgctttcagagataacgtgtactcctcagccaacaaatattctcaccaacatcttcgtaaagcaagtctctccaaccaacaataaccaccagagaatactacagactttgaaatgatactaatatcccttgctctttaacacttcattttctctttttagaagataatagttctagagattgcttgtgagacaaagagtctcatgtgagaccaaggagctttagccgactgcttgtggagcagaagagtacagtgcagactacagaacaatgttctgcagaggcattattacagataggtgaaaactcattatttttcattataaaacttgttctaatgtgcacgttttttaaaattttgaaacaccatataaaatgtgccaaatttagcataactgccaaatgtaatcaaagaaatataaactgcagtgtctagacactgactactgttgcacagcagcatcactcctattccttagaatgccgattctttcaagtataagacaggtgtcttccagattatttttttatataaaacaccaaactccatctgaggatttatgaggtggaaaaaaagtctaataagtagtaatcagtaagttcttaagtgttgtgtatgtttcatttaagtgaaattaagatgacgttgatagcgccatctcttggatgatatcagcagtataacaggtccttcctaggggcacacaatatataagcaaacattagctgctagttacagcacacctgtatacattctactaatcactgtgtgtccctaatacgacatactttcaatgagctatgaaagtataattactctttaaacttccttggcatgtatcactctagtgtaaatttgtattaccatatctctgtgaaatccatgagctattcaatggagtaacatcactaaaatgtattgaagcaatttggctaatgtggaagaataaaaaagaacgtatgtgctttggccaagcatcagtgtgtgtcctttgtctaaaaatataagaatctggcagcagctttggttaaaaaacagtaacggacatgagatcaaatttaccctgtaggaaattcacccagatgtagatgcacatcacttagatatgcattacacccatttgtcttattcatacaaaatggcttaatgattagaaaacaccaacataaatacttgggaaggagaagatactaaatcaaagaagtaagtctttcattgaaagcctctattcaccactgcaggagcaggacggctcacttaaaatatataaatatccgtttacagttggagtactaattgggatttttaaaaaatttaattagtcacatatatattttacatttcttggaagactgtttttttctttttaaggtaaaatcatgactctcatacaaatatcaacatgtgtcaaaagattttattaaactaattcaatttgttagggaaatggtaagatgttacaactggttaagaggagcattaaaagtgcagacatatattcaggccatcaagaatgaggaaatgaatttgctaaattgatgcaacatcaatcaatagccagggcctgtcattcacagacaatcactccaccacacgcacacatacattcctacggtttgtccacaacttccagagctgaagagtagctcaaggacatcaaagggcagaggcccctaggaagggctgagccacaatgaagcagtgctccttcactcccgatttccatggctaccaccgtttttctctggcaaatcagagacgaattttaaagactgagtaaatctataaaagcgattaatcacagaagttcaatgtctgataaattattccaaaagtgttcctgggcactgagactcaccaagcatacattctgaaatcaaattctatttctatccaaaaagtgcagcccatcagtgttcttaaaggaggcaaatggttgttgtgaggtagcaaacattttccaatgcaggtaaggatgtagataccaggtaaatgttacagttgtgttcatactaacaataaactatggatgacgtggcacagagtcagtcaatgaggaaagatccagagacattctgaggtcacaaaaagaatttaaatgttagctaacaaggagtgctcatcaaaaacaggactttcccactcagactgcaaaccaggcagaactaccatctcgctttatcagttgtcattgcatgttgacatcaacactgaggagagtgatgcagacgatagatataaacatatctacatacatatgcatacataaagcatatacttatatgcatacacagtttacatttcccagccagtgttcagaaaaactagaagagagaagtgatgttccattttgtcttggaaaagtatatattttacatatacatgcatgcatatgtctacatacatatgcatgtaatgcctacctgcatattaccaaactgatacacacatgtatatatggaggtgtgtgtgtatatacatgtacattcactttatcacatactccatcagcttgacttctgagatggtaattcaagtttcatctttgttctgggcttcgtttctgtctctactgtattttttgtctcaaccgtcaagtcacattttatcaacacgttagactgggacaaaccaacatgggatggaaactccaatctcaggaggctaaaatcacagcgcaggttgggattgaagagttgctgatttcctttccctttcccccagcagtgtggaccatgagagtgggctgggggcggaagactgaggccctccctctcactcataggagggcaaaccaaacagctcgggctggaagtcctgcagggaattcagcaccagggtggcctttgttgtcagatctcggctcaagtttccgtcaggaaccatgaccacctgcatcccagctgccagggccgcctccaccccattgggagcatcttcaaagacaaggcactgtaggaagaaaaagaaagtcgagatggccttttatggaaccagacatgtggatgaagtgtttattatcgtcgtcaccattggctctgcaactgtgcagaaagagacagaattacagtgggggctccccagagtagagattgtggtgaggacagcatgctgtttcttactggctccgggggtctccccgccgtggctcctttaaaggggagaggtttctgttgcagccaaagcattgttgaaatggagcgcagctgtgtggtgaggcaagattctcagcttaaaactttattattttattgggatcataacaatctgttcaatcaataattgaacattcagagtgtgagaggcaattgcaaaactaaaaatcatgctcttaaaatataaaaccacttcagagctgctcctgttttatgtactgtggtttgaaaattaaatggttagaatcttttaagttaaaaattcagttcctgtgtgtgctagtgtgacgtgacaaatgagcacgaaaacgtagtgtgcgtgcatgctctcttttggataatcgcgaaaatccactttattattgggattacagacacaacaccatccaaaacccgtggtctcttcattcagatacccacattgaaaatggggtgtttcctactggcaactgcaaagatatggaaccaacctaagtgcccatccaccaatgagcggataaagaaaatgaggcatatatacaccatggaatactactcagacataaaaaggaatgaaataatgtcttctgcagcaacatggatggagctggaggccattattctaagtaactcaggaatggaaatccaaatatcgtatgctctcacttataagtggaatctaagctatgaggatgggaagccataagaattctatataatgcattttggggactagcggggtgaggaagaaaagactacatactgggtacagtgcacactgttcggttgacgtgtgtgctaaaatctcagaaatcactgctaaagaacttatccatgtaaccaaaagccacctgtaccctacagactattaaaataaaaattaaaattaaaaaggaaaaaaataaagtactaaaagaaaaaccaatacataaaatggggtgtttgtacactgcatttatcagtgagctcctaaaggtgccaccacattgacaatgttacagtaagtttcacatgagggctccctccaaaggagacaccccagagcctgctccatagtataaacaagcataatccacatgtgctatcttcatatcaccgaccctctcaggaagacatacacttaggaaggaagcttcttccctgcattcctagaatggcacacacttcatgtgaaaacagatgtactgatgctttttaactgagactctgcagaggcccagacatctgtaagggaagagaggtcctcgccatggcgacctatgctgaggagtctcccctgctcttctccacatgtggcctagaactccaggagttgttgaggtggggcctttcagctctccactcatctcttctttgtctcctttgtccctctgcattttctttttttttttttggtgagacagagtcttgctctctcacccaggctgaagtgcagtggtgcgatcttggctcactgcagcctctacctcccaggctcaagcaattctcatgcctcagcctcccaagcagctgggactacaggcatgcatcaccaagccggctaatttttttttgtatttttcagtagagacagggtttcaccatgttggccaggctggtctccaactcctggactcaagtgatctgcccgcctcggcctcccaaagtgctgggattacaggtgtgtgccaccacacctggccccctttgcctttcattatgaaaatgtcctcttcggctcatcaccaggtatatagcagcgactcaatgcactggtgtcctggaaagggctcacggaagcctgatgccaggtctgaaagagaagctctgcattctttggcgttttcagtagaaaacactgaaacacacacacagtcttaactactagtggtctgtgctgtagccagcacaatgacttttttctttttccctccctccctttttctttccattaccccattctttccttcaatctggggctaaaatatcatattagccaacttatcccaacagggctgaaccctggattaagtgagttaatccatgtgacaatggaatgtgaatgctaccttactttcacagagggaacttggttggcccagctgtttcggtttgcttggaactgaagggtcagctgtggggcaggatgttccgtgctacaccctggacagtcccaggcaagccacagtagtccgtcccaacacctcccttccaacagcctctgatgccccctggtttctttctcctgtgagacactggtcaccgtaggacgcgagaagaaatgactccacttagactgtccaagttggttttctctgttatctcattcagtgactacctgttcatgatatttctgcccttgcctttttaaaagttatgacttgattgtattctaaatgccctccactgtttttatctgggaccagagataggcacttaaatgtcaaatgacatttcaaaatatccgtcaccttctccggggattctgaagctttgtgcagggtccacctgtgaaatgtggactggggtagaggaagagatggattatcccctggggtaacactgcttggctaagttgtgaaagcagcttttattctctatttgcgtgaggctgcttccaaggagcaagacaggtgtgtgggacgggaaatcagtagctgactgtggctgttcccaaagagataatggaaggcacccaatacacctgcactcacctaaagggggtcatacagttttgctgtgtccctactcaaatctcatcttgaaatgtagctcccagaatccccacgtgttgtgggagggacctggtgggagacaattgaatcatgggggcagttttccccatactattctcatggtagtgaataagtctcacaagatctgatggttttataaggggaaacccctttcgcttggctcttattctctctcttgcctgctgccatgcaagacatacctttcaccttctgccatgattgtgaggcctcctcattcatgtggaactgtgagtccattaaacctctttttctttgtaatttacccagtcttgggtatgtctttatcagcagtgtgaaaatggactaatacagggggtctgcagtggagggaaatgcaggccccatggtgtcccttcacacctgagaaatcttttcaaaggcagcccctgtttaaaggcaactaagtgagggctgtgagtgaggagggaaacttgcaagtgtctgcggcactgacagcaggagcagctgacaccagctcttggagacctttttactgtttctcatggctttcacgttttgctggttcctctgtgttcaattaatctgtcctcacctatttttaagaataatccaaaatggcactgacatctggaatactacacacaacatgtaagacaaatgtcgtacataaagtaagggggactcgaataagcatgaagagtggcgaaaagtcaaggttggtaactggttgctatcacaatcaatcacaataagaaggtgacgtaggctgggcgcagtggctcacacctgtattttgggaggccgaggtacgcggatcacttgaggtcaggagttccagaccagcctggccaacatggtaaaatcacatcgctaccaaaaaattaaaaaattagccaagcatggtggcgcatgcctgtattcccagctactctggaagctaaggcaggagaatggcttgaacccaggaggtagaggttgcagtgagtcaagatcgtgccactgcattccagactgggccacagagtgagactccgtctcaaaaaaaaaaaagaaaaaaagagagaaggtgacataataagcttatgcaacagaagggccatttgaaatatgtccatgtgagtaagtaaaaccctcagtgttcaaatgattgaggggaaacctaggaagacaggccagttggcttgggttttccagcacaagacccttgcaaagttaactattctaaaaggtcaaaagtaagtacagcctctgatgtaaacagccatgggtgatctcagcccaaaacaaacagcaatgggatacatgacacccctggcacctgaaaccctcttcttcctcctctcatgtggccgctttgctaacagctgtcaggagatacctttccccgacatttgccggactcttacacttcatgtccgctaacgagaattccatttgatcaagatggaatttgaaaacggaacctgaagtttcaaaagctgatagaatagtcagctggaggtggtcgatgatggaaacgtgccaggaaaactcaacagaacaggagtggagcagaagtgagtggtttacaggaaaacagcctgtaataccaggcattgtttgcacacaaaatttaaagaaagccccagacacaggacaaagagaagacatcaaacatgagtcctgagaagaaaccccctggtgctaggcccagatggcaactgcaccacacacacagcctgcacgtgggaaatgattcggggtcatgccacagcatctggaagtttgggttttgttggtttggtttttttcccctagaaacagtagaattataaagcagaacaactactgtgtcctgaagcacctattaaaaatgtcccaaaaggtttatttattttcttttttttttgttgttttttgagacataatctggctctgtcacccaggctggagtgcaatggcaagatcttagctcactgcaacctccacctcccgggttcaagcaattctcctgcctcagcctctcgagtagctgggattacaggcatgcaccaccacactcggctaatttttttttgtatttttaatagagatggggtttcgccatgttggccaggctggtcttgaactcttgacctcaactgatccacccatctcggcctctcagagtgctgggattacaggcgtgacccaccgtgcccagccccaaaagatttttatgtcgtctttagacttcgttacacccaaagatctaatgcacttgtaaataggaccacacctacaagaaaagtacctggtatctaaaagcctaaccatttaaagaatgttcacagcatggctgtctgtctactgaaacttaaggatttaagaataaatccttaaaagctatcttggaacaactgtgtctggtaatcacaggacttaagcatcaaaaaaagaaagaagaatataagctaaatacagtttatattttgcacaaataaaattaaggaagaagtatgtttcttatcttcgaaggcagaaatatctcaacacagtttccgtctgccacacccagctacagggaaaggaggttcaccctgactgaacttggctctcatgcttccttttaagcacctggctctcatgcttccttttaagcacctggctctcatgcttccttttaagcacctcatgttttcacttagggggcagcccttcctgtcccaccatgactgaccaattacacttgacctaaaactcattcataccaccacccatacagtgaatcatggattcgtatgtttgcatctgtagaaagaaacttttctctctaagccaagggacttcagcctctgcaagtggggagtggaggcagactgacttttctctgcacggacttggtgggttgctcctttgagggtggtggccagggacagggaaggtggaagtgcccacggctcccttctcttttctagcagggctcctgcaccttcagtgaagccggagaactggggtttggtccaggggatggcgctgccacctgcacatgctcccggcaggcctgcggcctaccctgaaatctccctccttcaccccacatatcatctctgtgtcaggacatgcacatggatgtgtgtgtatgcatgcatattctatatgattttaattaattttgtgatcattttgtagtgtatttagtggaccttctaaggctgacttccacatcttcaaggaagtatctggtcaagaatattcttgacgcagcttgtacagcctacatatcggctgtaactaggcagggcccagttttcacgcaccttcccaggatgccatggcaaatcgtgagcactgatgaacgtctgctaaattagtgaagatggtggaggtgtcctgggtacaggacttagagccacaaaggggccatggaaagtcagcgctagggaatagacagagcaaatgcagcatctcctctgcttagtgcaagggaagttcagaggcaagctggaggtcatgcagtcaggcggaagacagaactcttgaatagaatccaggtctgcagaatccaatgttcttttcactctacccagctgaaggctaaaatatatctgatttccatctccaggcgaggagatgagcttaattaaactgtagcttgagggatttaatttagggagcatgacatttccaacgacaagggaggtgaagcaccttggcggcttatcacttggaggtgatgaactgacttctccaacgatgttgaagcgcagcagcgacctggggatggtctctgtccaggggacttaaaaagtccttgtactttaatttcttaaaagacaaatatcatatagcttaaaagttccattttataactagcaagttgcacataagagtatctttgtctgacagcagcagggtgtcttagtcccttcaggttactgtaagaaaataccacagactgggtggcttaaaccccagacagggatttcccataggtctggggccaggcggtgtgagatcagggagccagcgtggtctctggctccctggtctccccctaacgcattacactgggggtgaggatttcagcatctgaattgggggagggaaacagtccaaacacaagagcaatgaataaaaatggatgggattagaggaaaaactgagaagcaatagggaactggatgatacctgggatgttaagcctgatggagaagctgattctcatgtttctgatgtggtgggtcttggggccgccattttggtggcaggaaggagaggtagcttttgtgacaagttgggtttgaggccatcgtgggacacccaagtagaaggctcggggtctccatgcactgtggctgtgagctggaggtgcggtcaggtgtcatcagagcagagaagcagttgattacacagaaggaggagcgctgagaagggatcccggcagccctggcatttctgtgcggtgagcagacgaggtctatggatggagctctaggtacagtttgggcaggaagggaacacagtaggaggcagtgtcaggagctaggttaggttttcaagagggaaggagaagggcccgcggcttgtgatgctctcgtgttcctccccaggtctcacttcccggtgatgcttccacctttggctcctccctgctgcaaatcctgtccccgtggcacttgcccaccatttcttctcagcagctgggatcaacagcacgtcccatcgggaagcagacagaacagtcacagcagggaaggagccagcccctttccaatcctgcacaccgggacctcctccaggccacaggcagagtgctgcccgtgcctacttgggatcacatttcgtaaccgattttaccttttaaactatgatgtgtctgttttaaattatgtgcttcattggaactagtgagctttccaaatattactatatcatctctaaggaataaagctttcccttttgcttagtgaaatacaacatttggaaggaagtcactgaagggtactttcagggctcccagaagcggtcctggaattacatggaagcacagaaagtacagcagctgctcacaactattcatcaattataaagccatgtatgatctgaatctcatcaccaaaaccaggctttttcataggaggttttttcctatgcattaattttgtaatatgaagttcaattttcacatggtgagacatcaaaacttcaagggggccttaaactttgtttttaattttgattggcagtgctcatatctaaggtttaagttctgtttgacttcatgttccttgtcagacagtgatctgtaaataagtaccacaatgttgtcatgttggatacatatacactattagatgtttgtttaaacatgaaacttttaagtactgctgtcaaaatgactgctgaggtatgtgtgtattttgttattaattagtacttttgtttatattattcatcaatccatccatctgtccatccatccctatttatcaatctatccatccctcccttcctcctgctctcccttccttcatccaaacatccacctacctactagtaagctacatatggtgctgcattcctctaagtaatagtgctgaggtggaggtcagtatcccttgtgcaccgcagagctactgttttactgaatcgatagtgctctgaaaatcaaactataaaaccattattgatataaacatgtttataacaaaaccctttagagttacaagctaggtaaatgaatgaactacacccctaaattgattccttctcctatagagaacagcctttgaaaaagttatttaacgacttggttggggggtgggcaggaaagcttcctaacgaattctctctgtgtcattttactcaataaaagtacattacgggcactcttagcatgcatattaaagtgtatgtatgtaaattaagtggtgagcaaaagacttcaagacagctcaaaaaaccttcctgatttcctcttttaatggtacagatgccgcgtccaccaatctgtcagaaaccagtgaaaacccagcaaggccctgaaaggtgctgactgtcttaaagtcaaaaacaaaccgcaagtttctagatggtcactagaatcattttctttttccacatcctctgagtaaaacatgtgaaatcaattcatcttacgtagccttctgcatgagactcatgatccgcaagtgtgacgggaggcccctatcggttttgtgtgtttagagggacattatgacttcagacagactcgggaagattagccatgtacgggattaaaatgctctaacctgtagagcagcaagttgtgtttattttcaacagcactttcgttatggaaaaaccacatttaggtgccttagatgtgacttgcttgtggtatgcttgctgtataatatgactccacacattgtcaggacagcaaaagcacagcgatgtttgcctgcttttgagagaagctacagagggggcttccccaaacaggattatcacagcataaagagagtgcctttgctggcctgtgtgagtgatttttccatgtcatctccaaatgtgccatgtagaagaagctgccatttataatgggaactgataaacacagagaaaaaagcctaaggaattcattggacctggaggggattaaaagacttcgtgattaaatgagctggtggatgagccaatgagctgtctgtgtggtgagcacgtggcagctggcaatgcagaggcctctcttcggtcctctccttggtcctttccatactgacacccgttgtgcatggcccagcaacctactcaacaggggatgagaggcctacaaagccaatgcccttcaggatggatttattttctggttttcacagggatgccctcagttctccttcctgcaaatatagtaactgctgactcctgaaataaaagccggtgtttatagctgtggttgcaaagtcagtgtttcccaaacaaagatgtgttgcagtaccaggtgaggcttatgttgttttcactggcctcccatgcccatattaacgttcaattctaaattgtctagtagtagaatgttcatgaggtaaggggtttctagaatgttctgtgacacagcagtccagagaaattttccagaaaaaggagattcctcccattaaatgaggaactggggacctgccatgtacaattagcacagaaatgtttccagaagtgctgccatggataactgtgtagttgaaacctcactgaggcctctcaggcatggacacctatcttcagagcaaatcgatgaaggtcccgcaaagcagcactccgaggaatctattttggggacgttttcacaaagagtagctgaatgtggcatgactcacgtcaatgcaaatgcaattcatttgccttgttttcttgaactattctgaatcttacctgtaaataacgacagatgaggcagatttcaccttaaatgcctatcctcttgcaggaatggttgcttacatggcattgaggctactgcttaattcagaactgaagggaccagctctgtgagggcaccctccctaggcccctcggcaatgggctctgctgaccactcatgacaaaatggcgcccagggcacctgtgagggcaacacagggcctggtccatccctctctcctttcctttagatagagaggggcgtgagcatattctcaatcctggaaaacagaggtggaaggcatcttgccttcctttctctaacctgagatgctgatggagcctgggctagaagactgacctggctgtgggggctagagaagagcgagaatgtgctggatgtggggcctggcctgagggtggaaattactggggctactgacacagtacttgtctgatactgtgtatgactaactcagtgtttctcaaccatttcattcatgatcacccccaaaaaagcttttccagttatttttccccaacagtctatccccataacatgttataataacacagatacactatatttttctgtatgtgtattggtgcttgatacattaaaaaaaagtaaggtttcattttcacctccccaaagccaatttttataccttgggacaaaatgcatggactattctattcaattttactcagttgaacagtttttggagaacctactgaaaccactctcaaggaagggtcccactgacccaggagaagaaggcttcacagagtaggaaagtagctgaagatttcagagaaaaacactttcactacagagaagaatccccccacccccacccccgctgcctggaagatcacaaatgaactgtaaccttccaaagtcaacacacaacatttcataactatgacgtacttggggagctgttcaattgcatggaataattcatatattgaagaatgtggagaacaaacaaatgaatctctgacaaataacactattccaggtagcagtctttaaatatgccctcccaccaacttcaaattttataaatgaatgaatcaatgatatccagtgcttggcagatgggacatgctccgtcgctatcagctattattatgataatggtgatccattctgtagacgttacaaaaaattcactatgaagtttaaaattactcaagctcgtgttgggactgggactagcaccttatattctagtgactatgccactaaatatctcaattactagccaggatattgataaactgcaaattaatggcatttgtttcttcctgtttttttgtgagattcatcagaaatgcatatttatattagaagctgggctttaatcaatagctatcagcaattcaagcatgttagacatatttttaggaaattaacacctacataaagtactgtcttgggcaggcagaagacagaaagcagagcagacagctctccagcctccctggagttcatggtctccaaggcaggaaacatgcactggggaatccctgctaatacaggcccactgtggggagccctgtttgaggcacacagtcctctggagcagggacagcagtccattcaccaggatttggaaggtggatttgaaggagtgggtttagggaagatgactcagggatttctggtcagaggcaggtcatgaaagacaggcataatcgcacatgatgtatgtagccactgggaaatggaaggtgtgtgtggggtgagaaatgcaggcagagggaagagcttagcagagacagctactggctgcactccagtgtggagaggcttgtcaggatgagatggacatgcagaaaaataaacattgtactgggggcaggcagaagacaaggccccaaaaggaaaccagaagtaatgagtgaggtagggagcaaggggtcaggctgagaggtctgtgctttacgaggtgggtggggagggaagctggggagggtgagatgaggtcagagcagggcaactgggcatatcagtgttttagaaacatcaaagaagcaaaaccactgatttaccaagaaactctgaccattgttaaaggcagtgcccccctaccctagcagtattgtttatgtctagtaagattattcgagagcatgactgcttaatttttttttttttttttttttttggaaatccaaaatacaactcatccactgaaatacctggcttagtgtcaaatgttttattctgcaatggtggcttaattcagatgggttggttacatgctacctgctattaagatggcctcatgcaaactgtcattctttgaaactgctggtatgtggagattgcacaacttcatgtacaaatgcacatggaaccagagaaaccacttagcagttacactggtacaacaacaccatacaaatgaattacaaagcagccctcaagagatgttacacacgtgataacaagtagtcactgctggcctgtcattttagcaatttatagtttgcttgatatatgtgtctgtgtgtatgaatctaaagaatgagaaaaaattaattgtgtagtgattcatttatcaggagtcatacttaataaaatggaacaaaaacatcacaaacaggtaaagcatggagattctgttgggttaatggtctttgtaattgcaaaggaaaatgatgttactatcacttttgggtgttcaattcagcttatctgaaggggctggaaaaagatcaagtaattactaaccatacttgactttgaaatgcgttcacacacctatccagttgatgtggggagaagagagtgtaggaggtaccgtgcttcctgtctagggagataaagtctcccctttcattctattagctatgggaataccagataattatgttttttaaatactacaagtataatattgtttgtttgtttttgagacagggtctcactctgtcgcccaggctcgggtgcagtggtgcaatcacagctcactgcagccttgacacccccaggctcaggtgaccttcccacctttgcctcccaagtagctgggactaccgggaagcaccaccatgcccggctaatttctttttgtagtttttgtagagatggggttttgccctttgcccgggctagtcttgaactcctgggctctagcaatcaagctaccttggcctcgctaagtgctgggatttcaggtgtgagccactgcacccagctaatattgttagattatgtattcataagcctatgaactattgcatagtccacttgtaaatgacaactacaaaaatctatgaatggctgcgtaattcatcctataatcatgacgactgtttactacagtcgttattttgagcatatatataagagaaaaacagtacgtattcaacgtttctctttatgttgggatatgcactggaacttccttctcataaaaagaacagaacgtgaacagaaggctcttacaagatggaagagcccactctctagtcatggggtcacttatgggacaagtacaaagattaaaaccagcacacactgccaaaaactatcaaagataggcaagctgttgatccgcatttattggatgtctactgaataaataatgagggcattctacattccgaggtcgtgaacagcccatattcccacttgggaacacaaccagaaaccgtagttcctagtcatttcattgttcaggtgtggtttctcagtattaatacagggaggtagggaagaggaaaggaagatgtgggggtgaagggaaagattgtccccctcctcgctcctatttaggaataaatcaggtgggagatgtgcttccgtaaccagctggacagtctgtgtccctgagaggtgcccagagggtcccagtttgcaccaacctctcctgagtcatgctggaaccttctttctagagagctgtgtttggagaacggcacacagagccccttgactcctgggcctccagcatctcccaggaagacctccaacagtatgtgattaaactatagacatgcagctcaaataatactctggatgagccacagaacatgtcttcttttctacagaaaacgtattttcttaacccttgaataagctagggatacaagatccattcaaagtttaaggctcggtaatagatttgaagatacacgaggaggaaaaggttactgatagggcttcaatttccacatagcaactaactcttaagaaactatcacttgctgaattctggtgtagtaaaacagctacacacagaaatagagctaaagaaagaaaaatagttaacattatcttaaaagacttaaaatatcccttccttttcaaactaggttctatataagagacgtgatctcagctcactgcaacctcctcctcctgggttcaagtgattctcccacctcagcccccctgcccccaaaccaaaaaaagaaaaaacaaaaaacaaaaaacaaactcgggcttctcattctcattagccacttcttctggggacagctctaggggtaaagggtcccaccgttccctacctgctgggtaatcagatcccttcaaaaagatgctttcgagtttttgtccagtttttctcactgttcttaaggggagagttagcgcagcttgcttaggtcctatcaccagaaggagacttggttcgagttttacatgttaatatttgattggagtaggattcaccttagtgttggaagtaagccagagccttggggtttatgtccccctctccactggcaagacatctaccccggtattatttcctgactgatccatctgtttcacaacaatctgaaatgccaccttgatcctcgcataaatccccaaacataacgaggctgaattcactggttattctccctattctagtttgggtgagggcaagtccgagaatgtgtacacaagcattgtggaggccagatcgggtgaggaaggtacaaggaaggtacaacatgtccaggggtgggagagttcacgggctttattgcaaattagcccaggccaaacacttttaaaaagcggattcctcaactacagcaatgttatgcaatgcaaggtggggagccatacatacaaacagcactagtgctacttatgggtcacgtgttctctgtattcaatacaccattctcctccaatcgcagtgaagagaaacaatgcccaaatttgccaataatctgtggtactacattaaatgagatgctaaacatttagcaaggttttagcccaaaacatccaataattattagtaataattactagttaaaagctaaaagatattttgaaaattgacacaattgtaaaagataactggtaatgcaggaccaacgaacttgatgcactagtgtatgggggaatagtgactagattgtatttttactggctagttgtctgaaaccttgctatcaaaaagactcagtgaacacagtatcattacaaaaaatgcacagctggtcaccagccaacctaatgaaatgccccgagtagggtagtggcatttgtactaatagtggctactagttcttttaaaaagtgtttcaaggaactacgaggcatggatttttttgaggcatttgagtgacagtccagaaataaaaaaatacatgttttagagcagtggtccccagcattttggcaccaggaaccggtttcgtagaggacaatttttcctagataggtggggggtgaaaggggctggttttgggatgaaactgttccacctcagatcatcaggcattagattctcatacggagcacacaactcagatcccctgcatgtacagttcacactagggttcaggctcctgtgagaatctaatgtggcctctgatcagacaggaggcggagctcaggtggtaatgctggctcactcgccgctcacttcctgctgtgcgccctgcttcctaacgggccatggagtactggtccatggccaggggattggggactcctgttttagaggatgcaataaaacatatatggagactgcaattttttggtttacaacttcggggaagttaaagggccaaaaccagcactgctataaagattaagctattagatgttttttgctggaaagtatttccagagacatgagctttttccataacacatatcaatcacacacacataaacacacacacgtgtgcgcacatgcatgcgcacacacacacagtgctgattaaatgaagttttgttacattttccattgtcatacaagtatctgcctttaaaagggaaatagtggaccagggattcatccatcatattttctccacacaaagcacagggcacagtgccatcctggaatttctccagccaagcataaagaagatatctgaaggcaagacatatgaagagtaattatgagaggacagaacttcattctgttctgagatttgctgtttttctctagcatttagtgaaattatttcttcacttctctgcatttgacagagtgcagaagggcctcatgcctctaatttgtgttttcccagagaccctcatgccccaggaatggctcagctctggcgtaattctgcagaacagtacaggggcccgtgtgcatgcaacctgtgtcgaggtctctgcagggctgtgaactagaaatcaacactgcagtgccccaagttccccaagaatgacgagcagctctccatcaaaggaggacagattctgccgctgactgtaagccctggaaaccagtctggaggaacgcaggtggctgtgggtctgccaagaagccagaacacttactgagctgtgacctggccaaagcacagctccacctcctatcaaagctgatgatgtacccaaggggagagggagagcctgaaggtgaaaaagacagcctccccattgacatcactgcagctgtagtggcaggagatggagacaaggatcacgagactaagtgtcagtcagggtttgtgaaataacagtacagaagaggaatgccttctctatttgtggggaacaccacgggaaaagaaaaagaaggtgatatggtttggctgtgtccctacccaaatctcatcttgaattgtagctcccacaattcccacatgttatgggagggactcggtggaaggtaattgaatcaggggggtaggtctttctcatgctgttctcgtgatagtgagtaagtctcatgagatgtgatggttttgtaagggagagattccctgcataagctctctttttgcccactgccatccatgtaagacatgacttgctgctccttgccttccgccatgattgtgaggcctccccagtcatgtggaactgtgagtccgttaaacctctttcctgtataaattacccagttttgggtatgtctttattagaagcgtgaaaacagactaatatagaaggccacactatagctgggaatgtagggtttctttgccaaagtttataagaactgaaaatcaaagagcaagaaataactactaaattctaataagaaatgacattggctattattaaaactaaatgacagtgtgtgctcctaaatcactcggtattcctggcatcttgcaatctgataaaatggcacgtacacgaaaggttcaataaaagcttacagaggggaattgagtcccttggtgtgaatctgtttctttacctacagaatcagtgactggattctgtgtctattggcttctgcttccgtatatcgtgcattgatagcctctgatttgggtgtggggacaggggaggagtctgtgttctcaggctgggaatgagaccttgaagtcaacatagcagctgctacctacagcctcaattcaggaagggaagaaacgtacaaatgaggacaagggaggttttcagaagagagggcctaagaagtggatggataaaggaggttgctggctgcagacggcatgtgaggagagagaatcctcgtgcaatgagaagcttcaaggttggctgagggactccagggtgcctggagggacaggagcaggctgaaggaaaatgtgggaaaatggagtgttggccgtgttttcagaggtgctcatgacttccaggcagtgcagattcatgagcctggggctcagacaagcagcagggtccccaagagtagatttaaggtaggagaacctctattgagactcctagtaagtgtggcctggctgaacttttacataagattttcccaaggcccctttccagaccactgggcccaggactctacccatgtccagaaaccaagatttgagtcaggcacagtgacaacaagtagcagataagatcacccagggggatgggacagagtgagatgaacaccaaaacaacacctgcacacacacagatgctgacatttggggattgctgaaccgagttcctgggtgagaggaagtgcagagagaaacagtgggagcagtggatgagggcggatgggcatggtgcagccagcagagggagacgttgcagaggagcgtgggaaacggatgtctgtggtttcagcagtcaggagcggcagatgccaggatgaaatgccccccgaggcgaggtgaggaggcgaggatgcagtcagaaacagggattgtggcacctggcagctaatgtgggaacaagactgagggacaccgaggtcatctgggagagcaagatgccccaaggctagtgttctggacacggacgtaaggctactcgggctggataaaggcaggacctgagaaccaggggccgggcacctcagggttgtttagaaacaaggatgccacgtgcgctcggcaggcagagggcctcttattagtgctgggtgctgggcattcagagaagggggcaggggagtaatgatggggtgttggggagaagcagatggggcctccatggactgaggaacatgccacagtggcatgagggttattagagctgaagacagtaagcatcaagtacaggaacagaaggcttctgcactcccttccctttctaaggaaagccttccagaagaattcagccctcagccctcatacatccaatgctcaggagtttcacaaccagggaagtgtgagtcttatcaccaaagataagaagtcagcacctgtcacacctagatgagaaatcgccccaaaagatgttgttataaaactatcttatccaccatctagtctcctaacggcccacttagttttcctaaaagttttcctaaaagtttattcttctgtgtgtccttctgcctctctcccatccatgttaagatgacatacaaatccgaaattctaactgcctccttgagtcacatttttctgtgaactccttcgttgtatgtaaatacaaatctatctttactcttgatagtctgtcttttgttagtctgatttacaggcccccaatcactgcacctaagagggtagaggaaacacatttcctctgacagtgaaatttggtttaagcaagtgccctcgtgccaggaaattcagaagggacaccaagcccaaaggcaagttcaatgaaagaaaagaagtgtaaggacagtaaccgtgaaggtccttgttattacggttttttaaataacgaaagaagggagaaagggaaatgaaataataccaaggacaagtgagcagaggcatgcctattttgttcagcgatgatgggtgacaggaggaggtggccttgaggctggagcaatgaggacccaggctgtggggtcctgaggcccacagagggtggcaaacaatggcaggtgacggtcctcaccctctggagcagctccagtgtggctgtgcccgtaactcagtgttgcagggtaagaagctgattcaagaacatctaatctccccaaaaccagaggtccagcaaagctcagctggtcaccaaatattaactttttttttttttggagaaggagtcttgctctgtcacccaggctggagtgcaatggcacaatctcggctcactgcacctctgcctcccgggttcaggcgattctcctgcctcagcctcccgagtagctgggattacaggtgtgcaccaccatacttagctgatttttgtatttttagtagagatgaggtttcaccatgttggccaggcaggtctcaaactcctgacctcaagtaatccacccaccttggcctcccaaagtgctgggattacaggcgtgagccatcacgcctggcccaaatattaactttaaattggacataagtagtatacagctatttgttctctattattctcggaggaaaagaagttccagttacagaggtcagctcacactgacagcctgcctgctcctgtctgcattcttttgggacatatgcaatgtacgataaggataagttaagatgaaactttgtgtaaatgtcacatgcagttacaggtattagaaaaatacatgtatttttaactagctacatctttttttcagtttttttaaatctaggaaagagtcacagagatgcaaaaagttcttcaaatttggtacaagttgatatgaatatatgcccagcgacagttttcttaatttcactttctcctaagcctcctataacttttgacattacttatttttttctaattgaactataagttccctgaaggaaatcacattggaatcacacctggcacttcctcctcccttactgcctatttctaatctgtcacccagtactccactgagctctaaaacacagacatggccaatgtgtccttctaagaatttccagtgagctcaaatgcctattgtaccatgtgtaaacttttctgcttggtttccaaagtcctcacgattgattctgtgttggctgcactcctgttggacttgttctgttcagcactaatcccaccctctgttcttctctgtaaaaacgctgagcatttatctcaggccctgtgccatccccagttcccctatgatgctctaatttgtgcctgagtgaacttttggtctgactgtcacactaggcagagctgcctcccccaacattgcactgtagagatggtccagcgtacagcagagttgaaagaatttcacagaacacctgtatccctaagtcaccacccagaatgtactctctattttttttttttcctttgagacagagtcttgctctgtcacccaggctggagggcagtggcatgatctcggctcactgaaacttccacctcctaggctcaggtgattctcccacctcagcctcctaagtagctgagactacaggcaggcgccaccacacctggcaaatttatcatcatcatcattattatattttgtagagacacggtttcactatgtttcccaggctagtctttaactcctgagctcaagtgatcctcccaccttggactcccaaagtgctgggattacaggcatgaaccaccacctgtaagactgtattcttaacaaggtgatagcataatagtttgggctatgagtagaaatgtctaaaggctggttgaaatgagcccagtctacctatttatgtggacttagcccttattcattaagaaatatgcaggtttccacgaaaaagagtagaatctaccacgtcccttgtttattaattgtgaatattatctcacaacttcaaccctggtattatacaaaaaaagacagataccgaatatacacaaaacttaggctggcaaaatgagtctactctatctgtttatgcagtttaacatgtataactttcttgaaaatagaacagaaaaacaaaaacaaaaataatttttttaaaacctgaaattcagctcctaaaacaacactaacaagtacaagaaaactaaaacacgcaaagtagtgatggctaggctgtaaaaaattgatttccagccggaacagtggctcactcctgtaatcccagcactttgggaggccgaggtgggcagatcacctgaagtcaggaattcaagaccagcctggccaacatggtgaaaccccatctctactaaaaataaaaaaattagccgggcgtggtggcgtgtgcctgtaatcccagctacttgggaggctgagacaggagaatcacttgaacccaggagacagaggttgcagtgagccgagatcgtgccactgcactccagcctatgcaacagagcaagactgtgtctcaaaaaaaaaaaaaaaaaacaaaactgatttccgatttctggttttacttgtaataaatatcaaccctagaagtgatatgtaagcaatgccatcatttttgtttcacaacaatgatggcatttttgtggctgggaacagagagccctggggtgcctcccagcttggtcgctcaagtccccaccaagcaatgagtgtgctcacactcgcaagtctcaggacctggcgttcggcacatggaggccctctacccactgggtctctggccttcaggggatgtgttggcagatgtcgcaccctgcctggcacacagtgggcgggtgctttcactcgatgggtgctcattatcctgaaggtggtttctggggggcttctgaaggtggccttatgtttgcttgatattttttagaacaaaataatgatacatgaataacttagaaaatattctcagtgaaaacttgattctttaatgtcagctctgttggacactttctcctagtaagatgggaattaatatttaacataattaataaccctttgatcctacttgtttttgactactttcctatgactactactactactatgcctaattaacctggtgacacctatggcatgatcaattccctaaggcaattccctaagagattcagaagtctcttcagtgactgatgatttaatggaatgcccttgaactctggaggcatgctgctcctgtgagctcacacccacactgcgggcaagaagcagcagcagggcctgactgaagagctccaagatcgtccacacggcccctggccactgcctcctgtattcctgacacaaatgccaagtacaaaaccagggctgcttccctgacaggagcttgggaaaaacttcctttagtattacaatatgcacatcacaggaggaagacccacaatgtgtcactgtctctaagtaagaagcatgagaggaaacatttcatttctgcaagagaaatatatctgtaagtaaatgtagattaataataaggaaaatgtttagaactttctaaaagctaaatgacttttaaaaaatgcaactgctcatttttctttgacaagtctaaaacaaacattgtcaatgagaacaccaagatgttaaaacacaattcattccatgggcctctttgcagggtaccttgtgagagaaattcctcctcatgagggcccttgctctgtgggtttcaccataactggtcccatgcaatggcagcatgtggtttccacatacactttgcttccatatacattttaaaacatggctaattttttgtggagacagggtctggctatgttgacctggctggtctcaagctactgggctcaagcatcctcctgcctcagcatcccaaagtgctgggattacaggtgtgagctgccacacccggctgcgcatggtggtgtgtgcctatggtcccagctacttgggaggcagaggcagaaggattgctgacgcccaggaaatggaggttgcagtgaactacgattgtgctaccaccgcctatggcctggacaacaaaggggaccctatctgaaaaacaaaaggaaaacaaaaccaaaaccaaaaaaccccacatgaaacaccatgtttccattaacagagtaccttgcaaaacaaggactgcctgtacttgaaattccgtttaattgccttagctataggaacagctcatgttaacaaggcaaatatttcaccttgtctttatcagtttgtaaatacagaactgaatgcaagtgccaacatactctgatcgcttctgggacatggttatggagtgcagcaccttcacttttctagtgaacaataactcaggttaaacaacaacaacaaaaatggtgtttctgggaagaaggctttatagcctgaagctatggaataattcttccacaagggggaaattctaaggaaaaatgaacatgttgcagaggaatttgtaacagggtgccaagcatgcagacatacacatgtccagacataagaagcagatacatgttcccactgggagctgttccagccgcacctggaggctcagccttgactctctgacttactagctgggaggtctcaggcacgtcccacgttaagcaattgcagtcaagttgaattcaataatgagacttaaatcaagaatgagatttcaatcagcccaggtatgtgtgttgctaagaatgccccactgtctttcaatgactgtttatagctatggcatcataaaaactacacacctggtttttgtccccagttcatgacatggagctcctaaaacacttggaatttctgagtcattaataagccattttcaacctaataagatgcctctagtggacccaggatagctttaggacagggtctggacatcagaaagaccaaatatgcgattagaagattaggtctgggcacggtggctcacgcctgtaatcccagcactttgggaggctgaggcgggtggatcacgaggtcaggagttcaagaccagcctggccaacatgatgagaccctgtctctactaaaaatagaaaaattagccaggcgtgatggcacacgcctgtaatcccaggtactcaggagggtgaggcaggagaatcgcttgaacccgggaggtggaggttgcagtgagccgagatcatgccactgcactccaacctgggcaacagaacgagactccatctcaaaacaaacaaacaaacaaacaaacaagactggaactttcagccctccccctcatctccagggagggcaccttggcctggattgagttcaatgagcaatcgtcagtgatgtcatcactcacacctacgtaagaaagctccataaaaacctctacataaggggcctggggagctttgagtttggtgagcacatggaggtgctgggagggtcaggtgcccagagagggcaggggagcattgcaaccacccgccatacattggccaatgccttgcttccatttggctgtccctgagttttatccttcataacaaagcagcaagtgtatgaaagtgttttcctgagctctgtcagtcatgttaggggattattagacctgaagagaggattgcaggaacccccaatttgtagccaatcagaagtacaggtggcccctggaacgtgcaatgggcgtcttgtgggactggggccttaaccttcggggtctgggctaaccgtaggagtcagtgtcagaactgaactgaattgctggatgcccacttagcttcagagaatcagaggcctgtgtactgaggcacaggttccggctgcctctataggctcaaggtagtaagttgcaccctgggcaaaaaacaaaacaaaacaaaacaacaacaacaaaaaacaggtctttcaagactactccggtagctccgctttattgggaaggtttctgagtaatttccctgagctcgtgattggtgtcactggttagtaatgagaggtgaggcctgaaaaagacctctcactgaaaggctcttccccacaaaccacaaaagtcctcacatgcaggaacccaggggaagcaggcatttgcagagactccccgacggatgccctccccagctgcttacacttacatcgccagcgggagcccccctttcaagggtgacttcctgtgattctggaatctgtacctgcagatcgttcaggccaaggactccatcttggcagtcacagaacggtcagaggaatctggagccaggcccagccaccacaagcggtcggctctctaaacgctctgcccaggtcacctgaggaggagccttatttaacaagaagagggagccaggggccgtctccactgcataccctgcatggtcaagcagccgtggtgcgggacagggggtgccacggcatacaagcccaccagctgccactttccaatggagaaatggatggaagtccaaaaacttggcgataaaaacccagcgtcactacacaagcaaaaactgcagcaaccaacgagcactctataagcagttggggaggggaagtgagttttagtgatttacatctgaactgcagtgaatactcaccttaaagcctgcacctagacaataagactgttttaagccccacatcattaaaaccgccgcttccctggaaaatgtctgaataggccttgttctggcactgtaagcttctcagattgtccctgagacccagtggattctggctgagtctccctggcctggtgacttaggtgcggccacgattcctcacaaaatcttccaaccagaccatctccctgcccacatacccaagttctagggagcattgcaaagtggccttcaacagcacaaaccacaacttttcacatttagcaaacactacatggatattatttggtggaacatggttgtggaacacggcccgtgtcaccggcacccacttaccttctccatagcaggagggggagagaacctcttggcacaagctaggaagatgtccgggtctggcttgccatgctgcacttcggggtcatctcccagcacaatgtgggaaaacaagctgaagaactccttgtggcggcttgtcttcatatcgaacgacgcggaccccgagctggtggccagtgcaaaggggatgccatgtttccgcaggtggatgatgagtttctccgcccctggggaggaggagggaaggactgaggtgaggggcgaggcctccaccataagaccttcttgcagggacagtccctccagctgtgtggcagcacactctcaggctgctccttttgaggaatttctgacctaggacagattgtctaaaagcggttgtcagctccacaacatccctgctcaaataaaacaaaccaaaaaatcaaaaaagctattggcggttgagcgatacgtttcccaaaggaacagaagaagagcgcactgggaggcactgctgctttgcctgctgggcctccttatgaaacgtggagaagggcagagagcaggcccaggaggtgactggacctgggatctggccagggcaccggggaaggcccttcagcagggcctcgctgaaccatacttttttttccagagcagtaaatacacaaggactatgcttttggtgttttctgcaaaaatgctgtattctacagaaaacacttcaatcattcttcaccctgctaaggagaggaaattacacaaaggcgtccaccagatgctgaagaaggctgtggctgagggactgctgcagcgctacttaacaagggatcaggggacaaaagaaagctgctgaacacagctgatcaacagcaacgtgccatatgaaaagagcatcctcacactgtcattagccacacggattaactacagggaccacacaggtccatggaggtcatcatagagccaatcatgagaggactagttatcagaaagaatcaaaaataccaggagtccttcctacctttaacttatgcgactagcacaacaggaacatctaaatccacacaaggtgtgacggtttgcctaaaatttcattttatttttcagacagggtctcactctgttgcccaggctggagtgcaatggctgatcttggctcactgcaacctcggcctcccaggttcaagcgattctcctgcctcagcctccagagtagctgggactacaggcatgtgccaccacgcccagctaatttttgtatttttagtagagatggggtttcaccatgttggccaggctggtctcaaactcctgacctcaggtgattcgcctgcctcagcctctcaaagtactgggattacaggcatgagctaccacgcctggcctaaaattattttaaataattgtataatcatgcctattttaataatgtcatgatttaatgtccctactttgtcaattgttacacaaaacaatcaacagactcattttttccgaacacctacagtcattcaggataaggtaacagatatctggagcacctgaccctctaaagatttttaaaaggaaggcatggacagatcataatgtagttccaggacaaagttaaataaagcaaatgaaatcaagcaaaatctagcactccactgggtgtagaattcatagtgtctaacattcaatcaaaaattaccatgctgcaaagaagcaaataccacccacaatcaggagaaatagacacagaaatgatagagacagatggaattagcagatcatgaccttatgtaacggctttataagtattataaacacacctaagatagacactatcagaataaaaaagaaaaacaaaagacccaactacatgttgtctacagaaacctactttaaatataactacacagatagattgaagataaaaggatagaaaactacataccacataactattgctcaaaagagagccaggttacttacattaataacaaacaagcctttagaacaatgaatgactatcatcagggataaatagggacatttcataatgacaaatagatcagttcatcaataagacataattctaaatgtgtaaacatcaaatagcagagcttcagaatgcataaagcaaaaaccaatagaactgaatggagaaacacaaacgtagaaggaagtttaaaactcctctatcagtaattgataaaacaagtagacagaaaagaagtaaggacacagcagacttcagaaccactgtcaagcaacctgacctaattgacgtttatgtaatacttctcccaacaacagcagaaaccacattatttttaagtgcacgtggaacattcaacaagaaatatcctattataaggataaaactattctcaaaaattataaaatacttaaaatcatacagaataccttatctaacgatggtagaattaaaatagacattaataataggaatgtggaaaatcacaaatatttggatgttacacttctatgtaagacatgggtcaaagatgaaatcacaaagggaaactaggtaatattttgtagagaactaaaaactaccaaaatttctgggatgtggctaaaacattgcttcgatgaaaactgatggcattgagtgatatgttaaataataaggtctcaaataagtgatctaagttgccacattgaaaacctgaaagaaagaagttcaatgatttaagcttttaccttaagaaagtgaaggaaaagagcaaattaaacccaaaacaaataaaaggaaggaaataataaacatgagagagaaaatcaatgaaataaaagtagaatacagaaaaccaactaaatcaaaagcgagttgtttgagaagagcaattaaattagtagactcctagctaaactgatcaaaaaaataaagaagatccaaatgtactaacattagcagggaaagaggggacagacatcactacagattctaacatcgataaaatgataaaaacttaattattataggattaatggcaacacatttgaccatttagatgaaatgagataattctttgaaagatataaaactccctcaagaagacacaaataacctgaatagccttctgcctatgaaaggaattgaatttgtaattaaaaacctccttcccacatctaggatcaaatggccttgctggtaaatttaccaacttcccaagaaaaaaaggatgccaattctaaacagacttttcaggaaattggagggaacacctctcaactcattttacattttacatcagcacttccctgatcccaaaaccagacaaaagccagacaagaaaacgacagatctcatgaacatacatacacatacctccacgcataaaaacaatattcaatcagtgtagaagtactccacctaaagagcttctacagaacttgaatccattagttaaaaatactaaaatgccacactatttcattagtttgcaacaaccactgattagtatcacagaggactatatttattagctaaatttcaatttaaaccttaacctaactgatggatgagataaaaggctctaatttttttaaaaaagagacagtcacgtgtggcagtgcgtcctgtaacccgttacttgggaggcagaggcaggagaatcgcttgaacctaggaagtggaggttgcagtgagccgacatagcgccactgcactccagcctgggtgacagagccagactccatctcaaaaaaaaaaaaaaaaaattagccaatcatgaacttctgtctggatataaacagtgattaaagctgagtatcaaaacaatctgaatttaaaacaagatttttaaattgctagatcacacaattttaaaccaatattttaaaaaatggagcacacttaaacacatggctctgtaaaacacactgtataaaaattttcttaaagtactttggtgctattaattttaaaaacttaaacagattattttattattattgttttgagacaggatcttgctctgtgacccaggctggagcagagtcaaacaatcatagcagccttgacctcctgggctcaaaacgattctccagcctcagcctcccgaatagctgggactacaggtgcatgtcaccatgcctggtaaatttttttatgttttgtagagacagggtctccctatgttagctaagctagtcttgaagttctgcttcaagtaatcctcttgcctcggcctctcaaagccctgggcttagagatgtgagccactgtacccggccgattattttattttagcttatccttcttgcatttctattgctgtgaattatttctaaggtggagtagataaacaaacacacaccaatgtgtctagactggaatgcagctcaacattcttattgatggagaatgaatcaaaaacggttttggacgactgctttacaccaccacaacatactgagatctccaaaatgcttgggactcctatgaagatgaaagccaagacaagactatgaccacagtcagagattacgggacatccgtcaattatacgccctctttgggcctcaattttgtcatctgtcaaagagcaatgattaacgttcctcatggaattaattcacaagaagaacaatgcctggaaaatgacatgggtgaggaagccccagataaatgttaggtagtgtcgttatcatcagatatagctccagtgtatcatcaggaatgaacgatcctaatcacctgattcaaaactgcctgatgccttcacaaagtttttcatcttttaaagagtgcacacaaactttgtctcactcagtggctttccctgagaagtaaaagacgaaaaaatgcaaatggagttctgttctagggagaagctggttaattatgtgtataaatgaactccagttcccagctcctagaatttggtgtgcttccgtgggtttacaggaagggcagagagacagatatctaggtatctgttgctccaaacaatcagctcacaggacacatctccaggggaagaactggggaatgtggagaatcagcactgtgagtgggaagaaacgctcctgctttcctccatcctagagacccaaggtgggtgagaacagggatgtgcaattaaacaggattaaacaaaggaaagaggcagaagacaggcagctgccgcgcggtctcaggtgttcgtggcattcttttgttgggtgatctggccatcagaaccctacaagcctgaacattctctgtactacctaagacctgcagtgagcaacagaatcaagtggggggtaccgggggttgacaacgcaaagtgggagagggaaccgcttagagggccgtgcatgtcattaacgctgtgtgccgagaaccatgtcctgggcctcagtctagaagagctctatgaagtgagacatggaagacagcccgtgccactggggcagacgatgtggtcagctgatggatgccacctggctacctgtgagaagacgctgatgctatcccaggaccagacacacctgtgggattctgctgagcctccacttcctgcatgggcatcctaagggtgcctggcccgtcaccccaccccaccatggggaaggtgctttggcatgctgtctttcttaggggctacttttgcaactgcctgaacagcaggtgttatgcttcaaaagctttgtgtgactgagagcagtgggttgaacggtagcccccaaacagaagtcctcacccatggtacttctgtcttgtttagaaaaagggtctttggagatgtaattaagttaaaaatcttgagatgagctcactttgccacgtggaaacggaggcagagactgaagtgatgtggccacaagcccagggatgcctagagcccccaggagctgggaaaggcaggaaggatcctcccctagagcctacagagggagtgtggccctgagacaccttgatttcagacttccagtctccagaactgggagacagtcaacttctgttattagaagttgctgagttttcagtatcttgtggcagcagccccaggaaatgaacacacaggtgctctgttcttgaatgtgaatgagcagaacagacactgccaggtgtttgtggaagaagactcaaacaggcagaagacaggaatctgccagaaaaaaatgacaatccagagaaaagtgggcgaggaagcaacagtcatgataataattagtattcatgaagacatataagttactgagtccttaaaacaaaaacagaatgctagaaaagaacaattcccagaagaagaaagaacatatgaggattaaaataaatcaggagaggagggccgacacaggcaatgtcagctacgacaccaagctgtctgggatgcggttcaagacagttgtggggggcaggtggtggacagacggctgctctttctcgttccttagaaatatgtccggtttggctgggcatggtggctcatgcctacaatctcagcactttgggaggccgaggtgggcggattacttgaggtcaggagttgcagaccagcctgaccaacatggtgaaatcccatctctactaaaaacacaaaaattagccaggcgtggaggcacatgcttgtaatcccagctactcgagaggctgaggcaggagaatcactggaactcaagagacggaggttgcagtcagccgagatcacaccactgcactcgacagagaaagactgtctcaacaacaacaacaacaaaaaaaaaaagaaggaaaaaaaaagaaatacgtcgtgatttttaaaacattgacaatattcaaatatacacagaaagaaactgcctgattgatattgctttatttcctgtgaggcagtttcacttcctgaggactacagagaaaccctgtcaccctccggcctccatcctcttcctaagactcagaatctgagctgttacctgcatctttgcgggtgaagacatagctcatgtgctttcacttcctggaaactttaccaggcttctcacacccttgtaacccgctgggattcaccacaacacctccagcagctggctgcagttattgcggttgtatgtatgtggttagaaacttccactcaagaatgagtcacaacctctgcactcccaagaccccatgcagacatccagtgaataaactgcttatttcctgccgtctgttttcctcatcctcgtactccatcctctctgttcttaggaatggaaggcagtggtgggggcaggaatcattccttttccttgcagtacatgtgtgcagcatggaatagaaagtgatttcagatacatagtgggaaggtgagctagttttcctttgactccatccatggcttatgaagcaagctgaatgctggctgtgggggtgtgaggatggcccctgcactacacaacaatgctcagagtttctcagggtttgtgtttccaattaggaggccacgcttggctggcacatgctgggccctcaataaatatctatgaccgatattgaatggacaattaaggcaaaggtcattaaaaataacatttggctatgtgaaaatcactcagattctagattttaagtgttctccccacaaaacatgatgagaaagtgagatgatgcatgtgttcattaccttgacgcagccactccacaatgtatacatacttcaaaacacgttgtgtgtgataactatatacgatttctatttgtcaattaaaaaataaataagttaaaaaaatagcatccggttatccgagttcatggtggggagccttctcatgaagcggttagcattctcctttacacaagacagacctgttactctctaataagatgctgcctcctggaaaatgtgtacccagagagcacacacggtccagcagacgtcgctgttgtggtatagcacatggaggcaggggataagattcgatgtgattgacaggcacatttatccaagagaaaactttcaagatctgatggagtaatgcagggtttccattcttatttcttgcctacttgaagttccttgagcgagctgaaagcacttactgttgcgaggcttcctaaggaaacatcagttccaggttcttcacaaatgtcacacgtgatctcacaagggtaccatgttctgaacaacactgagctttggaatactagaattgttggcacttcacaatgcaaggacttgtctcgctctctgaaccctgggttttacgtgggcaacttggcaagtccacgagccttcggtcatcaatggacagtcaggggccacatgcaggaagctgttgctgtgtgaagagctgatgccctgagagagtgaccaagaagggagaaagatgtctgcaggtcaaacaggcacctgggattccataaaatggatgcaagttaactttaaatcataaggggtaagctgtgtaggtcaggtatttacaaaggggtccacgaaatggattttagcaaacttcctttaagtttaacatctgtttaacttttaaaaacatatgctgatgcatttatttcttgttcaagatttatcgaaggaaacataattccatgaggacacgctgctaccattgtgataaatggattggtcatgctcagtgacaaaagtgtctcctggaccagactctactcaggctgctctgagtctttttctccacaaggcccccacactggcctataaagacttgaacaagttcaacagctcaaggtcacaccgctacatgactctagcccccttaaagtacttgcctacgaaaactcaaggctgccaaaataactgattgttggttccagccactcctgcagacaagcctctgtggaagggcaggagcctgacttctatcagcaccagtgaaacccagatggcttcacactgaccaaaccctcttcctgctttctgcaattttcacttccccaactctgctgagcccctgctgacccctccctactccctgaatttccctttaaaatgcccagtcacctctgggataattgatgttgagcccagtttcacattggtctcttttctctattgcaatagtatattatggaagaaaatctgtgctgatcgctttaactactgtctggctgtgtttatccttgacactagaaaataaccaaagtcaaattccccaaagcatatagtattcacattcatatatatagttttaaaaactgtgactttaagtataaatttaaaagaaatattaactaatttaggaaatctggctaatatagattcttgattttttataagttctgtatgtttatctattaaaatggaaccatcacttacaaacactactgtgcgctttttagttccctcacaggaaacctctggtagccacagccactgtgagtgggcgtctcttaatgatttactgcagagccatgcctcaggctatccctcttctgatcttctccaagctctagggagcatgcttctttctcagacatcattgattttggcagagcacctccttcctttttctaggccttccaaatgaattctgctcttttgaaaaggtgcttgctgctagggagagggcccttggctgtgtgcagatcttcagtcctaatttactagggacccggcaccaactcaaagctaatatcagggatcgccacttatggaatttgcaccacaggatccggcttatggaattgagtgactaacctatatcctggacgtaagacagtgtggtagtgtggaaggaaaggaaacaggagaaaggaattgggttgaggggctggaagaggagcaaggctctggcaagactggctgaacctcatggaacactccagccaaacacgactgactgagtccgcgccccagctcagggccctcctggggcaacctgaacagtggcagtctgagctgggagtaggaaagtatgggtggaggtgtactggcttgacagtgctctccccacaaaattcatgttcacctaaaacgtgggaataggaccttagttggaaatagggtctttgcagatgtaatcaagttattatgaggccatactaaattaaggttggaccctaaatccaaagaaaggagagggaaatttggagacaaagacacacaggacgagggagggcgtgtgaaaatggagacagagattggggagttgaaggtacaagccaaggaaagctaagggtggccggcaactaccagcagctgaaaagaggcaggaaggatccttccctagagccttgagagggagtgcagccctgctcacaccttgacttcggacttctagccttctgaggtgtcagacagttaagtttctgctgctttaagccacggagtttgttaattaacacagcactaccaggaagctaatacagtgggttgaccctggaggagaaaacttggatagactgaggttctatctgtgagatgaccttaaaccatcttaattatctttctcaaattctggtacttgacacacaaatttgtgatacttgatggggagacagtgtgggaaacctgtgtttccttttttggcaaacattaaatactgacagaaataaagcagttatgaaaataaatataaactaactcctttcaaatcttcaaacaaacagttgcaagagtccagtttacatttatttggtctgctggtcccagggcaatacaggcgatgagcatccgactgcctttgctgttctacccacagctggctgcttgctttgtggcaataggtgctgtctaatgttctccggggtcactgaaatgtgatcggcctaaactcctccagccaaagaagcacctttctctagaatctcgttatcagtatcactgatggcacagcttgtgttctggtccaatttcatagacttatagcagaattttagattaaaatggaaagccagggagggcaattcaaaccactgatcaatgcctggtaattaaggatggatcaaataataaaaattaaaacaaaactatttttttcagccattgaaaataaaagagacaaagtaatatagagagtaatgcagaaattttatttaaggaaaattaattttgcatttctacattagtttttatgaagtaaacgtaggactacagcgtgtaattttttttttaagtagcaacaggattttaccaggctggtctcaaactcctgtcctcaagcaatctgcctaccttggcctcccacagtgctgcaactacaggtgtacaatgtgatagtgggactgaatggtctctctcattcctctgctaagcactaggactttagaagaaaagcctctccacctgatcctactgaccctaagtgcccctcctccaggcaggacttgacaccttaatgttaaaaatgactcaatatttccctgtgctgtagatttgtctctgtaacaacttaacgtgaaaatttccctctcactatagcatggtgtactgatccttgatccttgttttcccttataaagaatgactagactaggacttaaacaataaaatgccgttttattaatagcatgggatacatgtgagtgtccttgtgttccagatttgccactgtaacaatttacatacaaattgccctctgactctagcaagtagtactaacccctgatcccttttttaaatcccttgcagagaattattagactagtacttcgcagtataatgcccttttaataagcacatggaatgcatgagagtttccttgtgttctagatgtgcctctgtgacaacctgcatgcaaactgctctctgactctaacgttggctactgatccatgatccttgcttctctctccttttagaaaacggctatactaggaatgaacagcataatatcaacaaaaatgacaaccaaagtttaagttctaagcctcttgaaagggaggaacaaatatatagattacaggagtgtctggaaaggatgcatgttccccagaggacaacatttcagatgtgggttgccacaacagaagagtgggggctgagccgccaggcagattctcagtaagctacacagcaccacctgggggcacaggtgggagccttctccaaactcgaagttactacctgtagtcagtttttccatcagtgggcctcgaaatgttggtgtttaagagttgttgtcatgaggtaacttccttccccagagaagagttctccaggatcttttttggttgtgcataaaagagagtgaggtgaagggacctggtgggctcacagcgcagggtgcagggatcttttatctacgtcctccactgtgcctgatcaccggagatctgaagtctctctggctctgtgtataaacctgttttctgccccaggtggcattctgaatgcacagcttggggtggagggcccaatggctccactacttcacatccgggatttcaacctgctctgtggtgttttagctcttcgttttatcctgccttttgtttttttttgaaacacaaattcaacttactacctgtttttaaatgaaaagagtcaaaaaatatgatcttataacctgtgaaaatgagatgaagttccactttctgtgtctgtagagacagtttgactggagtgcagcaccagcacccactcacgcactgtttacagctacttgcttcttaacacagcaaagctaaaggcttcacacatataccatggggtctgtaaagctgaaaacacagagaaagcttattggcccctgatagcaaacaaatcatgtgcaggcccaagaggtgaaagaaaagagggggtaacatcaggaagacagaaaagtaagaggtaaattttgtaatgcaggaaatcagccaggcattgacacctaacccctttgcccccttgcctgtgacactaataggaagaattattgtcagttcttcaagaaattcatgcacagaccagataggaaatttacctcatgagagaactgccctcctagaaacggaatccaaaaatccccaacgagtttcttccattaaccacttaactaaatattctctacaagtgctcaaattattagagcgttattagagcaaattatcaaaacaatgttgagaatttaaagtatatatagtatctaaatattatatatactatataataactcattgaaaaacatatagcataagggtttattaatgtttattaaagtctgatgttcagttcctgtacttatgcagctaaatccaaatacagatatattttagcttaccatgcatagaatattttatgagccatagacccaccatttcaatgcaaccaaaggagcagaaatttttaaatttaaaaaaatttttcttagccctgtgaaattgaattcatataaatccctaatagacaaaaaggatgtatataaagatcaaatcaatttgatataccaacatgcttaaaatctccttattaaattgcgcttacaataggctgtgcatggtacaaagaaaactcagtaaaataagactcatacaacccagacagtatctgcattgggaatttcgtactattttctaaaatgtgggacattcaggaaatgtccacttccccctagctagctggtaagtgaccctttgatcatatgcctcacatctcatctcagtcttacagggacaggcagtttcaacaccagaagctcctgtgttgtcacaatgaagaggctggaggctaccatgtaagcgacccactagccccgacttcaccccaaccaggccagacacaatcagacacaatcttgtgctccccgccatgtgacaaaggttactaccactggcaaattctgagttcagtgtgcaaatgtgctatcagtttcagaatctgctctttgccctgaaaatcaagtaaaatgcattcttttgtattatgtaacagatgagaaggagatgactttgcagagttttacgttgatatgagaaagaagtggcactgaacacttccaaagggtcaatggtgactccatgaaaaagactttatgatcgtcaggagcctcctgtcctcacagaagctataccagcattctttctggagattatatgatctctgtagccagctgtcaatggtaaataaaaaagaaagggaaagataccgaggaacagtattttgttctgatcaggacacacttagttcaccacttgactgtggtaactcaggtctcctaggtttcactagaatgtggaaagctctggaaactcaaagggaaggcacatttaactggactttttattcgttctttttaagacagagtctcactctgtcaccaggctggagtgcagaggcatgatctcagctcactgcaatctctgcctccctagttcaagcaattctcctgcctcagcctctcaagtagctggaactacaggcgcccgccaccatgcccagctaattttttttgtatttttatacagacagggtttcaccatgttggccaggctggtctcgaactcctgacctcaagtgatccacctgccttggcctcccaaaatgctgggattacaggtgtgagccaccgcgcccggccttaaatggactttttctttcattggctttcttaagatctggagaacctgaccaactatctcaaaatactgaccatcctcagaaaaatatttgattttgtgtcttctttgatttgccagaaagctgcttacagtactaatttcatttactttgaatcacttttcgggttgctacttctaaggatctatcactacaaaataaatgtataaaacagctatttaaatagcttatgattaatagccaaaggaaaagatacaaactaggaaatgttaacataatagctcattcaattttcctgattttctactatagctctctacgtgattaaacaatgtaaattctcttacctaaacaagcacaagtattataaaacccaatctgaagaaggcatttaactcatcgtagagaatgccatacctgaggttctcaataaaagcagcctggtaatggcctacaaggccagggtcaaacttctccttctccgtttcacttctctgaacctgtatcctcacctacataatgcaaataagaacaaccctgactacgtcacaaaacaaacataaaagtgcaaatgatataaagattgggaaagagtttcagttttcaatttcttcacaaataagaggtaacagaaaagtattcttcttttaaataactcacatcaaaaatggattcattttgccttatgcattcaacaataagacaaaaataacagaatactttaagttatagtaatcccaaactaattttaaagttcttaacctaatttgtggactacttactataaaatatcatagtttcctattgtcaatttttttttgcaaatatttcatagaaatttcagttttatggctagagctttgttgtgaggagtttctgttgatggtgtctctgtcaatagtctcaaatattaaagtcttgctcttacagtctactctctaaggaatcctctagaaaggagagagtaagactttccctgtattcttgtgtctaccatgctatggagatgaaaggtcccaccgtatagaagtggtgcagaaaccacctcaagagagtaggcgtggtgcgaggtactcctgacctcactcaaacctgcccatgacactgggcccaagtccccatgacccaggtgcttggggcgtatgagagacacctgtcttccctgataagagtgtatgattctgttggggataaggagatgcacttatccacaacacttatgtgaaaaaccacatttgtgtctactcactacaggctttctacctcatctgcacaggagctttgccaaaacacaactccaaaatccttgaatggcttcttgccatttgaaaaagaataactattgttgtatgtggtaaaacacctacaatataaaatgtactgttttaatgatttctcagtgtacaattctgtggcattcagtacattcacattgttgtacagccatcaccaccatccatgtccagaacgtgttcatctccccaaggtgaaactctgtccccattaaatgctaaaacctccatccccctcccccagcccctggcaatcacaattctactttctgcctctatggatttgacaactctagggacatcatactgaagcaggagaatagggtctggaggcagggaaccgaaagctgattcatgctgacttcccagaactcaatcaaaaggaaaaccccaactttccatgcccaagtaacaaaaggactggatgctattccctttgcaagcctctcctaccttctctgtgtggcagatggaaaactgaaagtatttctcattggttgctttgtgcaaccatttctactactggcgccaggaggctgtgagcgggtgctgggactcggggcaagctggcagcgctctacacctggatgctcacctaaaagtcactgccctccccactccctcgtcctgactgcagtgtgcagagagtgctggcacctaacacccctcaaagcctgtctgtgcagctccacagtgctgtcctatgctgtgagcacacccctcccggagggacagtgacttgattcaacccattgtggtcatttatctactcatttcctctcctttgaatcgagaggtccttgaggtaaggatttctcttgttcattatcctatactcctaaagacttagaaatccacaggagaaccaccacacatttagaaacagaaactgggccaggtgtggtggcccattcctgtaatcctagcactttgggaggctgaggcaggaggatcacttgagcccaggagtttgagaccagcctgaacaatatagtagggccctgtctctacagaaaagaaagaaataattagctgggcatggtggcacacatctgaagtgtcagctacttgagaggccaaggtgggaggatcgcttgggtttggggggatcacttgagccagggaggtcaaggctgcagtgagccatgactgcaccactacactccagccttggcaatagagtgagatcctgtgtcaaacaaacaaagcaaaaaatataaattgtaattctttgagaaacatctccacatgcgcagtgaggtaatatctaggatgatcagaagcaaagatttgtatcttattctccttagtctaggatgtcttcattacaatttactaaataacaaggcaattagctgcctatgaaagtcactatattcagaaaagaggaataatgtccatatacatcattgaataagctgatttttttttttttttttttttgagacggagtctcgctccattgcccaggctggagtgcagtggcgtgatcttggctcactgcaagctccgccccgcgggttcacgcctttctcctgcctcagcctcccaagtagctgggactacaggcgcctgccaccacacccggctaattttttgtatttttagtagagacggggtttcaccgtgttagccaggatggtctcgatcgatctcctgacctcgtgatccgcccgtctcgacctcccaaagtgctgggattacaggcatgagccaccgcgcctggccaataagctgatactttaaaggaaaaggggggtaagaattttcatttacatttacatttgactggcaaatgggcttcttcctccctacgatcataaattttcctgaacatggggctaattcgatttgttaaacggaaaaggaacacagcgtaagttgaatgtgttaccatgactgtcagcgtacaattttccttttcgcttgttgtgtgtgtcctttaattgtgctgttatccaaggagtacaatctgcctaagtaaaaatccctgaggtccagctttgccagcagagcctctccagcgactgagaatcagctgagtgccccaaatcgagaccaccaccagaaacggagctggacgaggcagagtccccgagcactggggacttctccacatgggttatatatggccttaaagggctcagccctgtgacccgtgtcagaacacatcttctcccctttgtactctgatgttgtctacctcaacagaaggtcaccgccacatcatctggggcagtagagcgccgtggctaagagctatggactcttcattccccacctgggttcgaggccagcctccataatcagaggctgcaagcttttggacaagtaacttgacccctgcagtcctacctgccattccctgtgctaagagcgactgcttcttagcggcggcaggaggctgacacatacccccacgagtgaaagcactgagagcatgacatgcagtgagtcctcaatgcttgtgagccaacacgaccatagtggacaccaacaaggaaaagtggcatgaatacccttcaggtgcatgtttcctgaacatggcacagagaatgtgttctggggttcctaggcactgtccatcttaatgagactcgaagccccaacaccctgggtagatctaactggcatagccccagcaccgagctgtgaaatctggctgaggataggccaggaatgacaggcaggtggagacacagtttgtgccatgtacacaaatgggtccctcttctctgtgaggctcctgccacctaggtgttatactgcccctcaacactgaggcctgctgcccagacttagaaagtaatggattatcagagcggcctataaaccaagggctataattcttctgctggcttccttcttggcctggaagctgacctgggtgcttcctggttcctaaaggtaacagctggccctgaagccactggcacaggagacggaacaagagatgtgactgtgtcagtgtggacatatgaaaatctacaggactgtaagggtgtggacagcacaatacctccatcactaaggaggacaaaccaaagcagcacagcttgcctgctgaggtcttctggaagctgtccttgacacaagaatcatgttagcactgcatggactaatgcaaccttgtaagtgctcccaggcaggaagtgctctgagtgccttcccatcccaagggatgtccagcatttcagggatccacagtgacaattcatttaagagctaggaaaaagatgtcctcacttttgttagacctacttccaaaaaaaaaaaattgactaacaatttaattaaagcatttgggatttctgtcccattaatctataggtacttgctctggatcttggtgaattatgtcagcggcctcattccataaaggtgcatgtaggtgagtgtaggtgagcatatctctgtgtgcctgtgggtctacacacaaacacataggcatcataagacaaggggtgaaatgaggtaccttaaatagttaaacactgagtaacggttatctccagggagtaggagagtgggagttagaagggcttccaattttaatgctatacatttttgtaccgtgtgaaacaagtgtaatttgtgtaattaaagaaaaaaaaaaggcccagtgtggtggctcatgtctgtaatcccagcactttgggaggctgaggaaggaggactgcttgaggtagaacttttgagaccagactgggcaacatatcaagactctgtctctacaaagaaaaaaagaaaaaaaccttagtgggtgtggtggcatataattgcagtcctagccacgccagaagctgaggtgaaagcattgcttcagcccagcagttcgaggctgcagtgaactatgatagcaccactgcactgcagcctgggtgacagaatgagactgtgtctccaatggaaaaaaaagcatatcatgattgtggttttttttttatcctgaagggatattctccctacttaagatcatcctttcattcctctagtgacaaatttcatgatgcgaaaaatgatgtgtttcatgagacacactggaaaggaaaatctcctttactgaatccaccaattcaaatgctaatctcctccagaaaaaccctcacacacacactccaaagaatgttccgtctggacacctcatggcccagtcaaggggggtgcatgtcttttaccatcaccctggccttcctctggcccatctcttctaggctgcaggcgttgtgtgccacaaacccagaggattctccccaagtgcaggttgcattctgacacgcctccttttaaaaatcccaatggttctccctatccagaaagcaaacagatgagctggggaataagaagctcaactcatagagccacaattcctctctgaagcttgtgagccatgagaagcttggcttcatgctgtatagaagcaaactcactggctgactggaatcctccacaggtgctgttttccttttgaaatggcttctcccatctgtatctcttctgttcttgtggactcccccgaggtcaccccctaccccaggagcggccactactccaagaatatcttgctttacttaattctacatccctttggcatctctttcctgaatttctcattttgctgtgcaacaatatcctaccacgggttttcacttggatgctgcagatatgcctgtcccctctccccaaatggatgacatactccattaggaaagagacctttctcctgtgtccccccgagcactcactcagcactacatgcacgagagttcagaggaaagagaggcaagttgttagctgacttccagaggatgagtgccttcctgccagatgctcctaatggaaagggtgggggtgtatctgttaacagccaggaagacaacggtgtaagaaaataaaccaagaacaaaattaaaaagaaaaaaagtagaaggatggaaacaaccataattacctaagtcagcctgaggaggaaggcttacttacaagaggaagacacagcttggacagaaagaggactagagcccatgtcatgtgcatggtgtccatgtcatggctggtgtgtgcttttcaacgaagccgagcagggatggagaacgaccttactaactcctcaaggtgggattcagggtgaggactggatcctcctgggttaggagatgacacaagtgcctgctaggagccactcactgggccaggtgtaaccacacatgctccaaggttgtcttacagcaatgccccaggtgttagtctgtttgtgctgctataacaaaatatctgggactggacacttgtaaagaacagaaatgtatttctcacacctctggaggctgggaagtccaagatcaaggcatcagcaggtctgtctctgcagaggactgctccttgcttcaagatggtaccttgttgctgtaccctccagaggggaggaatgctgtatcctcaggtgacagaggaatggaagagcaggccttaccctctagtcctttcatgacagccctaatcccatccatgaggctccaccttcaggacttaatcacctcctgaaggccccatatcctaatcctatcacactggcaattaagtttcaacactagatttgggggacacattcagatcatagtaccccacagtgggcatgtcagtcagtactcctactgtcctaaggggactggggctggacagcaggaggagtgctccgctgcagagctgtgactggacccatcctttctaccacacaggccacacctgctccctcccctcagccacctaaggggagctctggcacccatccacgactctccagggggccagggttctagtttgctttttctgctccagatggtctgagagggggaaagtagagggcaggaagttaacaccagagagcctggtgcaggcggtaagggccaagagatgcaggggagagccggccaagagatgcaggggagagccggccaagagatgcaggggagagccggccaagagatgcaggggagagccggccaagagatgcaggggagagccggccaggctgaggagcacatctgcaaggcaggctgtcctttctactggcccagataccatgccctgggctcttcctctaggaatctcatgcttagtgaaaacacatgggaaagcagagagctgggacaacagaaaaaactcctgggggattctacacaataaaaggcaccaactttcttcttattggtctttgaatccaaattaccctcgctgagttataatgaaatgtagaatttcatctgtcccaaggaattcattactgaaaggatttgttcaagatacaatggaggtaaccagcataggctatgttttaaacaagattttctgatatcctaagtgaagattttttttaagtaatgtgacatacatttccagttgtaatacggtacctatttttaaaatccctagaaaactcacaagagatgaaccacatgcattttttcctctaaaatttgtgccacaatttaaaagtttattttcctaaaataatttaagccttggctgaccgacagtttacatggaaccatgaagccatataagaaatgcctacagaactaactgctcaaaaggatttcccactgaggacatcgtaggcccacccaccttttcatagagagggccttccagaaatgtgatgatagcaaataggcagctgatgtgcgagtgcatcagggccactctgcctcgtctttcaagtccattaggtccaccttgtcttcttagtggctagactggcccaggcaaagagccctcctataccatgaccaggcagactcacctctgcttcataatcagggcaaagatacacttctataccatgatcaagccaaagatacacctctgcaccataatcagggggctgattccttggtgactggcccaggcagacatgcccccacatcatactcaggctgatgccctggtgattggccaaggcagacacaccctgcagcataatcaggctgattccctggttattggtctaggtagacacactcccgcagcataatcaggctgattccctggtgactggccaaggcagacacccatccgtcccccacctcaccccatcccgtccccctccccggccccctaccacccacccaccaacagcataatcaggctgatcccctggtgactgaccaaggcagacacacccctgcagcataattggactgattcctcggtgattggccaagacagacacacccccaagaataatcaagctgattccctggttattggcccaggtagtcatgtccctgcagcataatcaagctgattccctggtgactggcccaagcagacaccctcctgcagcctaatcacagcacacagcccctgcagcatgatcaggggctgcttcccctggtaatctaccattcactccggcaatttaacttgctaaatacctccttgggttcggctgtcgctctgaaagcatgtgaaaaagaatgacgttgaattaaaaagccctccctacagacagctttcttttctaaagagctcaaggtcatttccacaacctaacataccctaccagaaaatacttccagaaggaaaagaaacaaagtcaagggttatattatcatctacaccttaagaacaggaacaaagtagtaagtgagcaaaatgaacacctagaagaaagactacagcagcaagtttctctgaatctagtcaccagagcaatgacgctataaggtcaccttccgaggggaattcaggtttggcgcagataaaagaggagatgggaggagtgcaaaatgaatggaaactaggtctccaagaatgttctttcaggacagaagagctattttatcttcatttttgtgactggtataatattgagcagaaaccctaaggaagaacacatttctggattggaattaggcacggcctgtctttctgctctatacattcagtccaacattgtcctcctctggcttgctttcccttcaggttaagtatgatttctaataattttgtcttatcctacacctaactcgtttcagaataccaaagcggcacatcatctgaccactgtccctgcacatcatctgagccagcatcccagcatgattttaagtttcttctctccagcattaccttgtgcatttctgtatactcttcaagtcttctgcatgctctgctctgtcaaagcacagctaattgtgtatatggcatgtagatatgatcattttcaaagagagactttcagtattgaagtccctactcgcaactgagcggctagtaaaagttaaaataagtatatgcgtgtgcacacacacgcgcacacacaaatcatatgccaaaaaacatgatttgtcaagtcaaaaaaaaaaaagttaaagaggtcaaaaagtagtaaagaaagaaaagagagccatctagataagttctataggactgaactatctttgaagaactagctcctggctggttgttcaccttctatgagtttctatgattggcaccttacttaatctgatacctgctcgcttagaaagccaaatgaagacactacgttgatgggatcaccaagtagattccataaaacagattcactagcactccagccaaactaccagactatctagataaaacatttttttctttttaagaattgcagtagaacatatttcaagtatatcttagaatatagaacaaaaagtgtagaaagaaaaccatgtgaaaggcttgggtagatatggaagaaataagacacgtgcatgcctcatacatcatgagtgctttgtaaagtcacaaaagacactcagtcacagagtaactttatggacaaaccttagctacattaactaaaaaaacaaaaaacaaaaacactcatatgactaaaatcagaaatgcaaggggcaacactacaaccaatgccacaaaaataaaggagaatactatttgttggcatatcctttgacaacaaattggataacctaaaagaaataaaagaattcctagaaacacacaacctacccaaactgaatcatgaagacagagaatccctgatgattttgagaagggggaaaaaatgaagacatagaaaatctgaacagatctgtaagtagtaaggagactgaatcagtaataaaagaaaacctccccacaaagaaaagcccaggaccagatggcttcactggagaaccctaccaaacatggaaaacactatatgaaaaacaaaatacagatcaatatccctgatgaacacaggttaaaaagtctaaataagatattagcaaacaattccacagcaaattgaaaggatcatatacatgaacaagtgaagtttattcctggaatgcaaaaatggttcaacatatgaaaccacatttacagaataaggaaccaaaaaaaaaaaaaaaaacaaaaaccgcaattgatgcagaaagaaaacgcatttgaaaagctccaacaccctttcacgattaaaaacagtcaaattaaggatagaaaaaaaaaactacctcaacatattaaaggccatatatgagaagttcacagctaatatcattctcaatgaagactaaagcttttcttctaagttcaggaacacaacaaggatacacactcttgtcactactagacagtataataatggaagtctcagccaggcaattaggcaagaaaacacaacaaaaggcatccaaactggaaaggaagaaacaaaattatctttgttcacagattacatgatcatatatatagaaatcactacaattcaacatattaaaaaaaaaaacccaattgttagaaccaataagccaattcagcaaagttgtagaatacacatcaaacaaaaatcagttgcattttaatatactaacaatgaacaagttgaacagaaaattataaacaatcccatttataatagcatcaaaagaataaaatacctagaaataagagaagtgaaggacctataaactgaaactacaaaacaaaacactactgaaagaaagacacaaataaattgaaagacatcttatgcccatggatgggaagacttaatattaagacattcatagcatgcaaagcaatcctacagattcaatgcaatccctatcaaaatcccaatggcattttgagcagaaacagagaaatacatcctaaaattcataaaaaatctcaagggatcccaaatagccataacaatcttgaaaaagaacaaaatcggaggtctcacatgtcctgatttccaaacatattacaaagctacattcatcaaaacagtgcagtactggcctacatactaatagaatagaatagatagcccagaaatacactctcacgtatttgtcaaacgatcttcaacgagccagccaagactactcaatggggaaaagataagtctcttcaacaaacagtgttgggaaaactggacatccacgtacaaaagaatgaagctagattctaattaacaccatacacaagaattaactcaatatggattaaagtcctgaatgtaagacctaaaactaaaactccaggaagaaaacataaattaaagtttcatgaaattggaattggcaatcatttcttggctatgacaccaaaagcacaggtaacaagagcaaaattagacaaatgagatgacatatgtcaaattcatctaatcaaaaacttatgcacaccaacaactaagcgaaaagggagccagaatgggagaaaatggtcataagtcatatgtctgataacagtttaacattcaaaatacataaggaactcctacaacataaaaacaaaaacacaaaaatcaaaaataagcaaaggatgtgcacagacatttcttcaaagataatacagaaatggccaacaagcaaatgaaaagattcttgccatccccaatcatcagatatgcaaatcaaaaccataaagagatatcaactcacacccattaggatgactactatcaaaaaaatccaggaaatggcaagagttgatgagaatgtggagtaattggaacccttatagatttttggtgggaatatacaatggtgtaacaactatggaaaacaatatggtggtcactcaaaaattaataataaaattaccatgggatccagcaattccacttctgggtatatcccaagagactagaaagcaggatctcaaagagatatttgtacactcatgtttatataagcattattcacaagaacagccaaggtgtggatgccacccaaatgtccctcaacaaatgaactatgaataaacaaaatgtggtctaacataccatagaatattgttcagccttaaaaaggaggaaaatcctatcacatgctctaacatggatgaaccttgagggcattatgctaagtgaaataaaccaatcaaaaaaagataaatactacataattctccttatttgaggtatggagagtagtaaaaatcttagaaacagaaagtagaatggtggctgccaggggttgagggcagggcgaaatggggacttgttcaatgagcacgaagtttcagatttgcaagatgaaaaagttctggaggtcaattgtatagcaacatgaatagacttatcactactgaactgcccactttaaaataggtaaaatggtaaattttagtgtgtgtgtctgtgtcctaccacaattaaatttgtatatagtaactgtatggatgtgtttcaccaagacttatcaaggtaacttcatgtgcaaatggtgcagaaagacactagatgcagagaactgagtatcacgatgctcgtacccatgcctgagattcacaaacactaccattttcagtggatgcagacagagtgattacaaagggtgtgtgtttgcatgtgtgtgtgtgctgcccaggaatggtcaatccacatgtttggacatatgtataaatataaataataacatacatttcaaaagtaggtatgcttcatattaatatcattttaaatccaagattactcacataactgctgttttttttctcccctagcaccaggaattctaaagacagagtattcatcctgtatatcccagaaaaatcttcaaatagtctattttcaaggtctgtaatctagaatattcttgaacaaggagcgtcaggcaagcccgttctgattgaatgtcagttaacaagcacggagggaacaaagttgtttttcctttccgaagaaaactggatacaagtaaagaaagggctgaacggcatataaacacacaggctaaaaatgaattcgactttttacttttttttttttttaattaagcgtctttggggagatttagctgcttatcaatttgttaaagtttgaatagttgctgaaatattaatcctatatctgattttgaaaagaaaaaggcaaaaccatctattaaggtaaactttgaagacattctgtcattaacataatctttatatatagtaatataaacaatactcaaatgtttttggaacccagaaatcactgaaactaacgcatattattttaagaagcttttaaagagaaaattgaatcacagcatcccacagcatcagccaaactctttcaggagcaccaggagggacttagtttagatactgaagaaaagaggacaaactaagcatgccctatgctagactttaaaggtgatttacaaaaccattgctaatagtcacaaacataaccctgcaaacagcgaggcaaccgcacctggcatgagcgcagccgtggggaacacttcctttaacttcgtttggctttcttccaccagctcctctttggacatcgggagctgcaagacgtctattataatctgtgccgcctctaatgccttcttacccataaccagggactttacatcccagctgtatttcttgtcatagcgattacatatttcttgaaacaccactgaatacagccgttcagtatctgcaggaaaaaaaaaagagatttttagagtgcatactgtatgaacagtaagtttgtatcaggtccgcataaacatacactgtgtaggtctcattccatgaacaaaggcttttgtggagacctaagtgaacaggagaaaggcttgcaggtcattctcactaaattatactatgggcagcctcctctcaaggctgctggagttatgtctggagttgtgatctggaaattcagaactcaggagagaaatgaaatctgtattattgtgttttctgtttaaatgtacgtatttgaatctaaatatatccttggaatggtcaattccattcgatagcacaaggcatcattactcggtgttcccaacaacatggaagccagcaccagctgacaaagtccactgcatggcccactagtattaaggacatttccactgcccagtgggatgaatccccaccatgcctggccaggatgctgctgtgaagctcccaggtaagaacagaacatttaatgcacaggctgtcacgggatggtgaaagctgacctgagaattaactcccggctcggcacttactcagggcacagcctcagaaacatagtgagcctgcaggtgcctgctttcctcacgcttacacaagatgaacaggaatactgctaataatagtaccagtaccactaatatacgctagattacactacatacaatataataactagtactggctcacacccatttctattcatgtgttttttctgtatgtatatttaatatatacatagtatcaattgcactcatattaccaataagaatactactgaggatgctactacagtgaaataatcctactttacagaatgaatatttcagggcacataagtaacattctagtgccagcctcctagagcatgcttgttacacactagctgtcttccccactctgtctccagtgtgggcctagaaagattactttactgaagaaccaactaactgacctgctaggaggcattatgccaaaaaaaaagaaatacttcaacacagaggaatgtctaccaagtggaatttcaaacccaggtaagctccatggagctgagtgttgcctgatgacaatccccccaaggccccagtgaaggcagaaggctatcccaaggcctgggcagagtccttgtcttccagtctgcggtggcacagaggcagtccctgaacccgagaggctggaaatagccctgttcacaactgatttaagaagaagacacacggatgcatctgacaaaaatctggattcaaattcagttaggagactgaccacctgttctagatttagcactgaaaccttcccacagggtgtggagcagcattagcaggacgtagtctaccttgaatctgtacagctggacccaacaagaagtcctgaaaagagcaggcgatctcaatggcctttaactgtcccacaatgacataaacaaatacaataatcatccctaaatactagtttttttccctgtaagatagtatctgggagacccaggacacactgagggaagtaacgtgtacgcacagagaaggctatgtgtatccaagaggcatgtaagtcttcatactcctatgtatgttcacatgcttacatgcacataggtatgcatgcttgtctgtaattgcctcgatgtgttttgaaagttggcaaggtatgaactgcgactaaaggagagttatggggcgggcgcggtggctcacgcctataatcccagcactttgggaggtcaaggcaggaggactgcccgagctcagtagttcaagaccagcctgggcaacatggcaaaaccccgtctgtattaaaaatacaaaaaactagctgggcatggtggcatgtgactgtaatcccagctactcaggaggctggggcaggagaatcacttgaacccaagaggcggaggttgcagtgagccaagatcgtgccactgcactccagcctgggcaacaagagcgaaattatgtcttcaaaaaaaagagagttagggcaggttttaactccaaaatatctgctcctcccagataggcatgcagagagctgcctgcaccacacggcaggattcgctgtgtcacacatggaggaggccgggaaggtctcttgtgagccgctgcaatggtagggccacctgtgctttgtctcctgcatctttctcacagaaggtgaatggtcatctgtgtagacacaaggcctgggcagtcaatcatatccaccacctatatgcaaaattcctgaatgaaccaagggcagagtgctgctgtcttgagaaaaagttttccgtgtggccctgtatcatgttccttcagcagcatccaaactgcatctcttgactgcacctgcagcatcggctagggctcttgccgccttatactcagaggactgggctcactgactgctttggctgccacggtgtggactttgcctctgtgcacgcttctctcctggtcccagggctcactgcacttgcctggggaactctctggctcttcctcctgggatggggctgaggctgggcccagtccaccctgtggacactggagaccaggagaggctggttattgtggactgggctcttccttgggcttttgggtggcccctgccctgcactccccatcttccttcctccccctgtgcactgaccccctctgtggccctcttccctgcagaagacccctggcttctccacctcctgatggatactctggttttgactgctaacagcaacaagaagagccctcctctgttctttctctgcttttcttggcaaatccacccacagctgcatctgcaggtgccatttcattttcagcactataatatttttctccttgcttttctaccacaagctgtatttttttcatttatttttttgtttgtagacatgggatgccttgccctgtggcccaggctggtctcaaactggtggcctcaagtgattctccagcctcggtctcccagtgttgggattaaggcatgagcctctgcgcctggccacaagctgtattttattaagtttgctgtaaaacacaccaaacaaacctcagaacctccaccgttctggatactgcagactgtgaaggcccaatccctgaatggagggctcaaagccctttaggagagtacaaaagacaggactcttagaaaagtctgggctggtttgtagaagtcgaagttcaagtaacaacctgagtaactcaaggcttcctggattccatcctgcactcggtctccctacagaagctgcagaacagaaggaagggctggcccaccctcctcctcaacagctgagtggtgaaaagcctcctctaagggagggttacccaggcatgagcgctccttttattttcttcttctctgtgagggggagaaagagccaaggctctcagggcaaggagatggacggattggcagtgaggcggcacattttacttccttgagtgtttgttctagtagttgagagaggaagattgacaaaaggaaactgcaggcatcgaacaagtgagacaccactgtcgggtttgaaaagccgagtgaaggaacagaacagagggcaggcaggacgatggaggtgctccgtggaactctgactaaggcgagtgtgcgaacaggaagaaaggagtgtggacaaaggcaggaaaacagctgtatcctctaaaaatgcttccaacagtgtttatttaaagcttaaaatgtcatggagcttttaatttaaaagacacagaactgtgggattataaatctgtaggggactgtgcagacagacacttttcctcaccatttagataaaataatcctaaatccgtggaataagaaaggatctaaacaagtaattaaactcctcagatcaaatgataactacagctgttgatgatggcacacttaaagggacagcgttgtgaaaggaaaaatgctgaaataaaataaaggagcataaaacacttgcactagggccatcagatggatattcttccctgcttactaacaagcttgcagctttaacattgcttcagggtcctttttaccaggaaaggtcatattgtttttaacatgctagggccacatacactactaccctccttaggagaattagaaaatatcccttgtgactgtgaccactcccctcctcccagctggaatctgtgtggcatgttgagagcagcttctgtagtagctgcaagggcagcatggggagggggagagcctggcagggaggtggaagctctgaagaagctacagggtgccccaggctggggcccaaagactggcgggtgttttcatcctcagaggcagcctgagttcccgggggcttatgggaggcattaaggcttaaattaattcaactgttatggaagccctgtgcctggaggaagtctaggccgatggcctctaagtttctgtctaaggcggagactgggtaattgctgcaaatcaagtaacattttataactgaaaatgtatcttaaatgctcactaagtccgcccctgaggcacagtggttgatgttttacccaacaaagatataaaaagcgagggtttctccccaactgctctctcagggagctgtacctgcttaccatgcaaatggggacctatcttcaattttataactgtgagttgcgttatttacggggaaaacaccttgagccaactgtcattaagaagcacatatggtgatacggtttggctgtgtccccacctaaatctcatctgttacatgcagccctgtgaagagaccaccaaacaggctttgtgtgagcaataaagctttttaatcacctgggtacaggcagactgagtccgaaaaaggagtcagcaaagggagataggggtgcggcagttttataggatttgggtaggtagtggaaaattacagttaaagggggttgttctcttgcgggcaggggtgggggtcacaaggtgctcagtgggggagcttctgagactcattgtccaggagaaggagtgtcacaaggtcaatcagttagggtggggcaggaacaaatcacaatggtggagtgtcatccattaaggcaggaagtggctattttcactttgtggtttttcagttgcttcaggccatctggatgtatacgtgcaggtcacaggggatatgatggcttagcttgggctcagaggcctgacaatctcgaactgtaatccccaagtgtggagggagggaggtgattggatcgttggggtggtttcccccatgctgttctcgtgatagtgagatctgaaggttttataagtgtttgcaagtgcctcctttgcccctttctcctgctgccttgccatccccttctgccatgactgtaagtttcccgaggcctccccagccatgtggaactgtgggtcaattaaacctctttcctctacagaatacccagtctcagggaagttctttatagcagtgtgagaacagagtaacattaatacacatgggaaggcctgattttgctcctaccctcatgttcatacaagacctagggctttggggacccaagagacctgcagaaaactcccagctcagctgcacgccctgggacaagtttcttagcctgtctaacatacgatgtttattggagaaatgtatttaatagccgctgacctgcagagcgggggtggccttaaagctgggggtggggtggggcggggggagatgctttaggtgtgggaggtggcaggcagcccaggcagtgaagccaggtcctctaaagcctggtggtctttcgggaaaccccaactctgcagctttctagccggaaactctggaagctagcagccttgggtaaagcacctataaaatgaggatcctattcatactgcaggtcttataagcctgctggaccttggcttgcacacctctaaaatgggatcctaatgatgtagtcatgccacacaccttctaggcggttgcgtccatggagtgaaataatctgtgttgtgctctgagcgcttggcccagaattacctctgagcatcaacatatggaatcattagggaatgcttttgttaaccgtgagttatagggaattgacaagatctgctgtctcccttaacagcaacgctccagtaagagcaaacagctattgaacttgagaaactaaagtgcctcctaccaaatattttgcttaaaaaaaaaaaaaagcaaacaaaactatcaattatttggaattcaccaatacatcacacctgctaggcacattaaaccagcttcacaaacacttcttaattgccggggctgcagaggaacaaacacagcctctgttcccaattccataacccaaaagcttctgaaaacactgcaaaatctgtactgggctagcatgaggtggttttaatggtccacatttatcatacttagtgcgactcttcaagcacttccctatagaaatactaatggatttgattacgggtgctgcctgagaacgttctgtgtcatggaacatatgaattctaataccttttaaaaataacctatatttaaatacatctggctccatagattttgggtaacggattatgaacccgagtttgtgaccgcttacttatgaagttacactttgtgcatcttgcacaactgaatctacttaatgctttttttctccaaaactaatcttgatgtatcttgagcataatttttattcccaattacaaaaaagagaaaaaacttaaagccagtgttttgtgttagataggctagttccttaaagacacaaaataaactacaagaaaggctgatcttgagttagaatcaaattgtcacaatctgacagttatgaagatgttagctgactgtgtgtgtgcacgttttaagagttcagcttttctttttgagacaaggtctcacctgagtatagtagggtgatcacatcccactgcagccctgaccccccgggctcaagtgatcctcccgcctcagcctcccaagtagctggggctacaggtgtgcgccaccacaccaggctgatttttaattttttttgtagagacacggtctccctatgttgcccaggctagtcttgaactcctggcctggagtgatcctcccactatggactcccaaagtgctgggattacaggtgtgagccacggtgcccagccaagagttcagcttttcactgatcatgttacaaaagaggtttcttcaaaaagattaaagcccgtgtcctaagtagatccctcagatgcttctttccttgcttgcacttccttctgctcagctggggcagcagtggaggggcaggactgcctacaggtacaggtccagcagcccccatgctgctgcagaggaggttcccaatgttgactctggctggggaaatggtacaggggcagaactgcctgtaggtacaggtccaccagcccccatgctaccaaaaaggctcccgatgttgacactggccaggcccttgcaaacaggtcaggcccaaaagtttcaccatttacactagctgctttaatgagggcgacggtcttatgtgatggtcaccacactgcactgtagaatgagggccgagtagatgcaagtgagctcaaacaaagatggaggccatggtgtgggcgagtgcggggctggtgccaccgggcagggtgctagtcacccaatgagtgacagcttcacaaggccttagcttcctcggaagggctaagcaccttaatggcagctgaggaaagagggtcagcagtgttttgaatgtgtgtaaaaccacattttaaagtgaagttgctttaattaaaaaacccaacatccagtacattttgatagaagtggtggtgtcatttttctgaaccattttgacagtacatagtagctaatcagtaattgttcaatttatttaaaatgtacaccactagtattgttcatctaagatattctactgcttgtttcctaaacaccttgattctcgaaatgaggtccccggaccagcagcatcagtatgaagtgagatgctgtccaactacatattcttggactctgtcttattccattttctgctgcttattaacagaatgcctaaaacgtggtaatgtatgaagacattcatttcttacagttatggggactgagaagtccaacgtcgaggggacacattttgggagggccttcttgctggtggggactccatggagtcccgaggcagcacagagcatcacatcttgagggggctgagtatgctagctcaggtctctctctctctctctctttttctttttttcttttttctctctttgagacggagtctcgcactgtagccagggctggagtgcaaaggcgtgatctcagctcactgaaacctctgcatcccaggttcatgcaattctcctgcctcagcctcccgagtagctgggattacaagtgcacaccaccatgcctggctaattttttgtagagatggggtttagtagagatggggtttcactatgttggccaggctggtcccaaactcctgacctcatgatccacctgcctcggcctcccaaagtcctgggattacaggtgtgagccacagtgcccagcctcctcctcttcttacaaagccagcagtcccactcctttgataacgcattcatccaacaactcactaatctattaatccatgaacgaaagggtccattcatgagggcagagccttcatgacccaacacctcttagagaccccacacctctcaatactgccacattggggattaagtttcaacatgagtttcagagagaacaaacgttcaaaccacacagcaggccctaccccagatctacagaatcagaagctggggtgggacctagcaatgtgtgttttacagagccctctcagtgatttgaatgtgtgctcaagtggagggccactgacctggcattatgttttcatgtaagacttgtgctctataaagttgtgattttaaaaatatatcaatcttaactaagaagtgcttaattgtacatatacaaatgtacaaattagtacaaattaaagaataaacaatctatgatgatattcatcccagtacttactttcctttatattgtaccccattatggtttagttacatttattttcctatttccttctgtcacccccaaatcagacttatgttaatgtgtttgtaatgaaagagagatttaaaaataaggacccttaaacatgccccattctttctcaagttaactgcagcaaatgattccaataaattggagttctcagttaataatagttaattaggcctgcatcaaatgagatgtagaattcaatgaaagttatgcacagcattctcacggacatggccagggtaaagtgcttatgaagacatgccctaataagctagctcttttaaagaaacatgcatcttggaataaaaacactgacaacttaatggaacataccatatgcaaggattagttaattggctcaactctcttaaatggaaatcaagaaaaaaacattttctaggctggaatcattacatatgaaatcacagttgtccttggtgaccttcttttgagagtaactactgaaacttttacatcgctatatatatatgttctaacataagatcctccttttcttctagtgaaagcatttccagctttatgaaagatattggaaaataagggtcaatttccaaaaaccaactttcggtcagtaagtagcacagcaatcctaaaaactgagctttgaactacataagctaggaaatccagcccttcacagcagaaaggtttcagccttctgaaatggctagttcagacagctggggttgccttgggctttttttgaccttcttaaccagccaagcttacttagtaatccctagaaccctaacagcaaaaactgttctgaaaggtcactgtgggcaacagctgtttcacattgctctctatgctcctggcacacagcacagagcccagatcctgtcggcagcgctatttcacttcactcccagagtcacgtccacgcacgtggctgcaagggggagctggcctaagcctgcagtgaggagtgaggccaaaccacaccacctctttgcatggactggaagagtctatctgctcaaagcatcctagtgtcataggaaggcattattacatttgcgggaagacaagagaagcccacgaaaagaccagattctggtaaatgaggaggcactgagttaagttataaagataactgtccatgtgtgaaggtaaatgaaaatctcttcaaatgagaacgagcagaggctattcattcagagattgcatagcaagaaagttggacaccagcacttgcctttggcagaagctcaaatgcaggttggggagctgggaaagctttacagttggaaaagggaggcttcaggtgggccctgactggaggctgttgtgggggctgggggtggctcactagaagtgaggcatctcatgggattggcttgggaaacattttggctctctggctggcggtggaaactctgtaggcatgcctgagacaatcaagtcccttaaaggagataagtcattgagctggccaaggaccctgggctgccgactagactcatgggatgagtgtggctgccctcctaccctggcctgcctcctggtttcttcccagccaccttggccatccgttagcaaacccctagcatgttcccaggtggatggtgggccaggcacttctctctgggccctgggacccctgccctgctcagcctcattcaccattctatattccacaggcactcctgcatcccttaccacatgcccttgcccagcctttggtaatgaccaatcagaatgaactaatctccatgccccctctacgccaaaaagaccctgcatcaggtcagtgtttatgaggagaaactgcattggtcagtaatagagtttatatatttattccctcccaaatctcatgctgaattgtagccctcaatgttggaggcagggcttggtgggaggtatactgatcatgggggcagatccttcgcttgggccatcctccacttggtgatcagtgagctcttgctctgagttcacatgagagctggtggtttaaaagtgcatggtacctccccccaactctctctctggctcatgcttttgccatgttacatgcctgctcctgcttacccgtccaccgtgattgtaagcctcttgaggactcccccgaagcagctgccactatgcttcctgtataacctgcagaaatgtgagccaattaaaccgttgttcttctaaattatctagactcagccatttctttaaggcaatgcaagcacggcctaatacagaaaattggtaccagaagtggcgtgttgctacaaggatacctgaaaatatggaagtgactttggaattgggtaacaggcagaggttggaagagtttggagggctcagaagaacacaggaagatgagagaaaagttgcagcttcctagagaacagttaaatggttgtgatcaaaatgctgatagtgatatggatggtgaagtccaggccaacaaggtctcacatggaaatgagaaactgagaactggaggaaaggtcacacatgttatttcttagcaaagaacttggctgcattctgttcatgccctagggttctgtggaagttagaacttcagggtaatcctttaggttatctagcagaacaaatttctaagcagcaaagcatgctatgtgtaacctggcttcttctaacagactacgctcagatgcagaagcaaagaaatgacaaagttggaagttatatttaaagggaaggtagagcaaaaaagtttaggaaatatgctgcctggccatgtggcagagaacgaaaaagctttttcaggagaggaattcaagcaggctgtggagcaaccacttgccagagaaatttgcatatctaaaaaggagggaagtgctgacaccaaaacagtgggggaaaggtctcacaggtatttcagaagtctccaaggcagcctctctcatcacaggcccaggggcctagaagagaagggtggtttcctgagccacgcccagggcccagctgcctcaggacactgctcccctcatccccactgctcctgcttcagccagggctcaaagggagctcatcctggtgctctgtaggcacacaagccacacgccttagtggcttgctttctgtatagcctacagaattgtgagccatttaaacccattttcttacaaattacgtggactcaggcatttctttatagcaatacaatatgtcctaatacaatcaggaaactttaacacagtctggagaactgtcacacttatgtgggcttggatgctgacatatttgggttttaccctttgctctattctcaaggcctgccattaccagatctaattcatgtatatattttcttatcccaatgtatagcagaaagacactgtgatttgcaggaaacactccaaaactatagaacagtgaggctgagtgtgagcaaaaatcagaggtaagtatgtcacaggaaaaggaaatcaaagttagtgctgttaaagtccaaaaacacaaaatatattcctctcttttaggttttctgcaatctccatccaacttgccttccatgaataaatacctgtctataaactaggagaaaacccaaacctacctggttcaaaatttaacggtatggtttgcttgttttggttaagtactgtactgcacccgtatgactggctcactgctccttgctgctatatgtgttatttcatttacactgtggaaactgaagaacaaaactgtaatgctatgaactagaatccaaacgaacctaaaattgactttccccttaaattaaaattcagtccaggtttccagtgactgagcacagagccccttctgagacaaatatttctaagttgggaccatcctgtgtcacacaagtaaacataacatgtaatattgattcaaatcatagatgaaaaatctcgagaagccagatatcccgggtatgcagaaatggcacatgctcagaatacaatcagtttaattaaacaaatgttgactgggtacctactttgtgctaggcaccaagaaaaatgtgacaactgacatggagacagtccttacaaggttaaataaatcagtaatcagaaatgataagttcattaatatattttgaaacaaatactgacaaagagaaaccttgcaaaaacagtgattaagaatacatcactatgtaaatcagaatgtttttctcacctgaagacctatccatatgtcaccttcagctaactaatttcaatgacctattatctaagaaatgtcctctcagacccgaaaacagaagtcaggtagaagcaatgttacaagccaagcacaaattcctagcagtatgagaagggagaagacacggtgatgagaacatcaaatgatgagaagtgcaatcatctgttcttcaacaaatgttgcaagttgttaacacgctgtgagcactaccgcgcttttccctacaaccactaacgtattttgtgctttatatatacaggatagaaacttccacagcaccgtgctgtcactgtttcacctttacaaatgagcctgcatgtaaatgctagtgctttctcgtgtttaggaatttaaaggactgaaatgaataattaagcataaaattaagagtctcagtaatattgcctcaaatgagaagcttgctctagtgggcttagaaaaaagtatttaagtatttgatatatcgcttcctgtagctgtaagctatcatttttgaactgtagagaaaaaataataaatatgattgcttaaaatagagatctgtaaagataattgagtgatcatctgcaaagtaaaactcttgattagcatgtggcataattcacaggcattagcaattctatttaataggtatgggaattggtctaagaatttttttctcatccatatttaaatttaaaaaatcacttaaaaaatgaactggttcaaaaggtgttgctagaccatacctatctgtatgaaaacatatctgtattggggaaaaatattgatccctaggatcataaacctctgtaaagaaaacaggagaaaaattcttggaggcttggattatgtgaaggttttatacatagaacgcaaagagcaagggtcgtacgagaacatatggataaaggggctttcttcaaaattaaaaggcacatacacataagaaagcaaaaggcaagctacagactgagggaaaatatttacaatacatacatacacacatgcacacacagacacccaaaggactcgtatccagaatacgtaaggaactgaactttacaactcagtgatgacgcaatctgcagtagagagaataattgtcccccaaagatgtccaagtcctaattcccagaacctgtgaatgttaaattccatggcaacagggaatttgcaaaagtaattaagaatcttgaggtggggaggtgaccctggattatccaggtggactcaatataatcacaaggtccttataagaggcggccaggagggagagagagaaggtatgaagaggagcggtagtcagagcccaggaatggcggccactctaggagctggagaggcaaggaaacagccaataccccacagcctccagaaaggaacacagccctgccaataccttgattttaccaactgagaccaattctggtgtccagaactgtaagacaatacatttgtgttgttttaagccactgtttgtgacaactggttacagcagtaataaaaggctaacatagcaactctttgggcagtttctttaaaagttaactataaatttaccatacaatcctcaggaaggaatcagtccagtcctacatgtttactcaagaaagaaaagcctatgtttacacaaagacttaggcacagatatttatggcagtttcatttgtaacagctaaaaactggaaagaagccaagactgtcaataggtcaatggatattcagcctgtggtgcagccacacaactgaataaaaggcataaaaactactggtacacacaatgacatgagttcccaaaattatgctcaatgagagaagccagattaaaaaaagaacatatactgtgtggttctatatacaattctaggaaatctttaatttcagaagcagaccagtggttcctttggcatggggtcagagagaggcaggggttgcagtgggcacgtgaaacttctgggagttgtgggaagatttgtcatctgggtgtgggaactgtgtcacggtaactgcatgccaaaactggtcacacagtatactttatgtgcagtttattgtactccaattaaacctccataaagttgttttaaaaagaaaaacttattaggttgggaaaaaatgaacagttacaatgttaatagaagtagccctgaatgacaaaaaatacccaccgaccatcacaacactcataaatgacccctggaatccaatgtgaggaaatcttcctgggacttctcaactccccttcataaaatgtgctttctttattgatggaatccctgaaggggaccctctgttgagccttcttagggaggaggggatgcccatgttttggggctcttgtccccagtgccatcctttctggggcactggtgagcgcacaaagtatggcgccattccttccctggagcttcagggtgccttccctccacgcccacacactgcaggctaaaagcaggtcccactactgttttaactttaattatggtggaggtgggattgaagggataatttaagagcaaggtaccctagttgacagaaggtgacagcctgtcccaaacacagagaacaaggaggctcccagagagaaaagatccacaggtaggtggccaaagggtacaggcatatagggaggagcctggggtcagtgtgagggctttctaactagcatgcagtgtgccagggaaccccctgcgaccataaggagggtgggtccctagcttgggagaataaataactgttgatttggatttataaattcaggagagctctaccatatctttaagttgagctatccaacagagagagtcttaaatcctgtagatattggggttaaagaatatgttagctgggggctgtggctcatgcctgtaatcccaggcacctgggaagctgtggcaaggaggattgcttgagaccaagagttcgagaccagcctggacaatacagcgagaccctgtctctacaaaaaacatttaaaaattagctgggtgtggtagcatgtgcctctggtcccagctactcggggagctgaggtaagagaatcggttgagcccaggagttcgaggctacagtcagctatggttgcaccactgcactgcactctatctagcctgtgcaacagagtaagaccctgtctcaaaaaaaaaaacccatatatgtgtgtgtgtgtgtgtgtgtgtgtgtgtttacattcatttgcacacaaatctgataaccataatgaagaggaaaaagcccaggatactgaataatactgctatgtacatgcatattgttctctctcccatttaaaagcacatatttggcagtagatgaccagtgcaaaaagaacttttaatttttctggtcacagagatgaattggctctcccttcctgtgtacttcctttccttctcgcttttcctacatggattttttcaaagcagaatctcagaccctgtagatgctgatcaaagaatgctttcctgtttcctttaagaaggcagcaggtatgtgatgaaataacagattgatatgctttgtaaccaccccctgcccccgttttgaatctgggctccaccagcaagagtcaagcttttttccagggcaaacagctatcccgcgcaattgctctgagtgttagggatgacttataaagactgtgtggatacagctggctcaaattcagattctcatcacccgattacatgcacctttctctgaacagaccttctccccaggtcaaactcacttgagattattactagagttacgttatgagtttgtatatattttccttctcaacatactttcagtatttgaataaagattaatgaatcaaagttctaacttgaagtatttataccaaaaattgttataaagttttactttattttttgttctggaaactatcaagccagatttggaaacacttaaaaatggaacattttttatccagggttttttggggtctcattatccaataaccaattaaaaaaacgtctctggtgttctttctaaatcgtgctaagttaccttaaaatgagataaaggacaagaatgctgtaacacttattttttatactttaaggcaatggctcacaactgggctttgcttttgccccttgggagatattaaagacagtataaacgttatgttttgtttgtaaatcaaattttgtgtgaagtaaattataagtgttgatgggcaaacaaggtataaacatgtaatttgtatgacaacagcaacagaaataagagagtcggaaacggaactacataggagcagaggtttgtgaactacttaaaataagtggttaagatgtttatcatagtccacagagcaatcactaagaaatacagtaaaggacagaataattaaaatggcacgctaaaaaatatctaaagttaaaaaaggcagtaataaagaaataaggtaacaagaagacttaacacagaaaacagcagcatgccgcacgtaaatcctgtcttaccaataatcgcattgtatgtaaatagattaaaaacgccaattaaaaggtagagattgaagaatggatttaaaaaagacatgatctaactatatgatatctacaatagagatacaatttagaccaaatggtacaaaagcattgaaagtaaaatgatggaaatgagattccttgcaaacaacagcccaaagagagctgaagtagctatagtaatatcagacaaagtagacttaggacaaaccatttcactaaaaaaaaccaaacaattttaatggaaacattttatagtgataaaggtcaccccatcaagaagatgcaacaattataaacatatatgaacctaaccacagagccccaaaatacaagcagcaaaaactgtcaaaactgaaaggggatatagctgattccaataatagtagctggagatttcaatgccacacttgacaatggacagaacaactagacggaagacaaatacaagacttgatttaatccacttacacactgtaaaccattaaaacttgacagacatctatacaaaactgacccaataataacagaatatacattattcttaagtgcacatggaaaattatccagaataggccatatgctgggtcataagtctcaataagtttacaaagaagtgaaatcatatattttcccaatcaacaatgaaattagaaatcagtaactgaagaaaacttgggaaattcacaaataatgtggaaattaaacaacatactcctaaaaatttgtgggtcaaagatgaaattatgagagaaattaaaagatactttgagaagaataaaaatggaaacacaacataccaaaacttatgggatgcagcaaaagcactgcgtggagggaaattatggctacaaacgtctgcactaaaaaagtatgttcaaagaggtgaaacagtgctagctttgaagatgagtcaagacgtgtgggtggcctctaatagctggaaaaggcaagaaaacattccccattagagcctccagaaacaaacagagccttgccaacacccgattttaccaagagattggtaaaatcaggcctcagtttgtggtaatttgttacagcagcaatagaaatagaaggcatttaagaaactttggctatcttgttgccaagtgcggtggctcacgcctgtaatcccagcactttgggaggccgaggcgggtggatcacgaggtcaggagatcgagaccatcctggctaacacggtgaaaccctgtctctactaaaaaatacaaaaaaattagccaggcgtggtggcgggcacctgtagtcccagctactcgggaggctgaggcaggagaatggcgtgaacccaggaggcggagcttgcagtgagcggagatggcgccactgcactccagcctgggcgacagagtgagactctgtctcaaaaaaaaagtaactttggctatctttttgtttttccctcatcgggctactgtacaatgactttcaaacatattaaaaaaaaacataaaaaaaacataaaaataaacttttaaacgtttcattcacaacctaaagtcaatgaaagctacaggcagagtttacagaactatgtgtgacaatttatctgaggcagttcaccagtttactaaaaaacagcacagtatagtcctcacaaaatgaaaacaaaccccagcatgctaggccttcgttattgctacagaataacacatatgtataaatactattaatcattttttttcccatttcctattgatgcaccatgatgcttccatttagctaatggcaataatctaaattctttttgaattttaagagctaaatatacaaacatagagctctagatggatgtcactttgcctaaacccttctcagagctagttttccagtgtctgaggcattatagattaatgccaaacccacatatccctaggccttttgaattaatgaaaaccagcaactgtcctccacaacatgcacaaaggctttatttaaagatcatctttcctaccaaaactcaatcacttctattctttttcagtgaaggtgacaggccctccgctacccttccatttctatctgtatcagtcattttcaggctgctgataaagacatacctgagaatgggtaatttataaagaaaaagaggcttaatggactcacagttccacgtggctggggaggcctcacaatcatggcagaagatgaaaggcacatctcacttggcggcagacgtgacagcgagcttgtgcaggaaaactccttttcataaaaccaccagatctcatgagacttattcactatcacgagaacagcacgggaaagacctgcccccatgattcaattacctcccaccaggtccctcccacaatacacaggaattgtgggagctacaattcaagatgagatttgggtggggacacagccaaaccatatcactatccttactcttagcattccctatcaatggcctgttaggaattaccaccagggatatatgcatatatatgaagataatgccaaaattacatttttaaaaaatttagggcaatgtaaatcatcatgaaatgtaagaaaaacattaagaatataaacagcaatacacagtacaaagtgcttctctcctaaagacacatgagtgaccatgtcacaggaatatttctttagctgttatgcttttggttcacttatttttgtgtgctggtgggggtggaggaatgtcagaaaattcagctgtaaaaagatgataggagctgagaatggagaaacttctctggtgatcctctaactgaacagacctgggccatttgctgcccaccttcctggaaaggtctgcccagaaattcaggaaaacattggtccagatggcttgatccttcacacaatcaaaaatcttagattcttgggactgtaagtttgctagggccgccatcacaaaataacacaaaatgggtggcttacatagaaattaattttcttgcaattctggaggctggaagtctaagatcagagtcagtcagcagggttggtctcttctgagacctctctccttggttagtagatgctgtcctctccctgtgtcctcacgtggttgtccgtagtgtgtctgtgtcctaatcgcctcttataaggacaccagtcccattggattaggacattgtttagccctttaaagacctatctccaaatatagtcacattctgaggtcctggggttaggcctccaccacgtaagtttgagggggacatgactcagcccgtaacactgggttattcatcttcatctacttggtttttttaatttttatttttttatataaaaggcaagagcagtttgttaatggaaggtgctatcttaacatggggaagggatgaagaagatcactaagaaataaggatcaagatccttttttaaagaatacatatttgcatatgtataaattggttcgagtatctcagattttatgtatctaattctacctaggatttctcaaaagaaccaaaaagcatagggtatggttcctgctatgcagagtgtacctctggtacccaaagtagcaaagtgggaattatattgacaaaaggaggcatagcttggtaactgcaggcacagctcaatttaccaagccttccacacatgggggcactgaaggatgaggagtcagaaatgctcactcacattctcaaagagcaactgacctttattccacagctccaattaccagggaaggacagctggtaagagaccgccttttctttgaacagctaggggcttggcagacacataactaaggctagcacaatgttctaactatgtcagtaatgtggccctatgaggtgttactgtcagtcaaactacatgaaagatatccagaattcaatcagatatccttttaatagctgtacctacgacttgtactgacctgagaagcataaaagaatggagaattcctcccaagttcaaagattactggagttaggtggaaagatatttacttattttaagaaatgaaaactctaatcacctgcatgggaatgtaaagtacctgggagggaactgttttccttaatgaacagacatctctcaactcccaaatcatttagagggatgcttaaaagcagcaagaccactgaatacattttccatgttacttattattttattacttgtactttttaattgaatttggcctatgagaacaataatgctaataaataaccatttaaatgcatacctgaattatttacatttgcaatttaaggcatgatcagaatgatgttgaaatattaagaattttaggttcatcatttttataaacttattatgtttaagatgattattgactaaaagagtttcattctttaattcagacaactgaagtactcaacaaagaaataaaatatattagagttttgtaagtgtgagttaacagtataaaggtgaagtttatgaaaaaattgtaaaggttgagactcaaacactgttatggcctctgaacagtgactgttaacatttactagattttttgtttttggtaacagagtctcactctgttgcccaggctggagtgcagtggtatgatcttggctcactgcaacctctgccttccaggttcaagcgattctcatgcctcagcctcccgagtagctgggattataggcgtgcaccaccacacccagctgatttttgtattttttgtagagacagggtttcgccatgttgcccaggctagtcttgaactcctgggctcaagtgatccacatgcctcggcctcccaaagtgctgggattacagatgtgtgccaccacgcccggccaacatttactaatttataagcagaataagcagaaagtaaaagcttagggaaaagaaagttttgaatctaacttcaatagtttataaatgtttagaattaaagggtagtggtgaactcaggacacaagaagtcctacagcaatactaagcacccacagtacaccatgcctgtgtgtgtaagctcatcagaaagcagagcatgaaaaagggctagggacccaatggcacgggcggcagtcgctgccctggagaattacactcctggcattccaagctggtacccaaacactttcccataagaaataagagatggtcagggacattcggaacctcctcaggtgcataaaggttgtgtgaatatgggagtgaataacctctagttttaatgtttctatctggggaaatgtgttctaactatccaagtactgcacaacaaatttatcttacattctgtgtttacattctagtgtagatactaatgaatgattttgcggataaaaatcaggcagccatcagatgaaacagcgggggcccaaggtgctcaacccataaataagcaagaattcgtattttttatatgagattataaatctccagcccaaacccccacgatgtctcttttctgttattagtcactatgaataaagtataattgcactcaaatgcagctggtttgtgagctcctgcaggtgaaattacaagctaaaacatagtcctcatgggggaggaaaggaccgagtacccttagccttcgggcaaccattgctttgaacataattagagaatgcaagtatatgggaaagaggtgctaggatataattagttataccacagcatttcattaccaacatttaataacatttaaagatcatagagcacatacaaaatgatatgccttcttcctttccattttatattctcatactggctgcactatatagaaaatgaggtgtggagagaaggggatctaatatattggctccatctagtccctgctctgtcatgtaacatgtgcccattcattcaaggacataaaaattacctgaagcttctctgtcaatacacatgccatgttggacccgtgttctgaatgttgagactccagcagtcaacagaacaggcctagagcctgacctccatggaggacatgttgtagagcccaaggttgctcagcattttgctgccagccccaacagtgtgacgtacagctcttctctgtctttgagccctgagcattctcatacctgaggggatattccctgaaggcaagaggaatgggatgcaacaacagtgaccagtgaccatcgcctctcagggaagtgccatttactaatttattattttattgtataactctctgaacttttatcttagaatatgatttcattccttattcaaaaacactgaccttttaaagatctcacatctgggcaagagaactttaatgaaggcaaaggaaagagccatcctaaccttccttactactagaaatgtcatactcagacagcacacagcatgcagggcaccgtcccgctctaacaaaaatcgaaagggtaagggcaatggctgggtataaaactacatactagaatatgtgacacggagcaccgcccaacaaatggttattttccatgtttatccccggcatggtgcgtggagtccaaaggttattccaaagcacttttcttttcactcccttctctggaaaatcaactgtgtttggaaatcatggtgcatcccatggttaaataatctccctaccccaggaaggaggactgggccctctacttctccctgacatttacaacccagctgggatgagaaaaggagaagggagtagaataaaaggacttcaaagttgtgagttcggcacccttacgtgtcaacaaagattaagcctgaagtggcaggctttcacacagggttggggggattcaggttttgatgcagggttagggggaattcggaggctgattggagaatgactagggatccagagctgctccctttgtatcagagatgcacatactacacacacacacacacacacacaaaaggaggaggaggacaaaacatggtgggcatatggctaaatttccagacccttcctaggctaattatccaactgtgtgtgtgcatgtattctctctgaggaaggggacttagaaataagtttaaaatggcttccaggggccaggcacagtggctcatacctgtaatcccagcactttaggaggccgaggcaggtggatcacttgagtccaggagtttgagaccagcttgggcaacatggcaaaaccccatctctactaaaaatacaaaaattagccgggtgcacggctcgagaccagcctgggcaacatggcaaaaccccgtctctactaaaaatacagcaattagccgggtgcagtggtgcacaccagtagtcccagctacttgggaggctgaggcaggaggatcacttgagcctgggaggcagaggttgcaatgagctgagattgtgccattgcattctagcctggacaacagaatgagactctgtctcaaaaaataataataataaaagtaaaaactaaaatggcttctaggtactgtagctgttcaaagacgagtgtaggtcgatggccacctatgtcagttttcttcatgggttaacggcaccaagagttttgtttgtcttaaatgggaaatcatggttgtttccatcaatgctgtcaacctaagaggtgcccagtctttcagtttcctgaaactcaacatgtccaaatgcctaaaatggaactcatccctattttcaggcctcacagcttcctctaatttcgacttcaggacaagtcactgctattcacctgccttctccctcccatccctctatgcccagctgtcagctgaacggcctctgaatcagccacttttcttcctttcattccaaccctgtgggtccttgtagtcagttgaagggtggctcccaaaaatatatgtccacgtcctaatccctagggcccgagaatcggaccttatttggaaaaaagacctttgcagatgtgattaagtgaaggatctggagatgtggcactctgtattatcccggtgggccctacatccaatggcaggggtccttatttataagagacaaaaggagagaagagaaggccacgtggagagaagctgagaccggagcgatgcagctacaagccaaggaaaaacgcagccctgctgatatcctgacttccaacttcttgtctccagagctgagataaagtaatctcctgttgttttaggccccccagtttgtggaaaactcatgcagtccttctatcgttcatctggacaatggcaacagccttctaccagtctccagtgtctaagcgccaacagtccacatcatcagaagcaccacccttctagacatcgtgtgctcgccaggctgtatgatggctacgagataaaatgtgaattccttagcctggcacagggctcgccgccatctgcccttggcaggcctttttacctgtgctccgcctctcaccgagtcctcttggcctgaaataccctcagcccttcctcctccacctcagtgactccccaacccttccggtggctcatttgggatgcgtttgctctgctgtgaggcacatccgactggccaacttccttttcctggctcccaagaaaatcgagttgtctctagcagatgaatgatgataatatagaagaacagatcatgtccacccccgcccccgtacaaattacagcacccctgcctgcagtcccctgaagaacagggatgctgttgtattcatttgactcagttgtctcagtatctggcaactggtggtcctgctgtgaaaagtcagtcgggttcatgaatcgaaggaacaccctgaacatctcaatctctcctccagagccctcatagatccaacttaggcttttcttaaattccttttgaacttaaagctctctcctcaaattctccacaacagaaagtgccacctgccttccgccatctgaatggagccacctaaatgctgggaatgttaagccatttattgtaaccacctctactgcttggctacctgtattgctcaatgacttgaagtgggcaactttacaggcttttatcaggttgctgtcagagaagcaaggtcagcacaactggtttaacaagatgagggctgagataaggctagagcttccagaaaggaacaagtcatggagccacacccaggaataactcacatatttgcattaagaatgcagaagcaatgcccaggagagggcagcactgacaacgcacacaaagtctaaggtcattgtgatccacatgaacaaggcttctcttagaaagtacttaagggccagtttatgaccaaattcctttgacaaaggaatctaggaaaatacactaggagaaaaacctccaaaaacatcctggtgaaggctatgctctcaccaaagccacctcatgcaaatacacctgggccccagaactctgcgatttcaccctcatgagcatcaaaaccccacagccaccactgatctcactgcaggtaaccaacagaactgcatgtggtaaaggttctcagtaaatattgctattagatcagaaaaaagcctgaaagcctgaagcaggaaatggcagctggaatgacacagaagtggctttgaaatatttataaatcaggaggtgcctggaaggtgtgggtggggatggcaaggaattgaagactggaagataactcccagccatctgctgtggggctttcggggtttgctgcctggtgtggaatgcaggaaaagagcagatctggcagagaactagaggccccgtttaaaatacaatgcttcagagctgcctcttggccacgcgggtaggaagagcctgtggtcactgggaaacgtagacaggaactcaaaagaggtgaggcccagccagggaggtcaaggggtcatcagagcagaagcatgtgccgaagccatgagctcagaagaggtttccacaagaggacagggcccataacaaagccatagggacgccaaacaggcaccaggaggaaaagaaagctatggggaagccagaagaggaactatccgtgaagccaaagagaaagatttccaaggagggtgcagaagcggcaaaggaagccggaagttctggcaatttaagaaaagggtgccctctgcacctagcagcacggacatcactgctacctctgtcagaacaatttctgtgagtggtagggccaaaaagccagctcatagcgagggaaggaaaatgggggagtgagttcggcaaacacagcccactttagcaagacacttggctgagaagagaggcagaaagacagacaagccagtttcaaaacacgtccttaaaatcgggacactcactagtcccagccagcagaagcaataaacacagcaacaggtacatggcatttattattctgtattatagatgtgatcatataaagatgttaatttcttcaggctacttcacagaagtcccgtcccctccctatgagaggatatgattttacttgatctcagcataaaccctaatggtataaggggatgcataacatgtgcagatggttacatctctgttgcaaaatcatgttaaacagtgcaatggggccgtaggtcagatatgaactgaacatgttctttaatctgattatattttggtaggcatgcaatatcctggaagatgtcacacattgcctgtgatatgctgcaaaccatactcggggacacagaggatgggtaattttactaaatcagtacagtaagtaagttgtcaatgagatgggccaggcttcagttaccaacgcagctcatgtttcacctaagctaaagtggttttgggctatcagtagagcctctcaatcatcaatgagataaaattaaatcagctggtaaattagatgtcagctggtgagagtttcagtatctacaattgtacctgtacctgtgagggctggcaaaactatgaacaaatggtaccaagactgctggtaactctaagtgatgaagcgcccaggagtagaagttagaagtgctggattttcactgggattttcctactattcatagctccccaggttgtcctgcctcagtttcactgtagacaggacaagtcgcctcaattctaaatctcaaatctgattatgatttcactttaaagagcttgtcacgtaagcacaccgtatcaaaagctgatgagcagtcagcaaaatgccagtactaaacacagggtagcaaatggcaaaaagtaagctagacctttatgtctacaggtattgtaatggcaaaaaccgtcattactttagcaccaacctaaataggagtcatacaaaaagaaaaagcagatataaggatctacttaaccaaaggaaatgctttatgttaagataaacgaggcaaataagagatgcaaaaagaaaataagaatacactaaagcactgtattaaaatcagcaaaatgtttagtatttaatgaaatccatgattatttgaggccagaacagaaatatgtgtaacactttgctgcacaaaatgtttctacgataaccaaataattttccttttaaaaagcaagagttaaaaggttgccaagctactgcaattgaggtaaataagggaaagagaagtctgcgtatgaacaggtaacctccagggaatggcagggatacaactgggtccaagagaacatacatgagatgtgggcagcacttcaggaagtcttttcctcccatcactcagttcaagctccaacctccagtttcctaagaccttggtagcctcagagtaaaaagggatgacacagacccagtaggcagaagtcagctgagaggtgcagtgagagcccagtcacagtagctcctcaggatcagctataaggctacttaggagcattttctgtcatgtctcatcagcatatgatgtgacacacaggtaccagtggctactctttgaagaattttagaaagcttttattccttttataagcatcatgccctgacaaactatcggattccaattaagacatcaacaaaagacaattttcctgacatctgtctaaatcctgtagacatttgtctacaaatctcctgcactatgagagagacgaggaactgaaaaatgagcactaggaaatgggactcttccttcagaatgttttctgctataatacacattgcaatgaatgcattgccactgtaatgttcgagagagctgaaggttctgaaactatttcttccatatctccaacatcaattttctaaagatgcatgctttacattcttgtctcttaaacagaattaactgactactacttaatactgcttttggggttgtttttagtggttcatgcttaagacttaatcttccctttcctattttaacttttcaagtatacagaagagtcaatagtaggataggaaacatctacataccctatacctgcacgcaacacacctgaaaacatgcagatgccctaactcttcattcctctagctctctgcacgtttctcctcagaataacactctcctacacagccataataccactgccaaacccaggcaaatcagcaatatttcatagtaccccctaaatagcacacatcacacctctccaattgtcacaaaaatgtcttttatagatttttttccccaatctaaggtccactgaatttgactatgtccctttagcctctttaaaagtggaaaagccagcccctattttttccccatgatagtcaacattttcaaggacccagtccaggtacctggtggaacatcctacattcaggatttgtcttgctgtttccacatgacaccccctcccgtgttcctctacccctctgaaactgctagaggtccagatggattcaggttaaccatttctgaggtcacttcagaaagcacacgtgacgtgacatgctgctttctggatggcaaagctacatcagttgggccacagggtcaattgtggcccccagagctgcccgctctgaaggcccgtttgcctctgttatcagtcagtgacttctgacatggcactgcgggcaccttcgtctcctgcatgattactctatgattttggcttccactgacaatgcttgtgggaaccacttacagtcgggatcccaaaatggtgacctggctaattctcccattctgtccatatttattaactggcattcttctgtaaaagagctcacccccagccacccttttactcttttgagaatcataacacagagacttaaaaaatatatagacagagtattatactctcttctggtcattattcttttgattacaaatggttcatattgtgccagtgggacccccccccccaaccccgcccactgcatcctggcatgagaaagtgctctgtgctcatgttgtattttactggtcccggtccctagaatcagccacatctccttagggcctgtgttcctttcactgggcatgatgtttccaaatgaaggatttaatcttttttaagccctcctgagtatcactgtatcactttgggtgaagtagatttacaaactgtgcagaacataggaccccaatgacaaatacacctcagtctgaaacattaagtttacttttcaaaagcagacaaagcgtaggcaactgcatttgattttaataactctgtgctgaggtcaggagttcgagacctgcctgaccaacatggtgaaaccccatctctactaaaaatacaaaaaattagctgggtgtggtggcaggcacctgtaatcccagctactagggaggctagggcaggagaattgcttgaacccgggaggtggagattgcagtgagccaagatcgcgccattgcactccagcctgggtgacaagagcgagactccatctcaaaaaaaaaaaataaaactaaggccgggtgtggtggttcacctgtaatcccagcactttgggaggccgaggcagatggatcatgaggtcaggagatcgagaccatcctggctaacatggtgaaaccctgtctctactaaaaaaaaaatacaaaaaattagctgggtgtggtggcgggcacctgcagtcccagcttctcgggaggctgaggcaggagaaaggcgtgaacctgggaggcggagcttgcagtgagccgagatcgcaccactgcactccagcctgggcgacagtgcgagattctgtctcaaaaacaaacacacaaacaaacaaaaaacctctgtgctttctcaggcatcttgtgacaaagccatgagtgtccttcaatctcatgagcaaacatcaaagagactgtggtgtgtgctccgacacagtgagaaaacagctgcatggctgctctttctttcctgtatcccactgcatggaacagaggaacccatacacgtgaaacctatttaggttcctgtgagtaccttctcttcgaagggtgcacagcatggcacacctctgtccccggcagcctcctcttcctgcctaagggttccggctgtccacacacacaggcattatagccagtacttctaacttgtatctcaggctctgaacttctcactaaaaagttccatgtaccactatgggagaggagtcagttcaccagctttcctgaggacaactctactctgcagggctggggctagcatgaaggtactgaccctatatagactgaatacaaacatctccccaaaaaggtgacgaaggggcacagcattattcttgccagaggcagctgacctgtgtccaactgaagcactaggcataatttctagattagaggaaatacaggggacagaggaacaagtaaggtggtatcatgtggaaacaatcagacaaatccagaatgtaggctggtgtctcgataaccatcctagactcttctgaaagtcatagggggaaaacccaggatgtgtgcttgcaggatggggtgagattttcactttaaaataggctaaagggatattaccaatgggcacccagtttaagaaatactaatcttagcctgacagagattaatctagtatttttttttttttttgagacagaatctagctctactgcccaggctggagtgcagtggcgtgatctcagctcactacaacctccgcctcccaggctcaagtgattctcgtgtctcagcctcccaagtagctgggattacaggcacgcatcaccatgccagactaatttttgtatttttagtagagatggggtttcgccatgttggccggggtggtctcgaactcttggcctcaagcgatcgacttgcctcggcctcccaaagtgctgggatgataggcgtgaaccactgtccccagccccagtctcgtatttctcaatgaaacattagagatttctaatctctacctgccagacattgctcaaaagagatgtgaagaggagctacacaggtgctccagctatgcaaacccaaggggaaaacaaagtcttccttcttgtgttcttacacaggagaaatgcatgtgttaggattattatgttttcaaatctcttctcacctccacacttcaatgtaatcattagcaagatcttttttaatacagtctttgcttgataaaaacaacaacaacaaaaaacgactctcttctatgctttagtaaagatgcctatggcttggccatttctcctggtctggaatatccatttttcttcttggctcctatctatccttgacagtatgctaccccaaatgtgatttcagttcaaaatcctgcactgttgctaacacattcttattgtgtatatcattagcaattattcacagattttaccaatcatgttttagattccagcaggactctaagatccttaaaggaagagactaattttgaagcctttgtaacacccagcagagtattttctaaatagattaaggatgagtgaatgcattcctctagagttgtgctgtccactctatattttgtgtctctatgttacgttttggcaattagtcattgggggctatttaaataacacgagaaattcaggtcctcagttgcatgagtcacatctcatgaacccagtttccagctgtggctcccatcggatgcagtatagttacagaacatttccatcctggcaggaagatttgctggatacacagtgctgggctagagagcagacaggcgcacagtgctcaaggaccatgtgcttctcttccatgtgcatggcagctgacacaagtgggagagggttggtgcttattttggcttttgtctgaaggctcagataagcttcgatgtgccaactatgaccatttgctcttacttcatagacacatggaacagtctattgggagtcaaagagcaaactttggtttgctccttgctctgtccttgaacagctatgtcatctgcagtgttttttaaataaggcaccatcaatcacaaaagggcacatcattcggcccagctcccagagctcagagagagaagagtcaagggccccaccaagcgccacaagcaatgccatgaaactgcctgccaggcatggctgtgaagaggtgaccatcctcctctcatacgcaggcaccttgccacgtggccagctgcaccagggtccttagctgctactcactgttggcatcacagcaaaggacacaagggagacagaggataaaggaggatcaggaaaggtggtgatctatctgccagacattgctgaaaagggatgtgaagagaagccacatggatggcccagctatgaaaagccatggggaaaagtcttcctttttgtgctcttacacagtagaaatgcatgtgttaggattactatgtcttcaaaaaaatgctctttaagcaccaacaaggcaattttaaactgcaaatatctgcaacacaaaatcaaggttgcccccttccaccattttaacactattgaaggaagctcttaatatattaaatgctgcatttattaatcactaaaattcccttatagccgatggtaggagcattattttcaagcgtaatgtattccagaataacactattgtgctttctacctacagactgcctatcaatcacttttcaaacatctcatcagaaggtctgaccagtcgcctgagcatctatataaggagtgctttcaggggacatttcttaggagatatcatttaccttgctcctttacattgctttaagtctccatctactcctgaaaaatgacagaaaatagtatataaattatagcagtttaaaaaaaaagaaatagaatcagagtaaggagtgaataatcgcaaagataaaaaggaccaaataatctctaatatatagcttttcaaggagaaaaatagattctggctcaaaaaacaaaacaaaacaaaacgatgcactgctgtcccatattatacaggcatatcttattttattgtgcttcatagattgtagtttttacaaattcaaggtttttggcaaccctgcgtcgagaaagtctatcaacaccattttcctaacagcatgtctcacgtgacgtgtctgtgtcacgttttggtaattcttgcaatatgtcaaatcgtttcattattacatctgttacgtcaatctgtgatgagtgatctttgatgttaccattgtcattgttttagggcaccatgaaccgcacccatataagtcagagaacttaagggataaatgttgtgtgtgttctgattgctccatagacccccatctctcttcctctcctccaggcctccctagtccctgaatcacactaatattgaaatcaggctaattaataaccctacaatggcctctaagagttcaagagaaaagaagagtcacacatctctcactttaaattaaaagctagaaatggttaagcttagtgaggaacacatgtcagaagctgataggctgaaagctaggtctcttgcacccaattagccaagttgtgaatgcaaaggaaaagttcttgaaggaaattaaacgtgctaccccagtgaacacgtgaatgatgagagtgaaacagccttattgctgacatagaggaagttttaatgatctgggtagaagaccaaaccagcacaacattcccttaagccaaagcctaacctagagcaaggctctaactctcttcacttctatggggactgaggcatgtgagaaagctgcagaagaaaagtctgaatctagcagaagttcatgaggtttaaggaaagaattgctccttgctctgtccttgaacagctccttgaagcagcaagtgctgatggagaggccgcagcaagttatccaggagagctagctaagatcaccgatgaaagtggctacactaaacagattttcaatgtagacaaaacagccttctattggaagaaaatgccacccatgacgttcatagctagagaggagaagtcagtgtctggcttgaaagctttaaaggacaggcggacttttgtgttagtggctaatgcagatggtgactttaacttgaagccagtgctcatttacaattctgaaaatcctagtgctcttaaaaatgatgctgaatcttctcttcctgggctttgtaaatggaacagcaaagcttggatgacagcacatctgtttacagcatggtttaccgaatattttaagcccactattaagaattactgctcaaaaacaaatatttctttcaaaatatttctgcccactgacaacgtacctggtcacccaagagctctgatggagatgtacaaggagattcgtgttattttcaggcctgctaacacgacatctactctgcagcccatggattgaggagtaacttcaactttcaagtcttattacttaggatatgcatttcctaaggttatagatgccatagatagtgattcctctgatgcatctaggcaaagtaaatggaaaaccttcaggaaaggatttagcattccagatgccattcacaacattcatgatccatgggaaaagatgaaaatatcaatgttaacaggagtttgtaaggagttgattccaatcctcatggatgactttgaggggttcaagacttcagcagaggaagtaactgcagaatgtgatggaaataccaagagaactagaattagaagtgaagcctgaagatttgactgagttgctgcaatctcaggatgaaacctgaactgaatagacactgcttcttagggacgcgaaaagaaagtggtttctggagataaaaatctatttctggtgaagatgttgttgaacattgttgaagtgacaacaaaggattcactatattaacataaacttagttggtaaagcagcagcagcagagtttgagaggactccaatttttttttttttttttttttgagacagagtcttactctgtcgtccaggctggagtgcagtggtgggatctcggctcactgcaacctcagcctcccgggttcaagtgattctcgggcctcagcctcctgagtagctgggactacatgtgtgcaccatcatgcctggctaatttttgtgtgtgtatttttggtagagatggggttttgccatgttggccagactggtctcgaactcctgacctcaagtgatctgcctgcctctgcctcccaaagtgctgggattataggcatgagccaccatgcctcgccaaaagagaatttttttgtaaaagaaagaatcaagtgatgtggcaaacttcattgctgttttattttttaaaattgccacagccaccccaaccttcagcaaccactactctggtcaacagtcaatatcaagacaacaccttccaccagcaaaagaattacaactcactgaaggatgacatgatccctagcacttttttttttaaagcaataaaatgtatttaaggttatgtacattttttagacataatgctattgtacacctaatagaatacagtatagtataaacctaaccttatgtgtactgggaaaccaaaaacttcatgtgactaattttattgcgatgtttgctttactgtgatggtctggaactgaacccacaatagttctcacacatgcctgtatccagtttacttaaagattctaaataaaaccatattgcttttatttgaaagagagagctagaaaaaagaaaaggatattttacacctgcatgcctagaatctgctgaatatttgtgttgccagctggacaaaactcttattatttatctgcagaattttgcaatttaagttttacccccttctcaattattctagaaacagaaacagctgcagtggacaaccaaccacttactacaagaacttaaggttggcatggttcaggtcaattagaaaacagaaccaaacggagctaaatctataatctgatgctgtttctccaacatacaatatagcatcttactctaaatctcttcggacccttaataggaacacacgtgtcttgtgctttctatattccagaagccttttcagtttccagaaacaacagattactcattgatcaccctgtagtgaaaggccaatcatggcccctgagataagggttcatctctgtcccaagccctcacactggcctccaccctcagccatctcctttgcaaacgtggaagagaacctacatttcacctagcaagggtaaaacccaagggtacactgtcagcctccagggaagacagggcaaagaaagaatgtgaacctaccaccagagttgctttgacatccagagcaagacccattacaaatgatggaaggaggggagattgtgattacgatctcattccaactaggatcactgcacgttctggggttaaacaataaccacctatggaagcatgcagaatgatccttcactttgctccaccttcctcagaaatgtgccaaaactcttagaaatcccacttggaatgaatgacttgataacatcaagtagtaagaaccgactgaggctgaaaagcttgtcagctgcacttttaaacctcagacgtatttcatggggtcaaatgacaacatacatagattcttctgacaatccacctagggcatgcgctaatattacgtaagaaaaatctatttttgtcatcagctatatagatgttctggtgtctaaagaaacagcctacatgaagttaacaaagaatgacagcgcaaaacacactcacgctatgtctgtggaattttggccacacagtggacatgactgtcaactgtctcaggcagcccacaatcccatcagtactgggcttggtaatccccacagagaccctacctccatgaccttttagggtctcctgggccccagacagtgaggcaggcacttatagtctcaagtgctattatttggcaaggaggaagctacgggagtgcaaaaaggcacagaagaggtcttcattttactaaaggtgaagtagaagtcactcattaaaatcctgcaatctggatttataaagatatggtatattatggtcaacactgcaaatgttcttattacccttcgcagatctaccttattattttacgatatttaagaaactggaaataagcttattttcctttgattttaaaaggattttaaataattctgtattagactccaagaaaacacattttacacataccacattttacatacaccaaaactcctaattctgaatattcttaacacccaccctctgcctgaccctcccagcatagccattatcaacagacatcttgggttgctccacaaagacctagacccatgctgtccaagccagtagccacccaccaaatgaggctacagagtgcctgaaatgaggctagttcaaactaagatgtgttgtatgtataaaacacacacagattttgaggacctagtatcaaaattaatgtcaaacacttcaaagattttcttatactgactttgtattaaataatatttttgatacattaggttacataacatacatcatccaaatcaatgtcatctgtatctttttacttattaaaaattgctccccaaaatttttacctggctcaattctatgagacagaactgctctggacaacaaactgtcttctcttttaaagaaattgggaccatcttttgtgttcctaatttcagttatttacaaacagaataatcttccctgtccagctgctgagatactgtttaataattgtcatcttcttatttcaaaatcatcccagtttttaactaatcccactcccctactctctttctctgaatggcatttgagagccaaaattattaatattacctaaatcataactgactcttaccttggtcatgagaaacagaaaccgaagtgtatttttttttttttttaaaggacaactaacagcatcgtgcatgtcaaaagcatgggaaagtgtcctggctttcttcctggtcaacatttcctctaaaatctccatttacttcctcattctcctctgattaaacaatcttctcctctaatgttaacaatcctccatgaaactattcgttttcaattttacttccccaagtatgcaagtattggggctacatagacaaacagaacttcctagaaaaatgcattcaaaattcccgaaaaacagacctattgtaaaataactcattataaattgatagtatattgttatgcaaacaacagatacactgaagtgaggtgctaaagaatgacagcaggcataatctggtagattaaattaaagtggcacatcttggaaagctgtgttttatatttacacatttggtgaaagaatgggataaacaaaggtatatttccaagaaagttttgcaaggccttaccacctcaaagaagaggtagggcaggaaaggaggaaatgggcagaaaatgaggggggggaataaaaagaagcagggcttatttttccaaatagcactaattcttggttatctgactagatcagaggattgggtaacaatgtgaggtcaatgcttgtaatgccatttaagtcacattcatcacttcagggcatggctatgtgtgaatctagaatcagaattaggcaccaagctcatttagaagtttaataaatttaattttaatgagacatcttgtttggtattaaaattcatgagactcccagaacaggttctctggacctttattagaggataagaaatttatttgacaatttaactttttgaccaccggagtaggaaaattcatgtctacaaactatacctatgtatcccacaagctttctgaaattgagtcatttcaaatttagtagctgcatacaccgttggctccaattagtgacctctacggggattttttttttcctttggaattcatcagtttacacctctgtgttcataaaatgaagagaatggtttctgcatgcctttttaaaaggaaacactgctagggaattacccagcaatatgatgagcagaaacaaggtcacattcacaatttaagatgagctcaacatcatttatatttagaactggatcaatccagaatcgtttctcagcttggcttattagctgtgtgaccttgggcaagtagctttacctctctgagctgcagggttttttttttttttttttttttaattagtgacatgcaaatacttcctcctaacttgcagggttttgaaatgaaggaatgatatacgtaaccaagcaggtcagctgtctacaaagagtatgcagacatgtttatagatatatgaagcctcctggtgattatgtgtcatagtgttaactgtgtcaaggctttcggtagagctcagcatagttctgtcttgagttaaaaacagggttttattctttgaattctacttgaattcctcttggctggtgaagttcacatgtgctaagactgactaccttagtacactgccaagggtttcttaatgcctcggattgatagagcagctgttctcaaacgttcacgcgcttaaaatgcagattctgattgggcaggggtagggtggggccccagcttctacatttacaagtagcccacaggtgatgtccccggtgctggtcaccctaggcagccaggccacttgacggaccttctgtgcctctacactgttgacggcgcgggataattccttatggttgcatagggcactcctgtgcactgcgggaagtttaacagtatcactggtctggactccactagatgccagtgaccccatcactcctcgccagctgtgacagccaaaatgtctcctgacatcgccattgccagatgccctcagggctgcaaaaccgccaggtagagaaccgctaccatgcaggatgctaccatcaaagtgcgcccacagcagcaaccttggagcaggcaggcaagtatcctccaggctactttgcagacggggaagctgaggctgggcaccgctcaaggtcgcacgcatgcgtaaccgaaaagagagcgcggaggtcccgccgcgcctcgctctgaggagaggacgcggagccgcgcgcccgcccggtggaccccagggactgctcccacgtgctccggccccacgcgcgggccgccgaccggaagcgggtgctggggccgcgtagacgccgcggccacgcgcgcccgccagcccggacatgggcccgcgggcgctcctggccgccgcccgacttcggggccagccgggggcagagcgcgcgggagcccgagcgtccctgcatgaacaccgccccgccgcggcccccaggccgtgacgtaccccgcgccgaccgtccccacgcccacacaagaccgcccttactggaggcggcggctgcacactacccacccagaagaagtccgtccatgtcaaagatgaggtgggtgacgggctgcgggggcgccgccatggtggcgccttctgggtctgggtgggggcgaggaggaagtgcgcgcgcacccgcccgccccgcgcacgcgcactgaggaccttctcgcgcgcccggggtcgctctgcgcacgcgccttccgcggcccctcgcccggctccgagcccgcgcgtcctgggctgcctagtggcgctccgcgcacgcgcaccttgggctttcgccgcagctgtagctgcagacccgggatgcggcgcgggccggcgctgtatgtttacccgcatcaattcctcctcacttcacacccggaatcgggccaagctactcagccagcggccgcgcagagccgaggccctcgtctggggacaaattcagtgcttgagtttggatcaggggtgtgaatgaggaaggagggacagtacaaggggctgtagagtggggaaaggggattgaagatgctcagggtggtatcacttctagccatcaggttgcagacaaatggccttggtcaggaggtccctgggtgggttcgcccgagcccccagtccctggaccgtgggtgggtttttctcagtttcgcttgcccgcctccttgcggtcctggaccgcgacttgaaccggcagccgcgcatgcgcagtgtgcggagaggctgcacaacctccgtgcctgcatctctgagcatcccaggctggtgcattgtcccagagcaaagccaagctgctcaaggaggatgctgaaataatactaacagtcaacatgtcttgctggttgtgccttcttaggtatcatctgtcttttgggctgctctgagttttctttcttttttaacttttcaaatgccacctaaacagctttcttttttttttttcccgtttgccatcgtcaaaaaaatacttttttgtccctgtttctatttcgtgttcgtttatgtggtatattcacgtttaaggaaaaggattggaccttttgagaagcggaaataggagaatttcaagactttaaaaacgtgagggtgtgctgggcgcagtggcccacacctgtaatcccagtacttagggaggcagaagtgggagttgggggaatagtttgagcccagaagtttaagaactgcctgggcaatatagcgagaccctgttctccacaaaaggggaaaaagacaaaaaaaaaaaggtgtaaacatgagagtgtatttctagtttagtgcagacatagtggacaggggcatgcctggattcagcaagaattattatctatgatagacaaagtgcacctgtgtctgtttcctcctgggtaaaatggaggtgataaaggaggtgaggcaggccaagcccttagtaccagtgcataatatatagtcaataaaattatgtgttcttagaggtggtactataagagagcttcccccatttaatgcaatcgtgatttccctttgaggacacgggatttcagagaaggcaatttatgagcaaattaggtagggacttgcgcctcaaatacagtcgttcgtggtttctgtattagtttactacagctgccatagtaatataccacagactaagtaacctaaacagcagatgtgtattgtgtcacagatctggaggccagaagtcctagatcaagatgtcagcagtcttaattccttctgagggctgtgaggaaaggacctattccaggtctttctcctcagcttgaacctgctttcctttccctgtatcttgtcctatcgtcttccctctgtgtgtgtctctgtgtccaaattttctccttttataagaacacgattcttattggactaaggaccaccctaataactacattttaatttgattacctctgacaaaatcctgtttccaaataaggtcacattctgaggtagcggggatgaggactccaacatatatttttgggaacacaattccataatagatgcattgcacacacatagctgtggtacctacagtaagtatgacagtatttcccacctggagtctgtagaattctccctcccagtttccttccattctctggaaacaaatggatgcacacatgtcagagttactgttatttttttggtattgtaaccacctcacatttctgtttagtcattaaattaaaaaagagtatttttcttttttctttcttcttttatgagacagagtctcactctgtcacccaggctggagcacggtggcgcaatctctgctcactgcagcctcagcctcctgggttcaagtgattctcctgcctcagcctcccaagtagctgggattacaggcgccagccaccacacccagctaatttttgtattttttagtagagatggggttttaccatgttggccaggctggtcttgaactcctgacctagtgatctgcccacctcggcttcccaaagtgctggaattacagacgtgagccaccgcccccggccaaaaaagagtatttttcaaaggaaaaaaggccccaatgccattttgacgaaatggcaaagcctcacagcgattgtggaagagacagattgggaaatcgtaggtacttcagctctccacagatgtgaaaacatgcttcacattatgtttttatcagtcttattttctacacttttcagtaacatcacttctatgcataagatggaagactcctctttgcttaaaaaaaaaaaaacaaactgaatggtgaatgcttctctgtcacaagctagattggaaaagaatgaaattttgttctagcaatgtggtttgtacacatataacaagttagtttttagcttttcataattctccaacagccaaagatgggcagtttctatgctgatggggatgcatttccttccatgaattacagtttacttttgtacagttgtgttctccccatgggacaataacttacttttcctgacaattttaagacacaatagaaatgatccagtaaactacagtacgatggcatcaaaagcacattatcaatgggacaaataaacagatgctcttctttcacacaacatgtaaacttaaacatgccatttattgtgtgtatatatatgccatcctgtagggagtcttagcttatttcaacttccttagtttgttgtcctggttcctgtgtctctgtgcttttgttatctgttgtatttggtttccagtctgctgtatctgttttctgtgagcccactttgccctgttattctctttacttttctaggggtacaaatcttgcccagcgtagatggagggtaacaggttggactagggaccatctttctcagtggctgtacacagtctacttttcttgatgatgctgagagaccagaaagctctgacttcatctgatggggcctgaatttgagctcctcattgcagacttacctgccttcttcccctagatagctggctttgcaacgctgacttaggaagtctcttgcttcagaggcactgaatattctcaccccttcccgctgctgctttcctccaagcccagtgagctctggaagggagcctgacatagatggctgaattcgccactcctggctttgtactctcggacatatctggtatttttgtgtggggagggtcattgtttttgaaccccttcaccatcagagtgcaaactggctctgagcgagaggtccagtttgcttctctgcagtgttggataacagatgtggtcggaactggcagtgccagcatcccctgggagctcactagaaatgcagaatcccagctgccacccccagactgaccaactcagcatctgcctttcaaccagggcatccaatggtctagaccattgaccccctcctggggtataccagctacttcattgtggggagggggcttaggattattattattatcgttattttatttattcgtttattttttgagatggagtctcactctttcgcccaggctggagtacagtggcacgatcttggctcactgcaagctccgcctctcgggttcacgccgttctcctgcctcagcctcccaagtagctgggactacaggcacccgccactatgcctggctagttttttgtatttttagtagagacggggtttcaccatgttagccaggatggtctcgatttcctgaccttgcgatccgcccccctcagcctcccaaagtgctgggattacaggcgtgagccaccacgcccggccaggattattattttaatgtaaagaagtagcaaatgtgttaagtttaccaagatttatttttattttattttattttattttttgagacaggatctcactgtgttgcccagggtggagtgcagtggcgtgaagtcggctcactgcaactcccctccttccgggttcaagcgatcctgtcacctcagcctcccaggtagctgggactacaggtgcccaccaccatgcctagctaacttgtgtattttttagtggagacggggtttcaccatgttggccaggctagtctcaaactcctgacctcaagtaatccgcccgccttggccttccaaagtgctggaagtacaggcaggagccatggcacccagccctaacatttaatatttgtgtgaacactggcgaatgttcttgtgtcctggtcttttctccaggtatccttgcagggaggaggggagacatcattgctctcaaccattttatttgatttcagcataatgcaatgtacatattaaggtaaagtgtatttatggcttatattatttaatttttaaatcaactgtcaaaaaatggacagagggattaaagacatgcctatgaaaataataaaatgtagcttccagttaataacaagaaagtagaaattccagcatcagctttatagccttcactaatgattacagatcatgtttcgtaatatccgtaatgttagtgcctaagtagacacacactattctaaaatagcacatgtgaagggaggatgtgtgctccaaaaatgtggagaagtgaagcatgtggtcagaccttaccatgcattcgaatttcctctgtcctgccaggattctcactgactagacatgactggacatctgagagaggggctcaggcttcatcacaccccaccctttatcatctcattgttctgagatttagggctcctgactccaaacagttccctccttgcttgcccctctctccctttctccttccctccctttctttcctccttctctctttccctgtcttccttcctgtcctcctcttcgactccttccctctctccttccctcccttcctttcctccttctctcttttcctgtcttccttccagttctcctcctccactctctccctctctcattccttcccttcctttcctcctgtcttcctcctgtcctcctccttgactccttccctctctccttccctcccttcctttcctcctccttctctctttctgttttccttcctgttcttctcctccactctctccttccttcccttcctttcctccttctctcttttcctgtcttccttcctgtcctcctccgtgactccctcactctctgcttccttctcttcctttcctccttctctcttttcctgtcttccttcctgtcctcctcaactccctccctctctccttccctcccttcctttcctccttctctcttttcctgtctttcttcctgtcctcctcctcctcgactccttccctctctccttccctcccttcctttcctccttctctctttttctgtcttccttcctgtcctcctcctcaactccctccctctctgcttccttcccttcctttcctccttctctcttttcctgtcttccttccttcctgtcctcctgctcaactccctccctctctgcttccttcccttcctttctttcttctctcttttcctgtcttcctgttctcctcctaaactccctccccctctcctgccctctctccctcttttccttttttctttccctcctgacatttcctctggcgtagctccctctctccaggacctgtgaggggtttgtgcacccataatggatacaaatggggatgtcagcaacttgggcctttgctgtgtcttgtaccacattcacaaagaggggtacccactggccctgcctgctgaagcctctctccttgaatggaatcacagctggagctcaccacgcagagagctgaatgccatctctaatgtgcgccttgcgtcgtctctgcttctgaataaaccacatgcccacctgcaaggctctgagttcctgtcacatcttatgcaagttgcttagtgcactggtcacttctccgaagtgtttataaaggccacatgctgagagtctgagatgaaagagtgattcgtttatggttaaagttggctcattgtttcatagcaactgttgtaatagccaccagccctcaaataattatgatgtacttacaactttataaatgatctgttacttcattgactcggcaactttgcaaggtaaacaatggaattcttcttcttatagaaataaagaaatggagcttgaggaaagtcaggtagcttgccacaagtcatatacctgaaaacgatcagggtggagagttcaacctctgttggtcttccttcctcaaaaagagccaaaaggcaaaaactatctattaatatgtttcctatatgttttcaaaatttcttatgttgtatgtaagcaatcaggaccacaacgtgaatagataatatcaaaatcaaacacaggagtgaatgtgcaaataaagggaaaaaaagtattctagaaaacaccagcaaaaaaaaataaggaaaaggaagcttcaaaaaataaacaaggaacatttgttttcttcaattatgatgtcagtatggcatgtcagcgataacgtggtccaaccagtcatttctaggattgaaatttttctcctttattttacttgcacccaactcctgtgctgcttggtgcaagctaacatctggagggaacagaaagctggttgcacagcctctcccttcagcttccccatgatcacataagcctggaaaatgtgctgaatgagtccttgcctcctcaattcacagccatgtgttcacttgaaactctcccatttctgtggtcaacgatggtcttcccatttttttttttaacacaacagttcccaaacttactcaacagggaccatcacatatgctctttaaaaagaacataatatctccttcaaacacactttagaaataccagactactgttcagcatagggtccattctgacttacattctgcctcaccaccaactttcttgaagcaatcattcagtaaggctgtgggattttgccaagtcagcgtgacaccaaacacattggaaaagcagactaaatttacagagtaaaattcagagaatgagaatcttaggtacctcaaatagttaagattttaagaatcttaaagggaacagattatgtttatatgtatatatgtataccatgcatatgttatataatctatataaataatatattggtgtgcatgatttttataaacttgaggaaatgcctttatatataacttaaatatatttagtttgtatatattcacaaatgtatatgttaaatattatattacaaacaatgcaactgcatggctttaagaaagttaagaagaaaggtgattacagtaggttctcacttgttggtaggtttttggaaactgtgactttaagcaaagccacatataacaaaaccaatttttttctcatcaactttataacaaaatgatgttgaatgaaataacctgctatatatcgttcctcttaaagttgcaatttccgagaatcagccaggtatggaggctcacgcctataatctcagcgctttgggaggctgaggcaggtggaatgcttgagctcaggagttcaagaccagcctgggcaacatggtgaaaccccatctctacaaaaaaaatacaaaaattagctgggtgtgatggcatgcacctgttgtcccagctacttggggggactgagatgggaggattgcttaagcctgggaggtcgaggctgcagtgagctctgatcatgccactgcactccagcctgggtgtcatagtgagaacctatctcaaaaaaaaaaaaaattctgagaatctattgacattgttaagtgaggagttattgtatatatgatttaaatttattacatatatacacacatatagatgcatgcatgtgtgggtttttttatttttggctggctcttgcttctctttggatgtatgtgtggttttaacaatcttcaggtgaaaggtctttatatataatatatgtgtgtatatatatttatatataattgcacaggtttgagagttgtttaataggctaagtgaagtaggtgggtcaaacaggtacaacacatgtattttcttctcttgtgggcacatttcaattgaatatgtttattggctgctgttgtattagtgcgtaaacaataacatttggaagcatctatttcaagtcaatttcctagggccatttaaaccactctgaaagaatcttagaggcaataaatttccatgactccttcctcctggtgtaaactaggatgccagttaaagaaaggtagtttactaggacttgggttttggtttaataataaagctataacttgaaacatggaaatgcagtggctgtgattaaatctgctcctgcaaaatgggaagcgaatgataattaaaaaccacaaatatgcaaaaatacctagaaactattcatgattttttgtgttccttctttgatctgcccccaaccatgttccatgtaacacacataggaggaattctggggttttccacatgtttttgccctttcctgtgccataccctttactttaatagacaaggagggggtccccaaaccagagatttgagagcacttttggtgttttaatgtttctagactttatgaagctggcaaatggcttggaggagaatatttgagcccactgaatgtatacagagctcactgctatttgtcttgtgcagtagtggatgatgcaatagggagactataagctggattctggggctccaggtctcttccttctgcatggctaagaggagaacccttctgtgagcaccgtgttgctctcatcccacttgcccaatttgcattgagatgcttgttccttgattcagggccctaattatcaagcctcgatctttgctcatgtgactgctgcctgtcgagtctttgagagtaagtgttcccttgctcatctctgattgcatgtgcccttcttctgtgggactccaggatttcccaccaacagtctctcttatgggttctttctgggtagaggcccaagtatgaagacatgcccagtgttagcttgagggttcctgtgcaatgccactgatggttggcacagttataggaatgtcaaacatcaggtaggttcaactctgaacaatttcattaagcatctacgtggattcatataccaaagtctgtgcttttcatgatcttaaagcacagtaattttcatagctcgtaaagtaaaatcttttcacttctgtcttctcaaaattgccaaaaaggatcatccatttcttttggccaggcaccatgccctgggacattatatctaatcaataaagggttattgattagaggggcctgagatgtatgcttctgcctgccttactggtgagaaagctggtgccccaagtgattaagcactttttggaggtcatacagctagtgggtgctggaatcagaatgccatgtctgtctgactccaaagtcctccatccacatatcaagacaaattattctgggaaatatttattgtaacaggatactcatttgacagcatcatgaaatgagatggaaaaaaatggcattctgtaggaattttccatgtagataaccaggaaccctatggatctctggcctcacagcaaggagagaagtgggggcttatgaagaggtttctgtggcattatagccctgcctcctccccagtggagttaggctttcttttttcttgtttcctaaatgaaataaaaacaaatgacatggcatgcatctctcttagcctcagtccaatgttgaggcttcagcgacactcctcagagaggttgatatttgattgtgcatctcttgggggacctaggtgggtggcacctgatccctgcctgatctgctctagagacttctgatctcgaggactagggggagttgatttaggttgcacttccagagtccctcaaacaaatatgcataaccagataaccttaatgatttggacttttgccccacaaaatctgctgggatgaggaggaaactccagcagagaggcgccacttgaaaaccagttggaggaagagacaacatcgcccgcatctcaggagttgcaaatgggggtgatccagctgtcctggcttccaagaacttaagaaaatgcccttcagctttgcctgaaatcttcacatgacaggaccagtgagagaagaacaaaccttctgctccttttcgccttcctttcctgctactctccaggtggagggatcagtaaccacagcagggggaatgagggaggatgacaattgagaaagccagaagcttccccgtgtgtgccctctgtttcaggaccatgaaaagcatgccttagctgggggtagggtggggagaaagggaagtcttactctggaattaaagctgcagagatttagcctttcattcgacatttaactttgatcttgaaagcattcagtgaccagaaacatcatgtgatgtgctggaattttgaccactagctggtataagacatttctgcaatgagtaagttttacagagaccctgggagacaaaacatggccttttggtaaaatccgagtcgtatttattcatgttaaaatacttttcaggtttcagcatgcccaaatccttagttattattaagactagaaaatgggctaacactgctactttatatattatttgagtgcctactgagagccagaggcacacaaaataattagaaataagcaattttttatttatagaagcaaagactcagattaggcttttttttttctttctccctttcctttttccctaaatgctgtaaaaacaaacaacacgaggaaactaataaaagagaaacactggaggttatttttcctggggtgtgattttcccccaaggtgtgtggtcagaagactgcctgctgtttcatcagcgttgatgggacacctccctgctgagtggtagccctgctcattgcccaaccctgtggtattgacacagagaatgaattccttggggctcttggcactgtgttgtatgtgtaactcacgtaacaaacaggctggcaaggcttaggcacatcaggctctccacagatcattaaaaacaaaacccttgctcttctcatcctaaaaccacgtcctatgttgttcatcgaaaaaataatcatcactgtttgtctgtcccaccccaccattatatagcctccctcttcttcctcaacacatgctccctttccttgctgcgcaccatgcaatgcaaaattcagtgcctacaggaagtgctctcagtgaactcctgattgttttccaggttagggagtcaataggtgaataagaattgcagttaagtattcagggctggcacccaaagctcctccaaagtgatgagttggtgaaggaagtccagcttccctctgagtgatgttaaaaatgtgtggggcactgggggagaggaaggccaggtggagaaatacatgcagttaaataacttttttatgatagattcgctgattactcagtgatgactttattgccaatgatgctccaatataactgcccaggctgtcaaatgattattcacacacgatgagcgttcggctgggatacttgtccaatgtgatggtatgaaaagctgtttgagatccttgaaggagacgtacaaagtgtcttgagtcttccagtaaagagccctctctgaaagccttgtaagaactggtgagttacatttttaatatgattattattttttcttctctgctgctaagatgttgggatacgtgatgacagaaaattgcttacggggaatatttactttagttgcactgcttcaaaggaagtctaaaggtttctatttatttcccttcctggaatagcccaagagcagcatgttaagagttaattgaataagtagaagagccaagtctttgctctgggaggcggagttttaaattctcttctgtgggactgatcaaagtttatacattttttatctgtagtgttacattaaagaaaatatctgtaaaaccacctacaacaatttatctaatatgttttcatttgctcatttgccctgaaacaaggctgtctataaggagaagaaagtaattgccaaatagtttgtctttgtggattagagtggtagtttgaaaacacaagcttggtataaagaatactggagtttagaggaaagaatcctaaaaggaaatgagcaaaggaagtggtggattttgtgctatagtttacacaaaagagaaattaaatcaattaacctcatatatgaaaatactgcacccactgcttctgagttagatacgatgtctatgcgggagatgtctttgccatccaatgcattccctgaaagattggcatgattttaagctttcaacttactgcttttctaaaggatgaatttgagaaggaattaacagttgtttcactctttttcattttaaatatacagattcaatatctgtaatgttaatatgtatgtatcctaaagagtggaaatacgtatcctaaagagtggaaaaagaacatacatgcctacttctagaggggcatacacgtagatctctcagtttatcctcaggaccatgcatgaagtcaaatgtttctttttgttttttcttttttttgagatggagtctcgacctgtctcccaggctagagtgcagtggtgcgatctcagcttaccacaacctccacctcctgggttccagcaattcttctgcctcagcctcccgagtagctaggattacaggcatgtgccactatgcctggctaattttttttttttttttgtatttttagtagagatggggttttgccatgttggccaggctggtctcgaactcctgacctcaagtggtctgcctgcctaggcctcccaaagtgttgggattacatgcatgagccactgcatccggctgaagccaaatgtttcttaacaggctatgttggttttaagatgtggtgtttattactgcactttttacagtatacttgtgtatgtaagatcatctctataaaagaactaggttaactgaagaatgggtatgtagttcagagatcagttagtgttttctgaaaatttatattaattgcagaaaatgaacatccaaaaacaatttaacttttgcaatgcatgctgtacataatctagtaattatgaaccaaccaaatggatgattttttccccaaagagagatgctaagaaattcctttgatctctttcaagtaaactctctgttatcttatgagcaattataatgaattaagatgtccagttcatgcttactttacttcttatcagagtatcaacatatttcatgtacacatcagttttgtcttctgtgccaacccgagcagattgagttggaggaatgttagaaataattttcactgaaaataatatcactaaaagtgttaaaattattttacagaaagtttgctccatttcgtgtcatttactgtaggtactctttgtctcaaggaacacatgacaatgctttactgagtaccctgtgagttggtatctatagtgacattactatttgccaactgagaaattgccccatattcatttataatgagattatcacatcacagctgatatcaggagacagaaatctaaaagctttcagtgcatgaaaaaaagataataatgactcctctttgcattaaaaacctaaatagtagatgttgagcatcccttaaaagcttgaataaaataagcattaagagtttatggccaaaagtcctaagccatgctttctagaccaggttctgtcaccattgttttgtttccatcttgtcttctccttaaaattcgagccttggttggaaattaacccctgtcaaacttggccactgagtcaacaagcacttccccagtgccccagggacacaggtaacagaggatgtggcaatgatgaagcagaagtccagtctcacctcaggtgttttctgtgaaggaaaacaagcagtataaatactgcaagtaccaatgtcaataataattaaatgcttattatgagaaggaagtgcagggcagagacttggcacagggctaattaggagaagcaccttcaactgtgaggtctgggagaaagcccagggggatggaacagagatggcttagggtcccgggttcctcttggcggttccaagactgggagatttttagtttagagatagagactgggacgttctctttcacaatgaatttgtctatccagcgattccccacggaggcactgttggtacgtggggctgggtgattccttgctgtaggggctatccagtgcgtggtaggatgcagcaacccacaatatctccagatgttgccaaatgtctcctggtaggtaaaatcatcctcccggatgacaatctctggcctgaaataagcatttaaaatgtgtaagactggccgggcgcagtggctcacgcctgtaatcccagcactttgggaggcggaggcaggtggatcacgaggtcaggagtttgagaccagctgggccagcatggtgaaaccccgtctatactaaaaaaaaaaaaaaaaaaaaaaaaattagctgggcctggtggcgcgcgcctgtaatctcggctactcaggaggctgaggcaggagaattgcttgaacccgggatgcagacgttgcagtgagccgagatcacaccactgcactccagcctgggcgacagagcaagactccgtctcaaaaaaaaaaaaaaaaaaaaatgcatgagacagagcttacttagagcagggtttttcaacctcagcactgcagacatttggggctgggtcactctctggtggtggctgtcctgtgcaccatagggtgctgagcattatccctgggctccacccagcagatgccagcagcacctcccacccactgctaagttataacatccaagcttgtctccagatatcaccagatgtttcttgggttgcaaaactgtctcttgtgtagaatcaccaaattggaaacagataagaaccggcatctgggatcacagaagaggtgtggagatcactgttttgagtctgttctcagctctttttccagctggccaggcagctctgtgtttttgctagagcttgtcacagctggtttgacctgggtcattgggcaagcattccctgggtctcaacttgtcacctcttctgcctatgaggaaactctggagctatccacatccaagtgacttggccaaggttctgttcagcataggtggcttttccagtacctgacttctcagcccacaggactttaccacttcttttcaaatcttgccttcagaaatgtaggtttgcaatcctttgtccataaccaaaaatagaaaagaaaaacattgaaaacccagagtttttctaacatacttggcagtgacaccagctcgaaccaactaacataaaactaacataaagtgaaaagtcttcattcatcccacagattgtgggtattcattttgtttcactgcagaactttttttagatagggtctcattctgtcaccaggatgaagtgcagtggctcgatctcagctcactgcaatctctgcctccttggttcaaacaattctcccacctcagcctccccagtatctgggactacaggtgcccaccatcatgctcagctaatttttttttgtattttttggtagagacggggttttaccatgttggccaggctggtcttaaactcctgacctcaggtgatctgctcacctctgcctcccaaagtgctgggattacaggcgtcagctactgtgcccagcctcactgcaaaactgttaacatgggtgaccacaggctgctgtccaagacttcgcttgagctattatatatgacatgagatattcaccattaccttataaaacccaaaacattctgcattctgacacacaccttttctcaaaagtttccatctcaagactatgggcctgagaatgtaattgcaagtggaaaagggttcattcttaacttcttgtgaccttgaccacccgatggtgctgttgttttttggtttatggtatcatcatgtgcttctgtgtgtcctcggatgcagcttccattatgtaaaacctccttccttttctgtactctttaagctttagaataacctgagaacactcaggaactgaaattgagccagaaaagctgggcagaatagctgtgtcatttggttctgggcccacttgtaagtagctcccagcccccacttcccagccaattacctaagatgcaaagaaccatttacacgaatctgggggacagagtgaccagacctggggactctatggcttgcggctattaaaccaaaagacacttcttcattgttgaaaggctaaattccattaaaaaaaaaagaaaacaaaagtacaagcatggtggctctcacgcctggaatcccagcacttcaggaggctgaggtgggtggattgcttgagtctaggaattcaagagtggcctgggcaacatggcaaaaccccatctttacaaaaaaaaaaaacacacacacacacaaaaagaagagtcaggtgtggtgtcacatgcctgtagtcccagctacctgggaggctgaggtgggaggacagcttgagtctggcaggttgaggctgcagtgagcactgattgtaccattgcactctagcctgggcaacagagcaagaccctctctcaacaatgaaaaataaacaaacaaaaacaactaccaagtccttatttggtttgttaaaaagaaagaaaaattgttctttattgaagtatgggtacatctgggacagaatttctcatcctctgcacactagatatttggggcaggataattcccttttgtgggatggactgtcctatgcagtgtggggtgttagtggctttgctggactgtgatggccaatatctaccttccagctgtgacagccagaaatgactccagacattgtccaacattccctggaatgcacaatcacccctggttgagaaccactggtctagaaaaagcattttaaaaggagtaacaggctgggcatggtggctcacatctatagtcacaatgtgttgggaggccaaggagggcgaggagattgacaccaggagttcgaggccagcctggacaactctgtttctacaaaaagtaaaaaaataaaatatcagccaggtgtggtggctcacacctgtagtcccagcgacttgggaggctgaagtaggaggatcccttgagcctaggagtttgaggttgccatgagctgtgatcacaccactgcactccagctgggtaacagagtgagatcctgtctctaaaaataaaataataataaaataaaaatagtaatgcaaagcttcgacttaatcaggattctctgccttgatactattgacatttgaggccagatcattctctgttgtcaggaactgttctgtccacacttagtagcatctctggcctctgctcactggatgacaatagcactgtccataagttgtaacaaccaaaaatatcttcagacattgccaatgtcccccgggggtcaaattgggccctggcaagaaccactggtctaggctagtgccgtagtctacagagtcacattactttaactttgtgtggtgcctcatattttacagaaagcattttctctttctctctgtcgctgtctttttttttttttttttttaattgagacagggtcttgctctgtcatccaggctgtagtgcagtggcgtgattacggctcgctgcaccctcaacctcccaggctcaatcgacccgcccatctcagccttctaagtagctagggctacaggtgcataccaccacacctgactaatttttgtattctttgtagaatcggggtctcatcacgttgcccaggctgatcttgaactcctaggctcaagtgacccacctgccttggcctcccaaagtgctgggattacaggcataagccatcctgtctggctgcattatcttatattttgcttcatttaatacttttctctttcaaccctgtgaggtatttttgagtcccatttttgtcggtgggaaaactaaccccagcaatctatacagtgtgtcacagagttttgtttgtaccctgccatgttgccagatatcacatggatgactgaagtatggggatatgcaaagccatttgtcttaattggcagacaggatcatataaaataatttacatgatactaagtagacaccacagttagcaatatgaaatggattccaggaacttccaattgcaaattagctcatgtaactgatgaattacttaatctaggaggttatagctgcaggtgcctagagcttgcaggttgcatgactcagaagatttttagttggacatgatggagacccagtgcaaccttgctccaacctagaaagagatttttcagttgcatatgtgggaagttcatagaatcaaagagaaaaccactaaccaggaacggttgtcttcaagaccagctgaaaattctttgtaagcctgtttgacatgacccatagctactacctatggctccagatagaagccatcactgtatttgaaaacacttggttttacattctggttaagttgtatagtgttggtactattttatgtatatttgggattagatactgtagtcattatttatcactgcagagcaaattaccacaaacttaaagacttaaaacaaatacccattgaggatcttacaatgactgtgggccaggagtctaggcatagcttagcagggttctctgctcagagtctcacgagattgccatcaaggtgctgtccaggtgttggctgtgttctcacccagagcgtggggtcctctttcaagctcaatatcaagttgttgataaaaaatttatttatttatttatttatttagagacagagtcttgctctgtcgcccaggctggagtgcagtggcaggattgaggctcactgcaacctctgcctcccgggttccagcaactcttctgtctcagactcccaagtagctgggactacaggcgtgtgccaccacgcccagctaatttttgtatttttagtagagatgaggtttcgccatgttggtcaggctggtctcgaactcctgacctcaagtaatctgcctgcctcggccttccaaagtgctgggattacatgtgtgagccaccgcgcccagcccaagttgttgatagagttttgttccttcttgtaggatggaagctctcagcttctaaagactactcttcatgagaggcatcttacaacagagctgtctattttaccaaggccagcaggagaaggcctcttgtgcttggattctgctttcaaggccttgccctattagggcaggctcacctaggatcatttttttgtttggtttttgttctgagacaaggtcttactctgttgcttggatcatggctcactgcaaccccaacctcctgcattcaagccatcctcctggctcagcctcccaagtagctgggactacaagtactcaccaccatgcctggctaattttttttttttaagtttttgtagatacagggtcttgctatgttgtccagactggtctcaaactcctggcctgaagtgatcctctcatctcagcctcccaaaatgctgggattacaggcatgagccaccatgcctggtcctcatctgccttttgattagcacaaagtcagctgattaggcaccttaatgacacatacaaacatccctttacttttgccatactttattgattagaagcaagtcatcatttccaccctcactcaagagaaggtgtattgttgtattgtactcacaacaatacaaagttgtgagtaccaggggctggaaacccagaaggcgatcttagaactctgcttcccacgagtgcctttgtgtgagtgcacctgggaactgaattataatgtagggaaaaatgtgttctgagaaccagataacctaatggcaaacagatgtctgggggaaacggatatgtaagattggctttggttgccagtcctgactctagttagccaatttcaatgtcattgatttatatttgatgataataaaatcatgaaaaatcccctacataattgaatattttattcttgtcatgacaaagtctcctgcaatgcatcacagtaattttttccagttgctcaggaatgtgtctaggggctgtggctcctctgaaaacaggatcagagggcatccctcataatgtgtgggcaggtttctgggaatggctcatgcctccctgcacacagggaatcccatcaaaattcttcctctgctgccctgggtggtggatgagctgtgcccctcctttccctgcacccaggccttgcagtgggatatcatctctcagtgattgggaattcttcctcgagcaccttcaagttgccttcctctctgtccttacccaggatgttccttagaagaacagcacagatgcctgggtctggtgccaggctggcttggttgaattgctcaccaactgggcagtgagggtcctccttccactcacagtagggtttatttgtccaaatttcattttggggatgtcatatcatgctagtgatatcagaaggctttatggtattaacaaaatagcttcagctttgatcatctcttttctgaattgtttttattgagatgaaattcttataaaattaaccattgtaaaatatacaattctgacatattgagtacattgaccacattaaaccaccatctgtctggttctacaacattttcatcaccaccgaaaacaaccctataccctttaacagcgattccacattcctcccatacccccacccctgggaaaccatcagtctgctttctgtctctatgaatttgcctattttagacatttcatacaagtagaattatacaccctgtggccagatgaaaacagggtctctgggggctcagtgctctccaagaggagggatctctgacctttcttttcccatctgccctttctcttctctcttcttttactgagcatggtgtttaaggtccatccatgttgtagcatgtatcagaatttcattccttttcattgctgaataatattctattgtgtggatataccacattcggcttatccctttgtctttcaccttttcgctattgtgaataatactgctgtgaacattgatgtacaaatacctgagttcctattttcagtaattttgggtgtatacctcacagtaggatttctgggtcatatggtaattcaactttttaaggaaccaccatactgttatccacagcaagttttactatctcttagttttaaagtcctcacattacagacaattctcacctttgattgaacatccagcaattatagtatctcctgccagaacttgtgttgaggagaaaataggtttggcttaggaaggtgcacttggcaaagcctccctttacttatcagcatttctgagactcgtttgtttgccctgcagcctgttggaaaaggcagtgtcaaaagcagctctgattaagtctagaaaaactcattataacacatgggtggcatgtttgttggtggggggggctggggggtgggtgcggttcccagaaacggcaccacagagggtgagctgacttagtgctcaagcatataagaggcaggccttgtaaacagtgaagagaatgggaatttacagaacatataggttttatttctctattcccgagcaatttagttctgggtgctttgaggatactgattaaatggtcatataaagcaatcacagattatagggtcttgttgtagaataatacaatctgatgattgtcaccaccccagaagacaatagggcaataatcacatactgcaggttccaagaaatatgatgagacctagaaaaacgtgacttcttaaaaatatatacaggcaggaggtaggaatagtgatttacagcagtgggaatggaggatctcactagggtgaagtgttccagaactgatgttgggggaggggtacggggggtgtcgaacaatatggtaatttaatcaaaacattcaattgtacaactgggtgaattcaatgcaatgtaaaatggatctcaaaaaagtaaacatgtttttcatcaaaattattattttgagacagggtttcactctgtcacccagactgaattgcagtggtgtgatctcagctcactgcagccttaaagtcctgggctcaagcagtcctcccaccttagcctcccaagtagttgagatttcagatgtgccccaccatgcccatttaatttacattaaattaaattttaaatttatattttaaaaaatttaaaaatttttttaattttttgtagaaatggggtctcactatgttgctcatgctggtctcaactcctgggctcaaatgttcctcctgcctcagcctcccaaagcactgggattatacgtgtgagccactgtaccaggcataaattatttttaaaaataaaatgtcctagagtcgctgggaatgtatggaatttctttaactatttaacaaaggcctccaagagtcactgtattgataactccaatggatctaatcaaacacgtaattagatgccacatatattccacaaacaccattgtactaggggatgcttcatttcctattaatggctgggcagtctctgcccatcccctggtacaatgggccagtcatgggatatgcagggtcatatgattgcaaggtcatgaaatgactcagaggcctctgcaaaaccaggtccagaggaaccctccaaatccatcctggagtggctgcagtttgtcgccacctgttggtagctctctgctcaaagcataaaaatctataggggcagttcggcctcctggggctggctggcttccagaatcctggcagtaattccaagactctctgagttggtgagctgaatctgctcctcagcctcaacctggaggtagggccagaagaaaataggatctatgaggactcagcgttttccaggaggggtctctgacttttccattgccacctgccctctctcagctctctacccccagcttctccccaaaaatgtcaaccccagtcttagcctgccctggtcttgggacagaaatgggcagaggatggaaccaatggccaatcagcttctgcatattcaaattccaattatttgaggagctgttatccttgggtttactggactaacttatatccagtggaaagagcctctcttgcaatcccacgtcctcaccatcaacaaacacaattgcacccagccgataaatgatgagatttgggattttattagccataatagcatagaagtggcttgagtgactaattgcgaattattttccagcaaaaagtactcctgacgactgcccagacattaataggaaatgaagcatcacccggtacaatagtgtctgtggaatatatgtggcacttgtatattcgattagatccattggagggatcagtatagtgactcttagaggccttcttgaaataattaaagaaattccatacattcccagctactctagaaccatttcttttctttaaataatattgatgaaaatcatgtttacaagttttttgaggtttattttacattgcatttaattcaccgagttgtacaattcaatggtttttattaaattaccaagttgcgcgatcatcaccataaatgagtttgggaatattctcatcacccaagtgagattcttcaagcccactgctgtgagtccctatccccacatcccacctgaatacatttttaggaagtcacatttttctgggcctcatcatatttgtttgaacacaggtcatgtgaattttggcctctggagtgttgatgatcatcagattgtatcactctgcagtatgaccctataatcagtaattgtattataggactgtagaagcagcatccttaagggacccagaatgaaattgctcaggcatggggaaataacatccatgtgttctggaagcccccacgcccctcactgttcgtgatgcctgcctgttttccgcttgagcactgtcagcttgcccctcttctgccatttagcctggcttctcttcccacttctaattacagtcattttctacaaatcgcctatggaattcattcctgtacttagccccttaagactgatttctcttataggcaagtcaacacctgtcgttgcttgtgtatctcaggctgctgtcatttggagatgtgcataattatttcgaagacacagctaatagaaaagagtaagggaaacatactgaatgttggcacattacacagttgtaccaaaaaaagagcaaatcacaaagctttaacttagacatggaagcatgtggggtatgcttgagtaagtatttttaaaagagagaagaaatccaaagcagtataatttgggaatatgcaataaaccaccaggcctggtccagacggtgaataatgagttcttacctacaaataacaaaattggtaagaggcttgatctgttggtgatgtgggacttgacaagtgggatacctgttggaagtcttgcccagctaaaaacttaatatctgatcagctcttttcttttttctcagtcagtgttattcactttgttttattttattctggggcacatgtgtaggatgtgcaggtttgttacataggtaaacatgtgccatggtggtttgctgcacagatcaacccatcaccaaggtattaagcctggcatgcattaggtcattttcctggtgctctacccccagcctatcctccccacacaggccccagtgtgtgttgtttccctccctgtaggcatgtgttctcattgttcaactcccccttataaatgagaatatgtggtgtttggttttctgttcctgcattagtttgctgaggataatggcttccactctcatccatgtccctgcaaaggacatgatctcattctttttttatggctgcatagtattccatctggtatatgtaccacattttctttatccagtctgtcattgatgggcatttaggttgattccatatctttactattgtgaatagtgctgcagtgaacatacacgtgcatgtatctttataatagagtgatttatattcctttgggtatatacccaataatgggattgctgggtcaaatggtatttctggttctaaatctttgaggaatcaccacactgtcttccacaatgattgaactaatttacattccgaccaacagtgtaaaagtgttcctacatctccgcaaccttgccagcatctgttgtttcttgactttttaataattgccattctgactggcatgaggtgatatctcattgtggttttgatttgcatttctctaatgatctgtgatgttgagctttttgtcatatgtttcctggccacattaatgtcttcttttgacaaatgtgcattcatgtcccttgcttactttttaatggggttgtgatcaactcttttctttttggaaactttatcctgcagatcaaatattgctctgaaatggactgtaatgaacaaggacagattggttgttgaagtgagagtggtagaatctttgggagaaagtggccatacagttttagaatctataatggtaaatgaccaacatagcttggcatgtgcattggggtttgggaaaacagagtttagcattgttcagataaaaatatagatattatctcctggccagggactctgagaaagaaatggatcaagtgctaggatgtactcaaacatgaaatatctgcacatacaatcacaaaaccataaagcatccaacagagaagggaaaaaaagaagcattgaaagaaagcaatgcggccctatagggtttctctttaatgaacctagactttgaaagagaatatttgagaagttggagaagggctagaggaatggcttacttttctatatataatgttaagaagaccaaaatcccaaagatactgataagactgatgagaaaaagactcacttcattccctcatttgtaggtctaccctgattcaatctcctcgccctttcaccagccagcatacctgctgcatgaaaactaacccatcacgctcaccctccatttaaactgcatgcaacttctgaaactgtaataacagacatatttactcaccaagaattggcaggcgataacattttgccatattttgggtcgaaccctaaagagtggtagtgaggttctttgagacaattgcatggaagtgctcacctgattcattccaaagtgctgactgacagcctcacctgcattttggggattccttgtcagattgatcttctcgtaaggtgtaagcctctttttgcgttcttcagcatcccaaatttatccctctcctggaatcccaaacatcacagttgctcctctcacatttactaggaaattttgctctaaaaactctgaacaaacaagcaaacaaactgacaggcaccaaatgggtgtcatcagatctgcctccctaacttgtactcagtccttagatgggccctgattgtaagctgctgtgatgattccccacctggcttcacaaagccaccttccttctcaaaacgtttgatctcatcaggcccacatccaagtcttcatgtctactgacatctaactggcgttggcgtcttctggaacttcttttcgaaggtcagaattgatcttttcattgtcaaacccagtcaatacctttgtgatgattaacacttctagttatcccctttgtttcagtatccatggagacagtgttcatatcacggtgatggtggggacaattccagaatcagaaaacctagatccaaattctatctttttcacatagaatctgagctggtaaaaaaaaaaaaaaaaaaaaaaaaagccagatgcagtgactcatgtctgcaatcccagcactttgggagactaaggcaggaggatcccttgagcccaggagttcaagactagcctaggaaatgtggcgaaaccctggctctacaaaattttttaaaatacaaaaatcagccagacatggtggtacgtgcttgtagttctacttacttgggaggctgaagtaggaagataacctgaggccagaaggttgaggctgcagtgagccatgatcatgccactggactccagcctaggagacagagtgagacctggtctcaacaaaacaaaacaaaacaaaaccccacctctgtacatatcagcttctctactccacctataaaatgggaaggaataaatgacatgattacaggttatagtatctgcagaatgaagataacacccagcatattgttagcccttagtacacgataatggcagtgaccttgtctgtttcctccagcatgagctacaaatattttccaaactcaatatgattaaaataaattctttagtgtctcttttctagattgactgtgccttcagtacttcctcgctcaatcagtggggtcctccattatccagttcatgagctagaaccatttattctccatgctcttatccacttagtcatctgtttggctgagtttccaaaatacctcttgaatttacctccactctgtctccatcattactgcctttcagcctcatccttaggactttaacaataatacactatttggacatctgagcaccacctccctttttgtggtaaaagtctgtgattttctttccatgttcctaccttgcctctccactcaccctcagcttctgtgcttacccggttccttgctagtcccttagtttatctcctttccattcagaatattccttgaacgtgggttttgtattggcactttggaacagtttccattgttttccaataactccctgatcagcctagctctaaagtcactcttcggtaatttggccaatatcccatgaataccaagatttcacaggatcacgggggtaaagactttgacagccaagggtgatatccatggtaacagccagtgagaggaatgccttttgtgcaaagtagaagaaagttgattaggaaaggggtgggcttggaaaaccgactaatactgagatagccggcatactccagcagctgggttttagagcagagcacacatggatgtgaaagatctggaaattgatttccttagagcatcccaaccctttacaccccatcagcatgtctttgtgtatctctacaagtaggtgtattagtccattctcacactgctgtgaagaaatacccaagactgggtaatttataaagaaaagaggtttaattgactcatagttccacatggctggggaggcctcaggaaacttacaatcatggcagaaggggaagcaacatgtccttcacatgacagcaggagacagaagaatgagaaccgagtgaaggaggaagccccttataaaaccatcagatcttgtgagaacttactcgctaacacaagaatagcatggggaaaccacccccatgattcaagtacctcccaccaggttactcccacaacatgaagggattatgggaactataattcaagatgagatttgggtggggacacagccaaaccatatcaataggtgagccccagtctgaagactagtggcttagattattgtatttggcttggcactggtgtcattttctgcaaacctctgttagatctacagtctacccattttgcctctatgaaaataattttcccacagcgtgtatcatttttctttaaaaacttacctcatcatactggcaaaactcttgctcctggctctctgagataatccaggatcatctccacatccccaaacccttaatataatcacatctacaaactcccttttgccatggaaggaaacattctcaggatcagggtactagaatgtggacacctttgggggttgtgattctgtctacccaacttggtttccattgatgtagtttgtaaagatggaccttgatcaaaatcttttgtgggtgagccatttatatgtttaggagttcattaataatgcgtagcattgtttgtgaaaataaaatcatagttatataaatagtagtgttgatttgttcataaacaagtaatgtgaacatgaactttttctgtgtcatcatgtcaattttatacaacatataattttaatttaaaatatatatatattatatatgtatatatatatatttttttttggagttgggacagggtgtcactttgtcacccagactgtcatcctctcactggctgttaccatggatatcactctgtcacccaggcatgatctcagctcactgcaacctctgcctcctgggttcaagtgattctcgtgcctcagcttcccaagtaggtggaattacaagcacatgccaccacacccggctaatttttgtatttttttggtagagacagggtttcaccatgttggccaggctggtctcgaactcctgacctcaagtgatccaccccacctcggcaaagtgctgggatcacagatgtgagccaccatgcccagccttaaatatatatatatttttaaaggcaaggtctcactctgttgcccaggctcaattgtggctcactgtagcctcaaactcttgggctcaagtgattctttcacttcagcctcccaagtagctgggaccataggcacatgccgccatttctagctaattttttggagagacagggtctcgctatgttggctaggctggtcttgaacccctggcaaggaatccttccaccttggtctcccaaagagctgagattacaagtgtgagccaccatgcccacaatagagatttttaattctgactggtatatttgagccagttcagggatatctgatggatatagagagacaaaaggttttttgtacagtaaattaattctgttaagacaaagcacataaacaaatcagaatgttcttcagcataatcagacatgtgcaaaagtttaaagtaagttttgccctttcccttgattgttcgattgctacccgagcttcagtgctgagatgcgctacctctctgttcaatgatgctacctttggtgtttgttgaacaatttttcatcgaacctaatttagaggaaaagatgtttagctgtagatacaatgaagggaattttagctccttctggcttcatatactcccgctgccgcatcgtgggcagcaggggtatcgcctgcatcgactgagttcatctgttttcccctcactgttgcctttgattttgtccttttgcttgggttcctctctccactccgaaaacattctcaagggctgagctcctgcaaaatcctttcaattctaaatgccctcaagtaaaacattattctttcctttcctaacaaacttctcatgaaagtggttaactagctttctctagtccttctcctgaaagtgataactagctttctctagtccttctcatgaaagtggtaacttgctttctctagtcctcatgaaagtgataatgggctctctctgtccttctctctctgtccttctcatgaaagtggtaactggctttctctagtccttctcatgaaagtggtaactggccttctctagtcctcatgaaagtggtaactggctttctctagtccttctcatgaaagtggtaactcgctttctctagtcctcatgaaagtgataatgggctctctctgtccttctctctctgtccttctcatgaaagtggtaactggctttctctgtccttctcatgaaagtggtaaatggctttctctagtcctcatgaaagtagtaactggctttctctagtccttctcatgaaagtggtgacttactttctctagtccttcttgtgaaagtggtaactggctttctctagtccttctcatgaaagtggtaactggccttctctagtcctcatgaaagtggtaactggctttctctagtccttctcgtgaaaatgataactagctttctctatcccttctcctgaaagtgataactcgctttctctagtccttctcatgaagtggtaaccatctttctctagtccttctcatgaaagtggtaaccatctttctctagtccttctcatgaaagtgataatgagctctctctgtccttctcatgaaagtggtaactggctttctctagtcctcataaaagtggtaactggctttctctagtcctcctcatgaaagtggtaactagctttctctagtacttctcctctgatttctttcatattcataggatctcctgcatggtacatgtattcacacccaaggctctgatttcaaaaccaaccggcagtgaacagcaggaaacatcaatgttcccacttgttaaaaagtcatttcttgacaactgttaggcatctgagattagtcacccatctgctgtcaatgaatgagtgtatctaaaaggttcaaaatactgactctaagaactcatagaaacaacagtacaatggcagttaccaggggcagagggtgcgggtggaagaatggggagatgttggtgaaagggtacaaagttccagttagacagcagaaataaattcaggacatccattgtacaacatggtgactgtggttaatggtaatgtattgtatacttgaaatttggtaagggagcagagctttaatgttcttaatcacaaaaactgagaagtatataaggtgctggatatgttaattgacttgataataatcattctacattgtatgcatatgaagcatagtcttcagattataattcctagagagtgttcctcatactctacggcagtggtccccaacctttgggaccagttttgtcaaagacaatttctccctggacctggggtgaggggggatggttttggaatgattcaagtgcattacatttattgtgcactttatttctattattattacattataatacgtaataaaataattatacaactcaccataatgtagctgagcttgttttcctgcaactagacgatcccatcggggggtgatgggagacagtgatagatcatcaagcattagattctcaaaaggagcacacaacctagatccctcacatgcacagttcaaaatagggttcacactcctatgagaatctaatgcagccacggatctgacaggaggcggagctcaggtggtaatgcaagggatggagagtggctgtaaatacaggtgaaacttcactcattcgcctgttgcccacctcctgctgtgcagccaggttcttaacaggccatggaccagtaccagtctgtggctctggggttggggacccctgctccacagagtcagcatacaggtggaaacagccttgactctcacattctccaaagctcgcaggcaaaaattggacattgatgtcctgaggttacttctgcctgtaaaactaggtgttaatttaatgaatgttactgtagtgtgggggagtggaaatcaactattaggtaattcatagaagtcgtcagctgagagagctgataagctccataaattcccccagctacccaagattaataattttatactgaaagcaagtaattatgaatttgcctctaaatcacttttttaaaatccacactcaaaagttgacaaactgtcctcataagtcagacaccacttatcaacctgttcacagcatggaaaactcagagctgcctctccttgatggcatgcttctaaatgcagtaactcaatcctgctgtcttaaggaaggcaatgtttaatgcccattaaaggaacccttcttgttttggtaggcagggccgctatgtctgctcaccagggaatatggatgctattcgatggtaaagtgacaaacacagtagtccttaaccacttacacttttaaagttctacacacatttatgaattcaataaagtgtcatttttcaatggaattgttagaaccccaaatctcagtgttacacaatatactcgtgtaacaaacctgtacatgtatccacttaatctaaaatttaaaaagaaaagaagaaactattgttttttagcctcaaatgttaaaaatacaaataccagtctgctaactttcagatcctggagacatcaaatcaaaactcatttgtcgaagctgtcattatgaacacctgggttaataaaggaagtgcagggcaagacacatgaagagtgaagaataacaagtactgttttagagcctcctgtgaaggtaactgtaaggtgtcaggagaaacaccctcagagcatcggaagtgactctgcaaaggactcctggagtgtgctggtccaggtctcacagtgaactggcctttggactgtgaacctgggcatccccaccagacacctatcacagcccatgtcatgccaacatcacctagaggcagtgggtttctggttgtttactgacttagctctggccttgaaaacttggcagcagtttcaggagtctcctgtttgaggctgagatgaagcttctttgttctatgggtagatattgcagggatgcctttgaaaaacaaaaaacaaaaagacaatgatcaagctgggtgtggtggctcatgcctataatcccagcactttgggaggctaaggtgggtggatcccttgagcccaggagttagagaccagcctgggcaatatgatgaaacaaacaaacaaaaaaatatacaaatcggtggcacacacctgtagtcccagctacttgggaggctaagatgggaggattgattgagcctggtaggcaaaggtggcagcatgctgagattgcatcactgcactccagctaggtcaacacagtgagtccccctgtctcaaacaaaaaaacaaaaaaacctcaaaacaaccaatgatgattatttttgtcataccttcattctgttttccaagcatcccgcgatattggctttatctatcaatcatagagcaggcacttactaattcatcccacagtggttgccagaaagagttgggtctagctgaagaggagagaggtaaagctattgcacatgtgcatgctgtaggggtgggctcagtactgatagtgtgtcctcacgtgcagggtgctggcttcttcttgagcgaattctgttcccctggcctcagctggcagatactccttatcatggggtggctgtaacttgcatcaaggcctcctggagagcttttggggccgggtacctaactacaagcagaaatggactctagcattcccactgacctttcaccactctggtccttgtgcctatagtgtcttttcataaatacaacctgttattggagcgattggtggaatattggataggaaagtgctttgaacaacagtaagtgcgcatggattgtataaggtccctgggtttgatttatgggtgctgctttgaggaatgatagaaatgaggaaatttataacaattctcagatatgacaaaagacagtgagctccaaatcagccttgccttccctgtctacctctctagactctgcggggggtggtaatctggagacctccatcagttcttacagatgggaccttacagaagggaccttatatcagttcctccatcaattctgcttgcaatgagctgaatagtccccccaaaatcatgtgattcccacgacctcagaatgtgaccttttttggaaatagagttatggtggatgtaattagccaagttaagatgaggtcatgctggagtagggtgggccccatccaatatgattggcgtccttatcaaaaaagaagacactcgcggaggcatgatgtgaagacacgcagcacaaatgccctatttccacagaggcagagattcaggtgatagatctataagccaaggagtgccagcagtcaaataaatgctttatattttgcttgattttttttcacatttacagttttcatccaggttgatatttataagatgtacttttgcacaggtcttcatgtccaatttggtgttaatcttaaaccctaagactattcatagttccccaggagaaaccttcagaactcattgtacaatttaagcaataaatccagcaaatgtttagtaagacctccctctgtctgctgctggacacaacctcgtggacaatggaaataaaaagaagatgtggcttccattgggagaattacacagtggattcagggagacaagatgtaaatgccccccaaactaagatgcaaaagggcaaaatcacttgcccaagatcacacaagtaatgactcactgaactagaatttgagcctcactgtgcctggtccacagctaaggtttttactgtttcctaacgcacacagagtttgttacagtggatattaatcacatcaccaatgtaatcttgcaaaagaagacatttccattatgtagagcataggaatgagaatagtcaaatgattccgaatgccttccattctttttgagatttcaaatcaccaattagctctttcaaaattgtaataccggccgggcatagtggctcatgcctaatcccagcactctgggaggccgaggtgggtagatcacctgaggtcaagagttcaagaccagcctggccaacatggcgaaacctcatctctactaaaaatacgaaaattagccatgtgtggtggcaggcgtctgtaatcccagctactcaggaggctgaggcaggagagtcacttgaacccaggaggtggaggttgcagtgagctgagatcatgccactgcattctagcctgggcaacaagagtgaaactccatctcaaataaaaataaaaaaaaaaatggcaatacccttagcataaatggaagactagcaattctcccaccatgaacaagccaaaaagtggcttgagtaactttgcaaaacacaaatcaaattcattggccagtttgaaactatccccaatgcacaacaaggaagcaacagaagaaaattctgcagttgaaattcttctcccttattgggtcaacattattatgtttagctgatttagggaattagcttcatcataaattcaaatctggttctattttaggcatcaatgccattttatagttaggctcaactaccaaaaattctagcaatttccatcgtggtcttgaaataaacccagactccctgcagcatgactgagtttccaccatgcaaaatgaagaaataattgcctggaatttttaaaaaatcattttgcattgccaattaaaaatttactcctgcaagacaggggcttctgtaaatcagggatgtgagggatttggtctgataattccaggtgttcttcatgtatagagtgacactttgacatccgctttgattaaattcagggtatttccacagtcttgggtgacacatgctgaatattgatacacatcccaaatatctcatctgaagccctgagagccaggtgttttctggaattcagttacgcatattttaggaagataatatatgcctttactttacctcccaagacactctcagcaggtgagggcaacattcaataatcaaacacattaatatttttgcagaaaaatgtatgactattcctcccagtgggatgcaggaagaccacaagtggtataatatagtgcatttttatagtaatgcactggtaaattaaattgtgtgatgacagaccatcagtaccctgggcacttctgatttctaagtaaaacatcagagagagtcaattcagaataagttaaatacctttacacatacttgcaatatacatctgtgacctctggttgcttcggctttttgagaagaggttgcatcagggctgtcataggtctctcactgagtctgagttggccacgtgttgttggccagagaacaagaatgatcagggaacatcttctccaaggatgaaatggcaatgtgaaaaatgaccctttaaaagacttctcccattgccgtctgtcatgtgaacctggcattctctcagagcatttttgctagttgaatgaactgtcttacccactcattctcaaggccaacaatgaacagatcacacattctaaccctatcatctaggtcaggggttgcaaacattttctgtataggactgcatagtaaatattttcagccttgtggaggatacagtcagctctgcaattgtatttcaaaagtaggtgtataaaggaatgggcatggtgtatttcaataaatctttatttagaaatacaggtggtaagctgggtttggcccatggccatacttagctgacccctgttgcatggcttttttttcactgtggttcacaattccattattattattactattattctcatgcttatcagtatatggcaaacataaagttaaaatgcacatcttctcttgatggaatacaaaattccttggccataagtttatattaaatacatttcatattgaggaaaagagcagtacctaaaacatttcatttttaatgaagtctgaaggagggaggacacttcagaaactatattattttatgctttttctgttagccccgattgtctgctactggtatgcttgttattagattactcaaaaaatgtttctcaggaaattcctatttgcatgatgatgaataggtaaattgagttaacatttccatcattgtggatgttggctttttccagtcactgacaactttactttgtgtttgcctttgagtgttaacacaaccaaggactgtcaatccaagcttgcagacctccctcctgttggcttttgttaggtgttgtgaatggcacaagatcggacaacaaggtctgcacatatttgtgtctttccacgaggttggacttgtgaaaatgtttattcagtcgtaaaagccacaagagccaattctccttagtgctaagcactccttattacttcttagtacttcccattcacttggtagccagagccagggacacacaggctcaagccagtttacaacagtcaatattgcaaaccaaacatggcagtatacttaatcaatatataaatgttctagattaaacattccataacacatgttaacatgtgttgtaacatttaacatccatataaaggggataggaaaaggagttaatgaaccagtccatggagagtgacatggacaaggagagtgttctgggctgatctggatgatagcccacatcttgtaaagaagaggccttgatttgggcagagggttcagcagtgggtacatggaggagaccacgagtgttagcaagacggggtctagtgaggtggtcatgttgaactggtgaagtcctgctaatatccccctgagtcctctggtgaggggtgacagtaaagggttacaacctcatctgattgggtgcagtctgtattgattgggcgaacatctggtcctattgggaagatgccttctgaaaagcaagatgtaatcttctcctaagatggagtcacttatgtcaagagtgctcctatacattagagtttctctaggattatagcttagtagcaaggtgggctatttgatcagcaagatgaggctatttgatcagcattgtaaatatttccgggaataaactgtttctttaaaatcagatatcatcttaggtcaagtcatgggaaatagactctgaggtgctcaggagattttttgtggggagtgtattcttggggtcaacacttgcaggggagtgaggaaaggaaattgaggccaagggaggagttgagcagcacagctgttgcaacaaagacctcagctcatttcagagggagctctggagccaggaaggtccctcagaggtttcccaccttgaggcaaggagatgccatccccttggaaaaggcagttctctttgaccgaggccagtttccagagacagactttgctaagtgtgtcagccatcaaaactatcagcagcagctgggggaggaagacttgggtcttcccttgacatctaagttgctaccacagcacccacaaaggacgttctctgtgcaaattctcggcaccatactctatgtcttcctcttcaaaatacactttttcaccctggattaccatttacccttgtaaattccttcaatcaatctctagaatattcacagtggttttcagtgcttacttctacatggaatgttctggaagctttcacgagaaagtaggataaatgactcatcctagcttgcctgagactgtcccagtttgaaaactggacctcatcagtcctagacacactgggatgtggttcaccctatggcaaatcaatcagtcaaatttcaacaactaacctttccactttgtatactacagtcagtcttctttaataactacacggcctgggctatggctaaggagaaatgcattctcttcttcttctcactgttgaacataggatgcctttaactctttttgacattttcacagtcaaaattaaacccgtgccattaaacctgaagtcacaacaaagtaacacaatactaatgaacagcagaagctggtaggctgagacaagactgatgcctcaagttggttcagtctgggttttgatgctcaatacaacaaaatgggcattacaaaaatcatttggttttcagggctttttgtgtctcagaattatggacaacggatggcaaaccccaatggcattcttagatcattatcattttcagacttgtacaactggaatttcatttggagggggcatgcaaatgagaaaaatggccaagcaaatggcagttgtgaggattatagataaacagagactcaaggggataaagatgcatacttattatctttgaacacacaaatcagaatgtaggttcctcataataaaacaggcttaaccaatcttcttgctctgtgactacagtttggattatatattttatcagaagagacttattttcatataacttgtgatagtaacagaggaatcaccatagttactaggtgcgattgtttgagtcagctgggtaccattccccttcacccctaaaacctatttgcctgtgcttgtagccacacccactttaatgagcattggatgagtgatctagcacagcattcctaaaccttggcactgttgacacttgggagaagaccatgctttgttgattgagggcgggcactgggctggatagttctttgtcttgggggctgccttgtgcattgtaagatatttaccagaattcctgccctctgcctactggataccattactgtcccccaaattgcaacaaccaaacctgtttctacatatcaccttctgttcctggtggggtaaaattactcctgggtgagaacccatctcatactaatttgaaaaatgtcctcggaacgtgggcctttagattttccattgtgctgtttcattctgtaagtataggctcttcgtggcagtaccactgtgataagcattgtgacttaatcccttcagatatgttctttgtcttcatttctcactggggggttggtaagcactgagtatcaagtgtgggtcaaagagcttccatgctgataccttaaaatctattttctgtaaataaaaggtggggacaaaaaaaggaaaataatgacctttcttatctcgcaaggagagacgcccaattgttcaaacccacatccatgcaatcttagtcttgcctgatgatgtcatggtgaatgagcagaaggggagaccctgcccagtggttttgtcattcctgcagtgggaggttaaggatcaatgttgacagcacactattccatttcaacaagaatctaacatgaaaagccatgctggaagattgattacagtttcaaatgccatctctggggggaaaaaataacatttctgagattctgattgaacctcagaaattgttgctagaagcctaactttaataaagcaaaatccacatttataaaaatctatatggaatggtaatttttctctgatgtgatattctcttgtgaatatttttttttaccaagtgggattatgcttcatatttcaaagcataaacaatagatttatatattaataaatagttcaagacatatactagatttttggtctaaatgtcaacaagttaaaagaaaagtcttcaataggttcaaagctatcttcttggctttcttttgagacccattttctattcatttctaggactttgtatcagaggtcaaaaaactgtttctgtaaagggttagatagtaaataaatatttccagctttgagggacaaatagtatctatcacaactactcaactctgatattgtagcacaaaagcattaagggagtggaggcagctgtgttctgatacactttgtattacagacaccgaaatttgagtcttacgtacttttcacatatcccaaaataatatccttttttcaaccatttaaacatgtaaacattctatgaaaacaggtgtcaggacagatttttcttgtgggccattgtttgtgcaaacccagccctattcagaaaacatctattgagtgtttgctgtggtgaacaaatgagatgtggtctctgccttcttgatccttagagctgtggaaaggacagctgtcacatgaataaatcaggaaataaatgaatctattatacaagtagtaataattgctatctgggggaaaagaggtgctataatagtcaacagtgggggagcctgcttcatacagggtaatgaaggagggcttccttgtggcagtggtgtaagccaagaggtgaggatgggtaggagttaggcagagagtgggaagaagaaaagtggggagagaaatcctctagaccagcagtccccaacctttttggcatgagggaccatttttgtggaagacagtttttgcatggacagggagggggatggttttgggatgattcaagtgtgtcacatttattgtgtactttatttctattattattacattgtaatatataatgaagtaattatacaactcaccataatgtggaatcattgggagccctgagcttgttctcctgcaactagatggtcccatctggaggtgatgggagacagtgacagatcatcaggcattagattctcatgaggagtgtgcaacctagatctctcgcatttgcagttcacaataggttttgtgctcctatcagaatctaatgccatggctgatctgacaggaggtggcgctcaggcagtaatgtgagtgatggagaatggctgtaaatacagatgaagcttggctcacctgttgtttacttcctgctgtgcagtgtgattcctaagaggcctaggggttgggaacccctgctgcagtaaagaaagagcttaagaggctgggcacagtggctcacacctataatcccaacactttgtcaggctgaggctctgtttagcccaggagtttaagaccagcctggacaacatagtgggaacctgtctctaccaaaattacaaaaattagccagctgtggtggtacacctgtagtcccagctacttgggaggctgaggtgggaggattacttgagcctgggaggtcaaggctgcagtgagccatgatcatgctgctgtctgggcaataaagtgagaccctctctcaaaaaaaaaaatactaataataaataaataaataaaagagcacatgtcatttaagtatgtcaatatatgattacccagcgtgtgattattcatcttttgaatgaattcacaggaagagcccgatgcccttggtttgactctactaagagcccctcagttgctgaacctgcacacagtcatctcagtaagttaagatcttcctgaggacaatggcgcaagatcgtcttcagctgttcatagcgtaagtatgagaggtgcatatgtttgtatcttcgccctgaaactcaagtgtttgactcacccagaccatgttgtctaagtcaaatagtggtatgcagtgatcttgataatggtattgaggacattctgttattgcagggatgacatacacatggtgctattgcagctatctttcattcagaaagaactttccatcaaaaggtcaaaggggagcatctgtggggcaaatatatttttatagagaaagactgtcctgggccaatgggggcagcgtgcataatctgatgagcataagcaagtggcctattatgtggcaagtctagaggaatataggtatgggggcttacaaatgatttaatgcatcctctggacccttgaggtggctctactctagttgaatcagcaaaggtacagaaacatggcacagtgggaaggctcacagtacacctgttctcagctgatcagctgcagcaatacctgagggacagaatggggtccctcctctcaggaagagctcctccgcctggtggaggtgagggctgaggtcatacccaggtctctccctgcaggaagagctcctttccctggtggagttgaaggttgagggtatatccaggtccctccctgcaggaagagctcttccccctggtggaggtggggtctgagggcataaccaggtctctccccgcaggaagtgctttttcccctggtggagttgaaggttgagggcatacccaggttcatccctgcaggaggagctctttcccctgatggaggtgagggcatacccaggtccctccctgcaggaagagctcctccccctggtggaagtgagggctgaggggcagagcatggtccctgcctgcaggaagagctcttttcgctgatgggaggtgagtgtgcatggtgcaagtctttagggtggatgagggaaacatagttttaaaagcccctgcagggaagaatccctgttattttacacctgttcttggacatgtctggaccactatggcactatgctatcagaacaccagggggcacaatatttggccattcagagcatttatggtcccccatagcagctggctcaaagaaatgggcaggaagatacttttggaggagatatttggttcaaataagtgtgaagagactcccaaagtcagagaccctggggctggggattccatcccaccccatgctggcagtgtgttcccaggagaacgtttcacctcttcctgccttagtttcctcctttgtaaaaagcgacttaaagatgctgggcccggtggctcaggcctgtaatcgcggcactttgggaggccgaggcgggcagatcgcctgaggtcaggagtttgggaccagcctggccaacatggtaaaaccccatttctactaaaaatacaaagattagcccggcattgtgccatgcacctgtagtaccagctacttgggaggctgaggcaggataatcgcttgaaccccgggggcagaggttgcagtgagctgagattgtgccactgcactccagcctgggctacagagcaagactccatctcaaaaaaaaaaaaaaatagatgaacggcagtttcatagggtgcttatgaaacgtaaaagatgacctctgttttgggaaaaatgtggtgaagacctggatgatcctgccagccagggagatgggagctgaaagcgggcttgcagggtgatttaatgattttcagaaggcagcttcgggggttacggatggtagtagttatgtgtcagggtagactttgcccttcagagagaatttggtaaagtttggagacatttttggtcgtcagaactttggagtggggtgcatgtagtgggtggaggccaggcgtgccgctaaccatcccacggtgcacccacagttcctcacaaatccgaaatgtcgtgctgagggcgacaaaccctgctcactgcaacaagaggctttaacttaatcttctctttcttcctagaatagtcaatggtcttttactttgagggatatgagtcagaataagaattaaagagaacaaaaggacaatgaccttttaggatttttctttctattaaatttaaaccccataacagaggattctccgtctgaaagcaacatccgtggaggcttaaagcctcagcttatattcattcctaacacttagcagcttaacagattcattttccattgtgatttctgtaatttgttctttaaaaggattgtgtgttcctttttctgtttcagaaacaaactttttgggcattttcaagaataatttattttctaaagttattgataatacacgggctggcatgaatttctgacctcgctttcaaagtctttagcaccagctaagtagggttttttgttgttgttgttgttgttgtttatttaatttctttggaaactgtacattttgcagggaaatgctttaagtaccttttttttttttcggtcattttagtctacgggagagattgacattccctagatccagctagaagggctctgaaaaaaatgacagatgcagtagctaattaaaaatatgcagctgaaagggttcatgattaattcatgataaacgaatacagcattcattatcctttcctaatgttctcagataaagtgggagtgttgcagtgggggttaaaatatttgttctaaatatctagtaacagtgtccattctatcttactagcataaagccatcctcatagaggtattttaatgtgcttcacaattcagaattcagggttcttacatacagagtattaaactctctccctcccataaatggatgaagactttggggattgtcaggagaacacttatattgtctgtagttttcctgatttgttctcctccaaggaaaaggtttagtaataggaaaatattattattattttttttgagacagactctcactctgtcgtccaggctggaagtgcagtggcacaatctcagctcactgcaacctccacctcccgggtccaagtgattcttctgcctcagcctcctgagtagctgggactacaggcaagcgccaccacgcccggctaatttttgtatttttagtggagatggggtttcaccatattggccaggctggtctcgaactcctgacctcgtgtggaggctgggatttttaaggacagtttggcgggcaagaggctagagaatgggaaaggctgattggcaccatcagcaaagaaatcacagagttatcaaaactgtcgttgtgtgccgagtcagttcctgcatgggggtcactggtccagtgacgtcacttgttccaccagaatgcaaaatctgaaaaatattttacataccagtcttaggttttacaatagtgatgttatctataggggcaatcagggaagttgcacatcttgtgaccaccagctacatgactcctgagcagtaagcaggttacgaagcaatggctagttatcatgcaactatgtataggtcttagcagaatgcaggtccctcccacaagtctaaccttggggccgttcattagttttacaaaggtggttttggtccccgaacaaggaggggtagttttgggaagggactgttgtcatccttgctttaatgttaaactgtaaactaaaatcctcccgtagttgacctggcctacccagaaatgaacaagggaagttagcttgtgacattagaagcaagatggaaccagttatgttagatttctctcactgttacaatttttgcataggcgtttttcaaattcctattgctttgttacgtgatacagtcacgcatcgctggatgacagggatacgttctgagaaatgctctgatgggtgatttagtcaccgcgtgaacataatagagtatactcacacaaacctactatacacgcagactgtatggtatggcctattgctcctacactaaaaacctggacagcaagtgaccgtactgaatactgcaggcggttgtaacacaatggtaattatttgtgtatctaaacatgtctaaacatagaaggtactgtaaaaaatatggaattataatcttataggactaccattgtatatatgattcatcgttacccgaaacatcgttatgtagtacatgactatatttataaaataagtgtggaggccgcaatgtttcttttccatgttgcttctttatgtagtattcagcacgtgggagatttttgtcaagaagtgcatttagaacttgtctttggtaatacctgtaccaccctccaaacttctcaacttctactcttttacccaagacagggttcacgtgacaacataatgactactgaatacaatctctagagttgtctcaggatttatagacatagtagtggatttcacacttcccattctgtgtttgtctctgcatggtttgcagaatcaggattaacacaggtgttgtggctctgtggacctgtgaattagtgcaagagcgacaaagcctgtcttgctttttctcggcaagcacaccctggcttcagaattgagaataactttgttctatgttttaaaacatagtgtatagaagtgcctaaggaagaaaacattgcatttataagaagacgtcttacaaacactccagccaaacacttaatttgctatctttacatccactctagtgaaagcacttagaatgtttgactttatgttcagtgcttggcaaactgctcctgttggaaccctcagggttcctcaggctgctcctgggagcttcttcagccctgcggtgggaattgtcagagatttaattccacccacttctgtaagaacagcactgattttcatctctattagacattcttatggatagaagtttctgtgactaaaaacaatgacaaccattactttctctacctgttctgttttataacagaaggcaacactgaagctgaaagatattaagctgtttatgtaaagactagataaggtctgtggataccctctcctgcatcttagccgtgatttctttagctgaattattgcatagggaaggaaaaagtaatttttcctctaccctgtctgagttcttatctaggacagacccttgtaacaaaaggcagataaacaagagaaaacaaatagtttattaacatggatacctcctgtgtatctgggcaatatccaaggaatattgagtaaatctcaaagaagtgaaagagagaaaggtgtgggaagggacagttatggagaagtaaccaggaaaagtatggtaaaccagggtaaggttggctgtgcacatttcagttggtgccttctccaaccttaagagtgtttaatcattcagccttccttctcttccagtaccatgaaggagaaacccttacaaatggagatttcctttacagatgtaaatctctcttagaaaacagtaacttctactctgttttaagagcttctcctgtgtctgcaattactcaaaataattcttacgccaaagaagcacattgtggggtgacgtattcttgtcctttcttactgtactgatgtaaaaaaaaaaagtgatatatgcatatgtgtgtatacacctctctctccactgtcttctacactttctagccatgggatccacaccaccaccactacaactatcagtgaccaccacaacaaagagatggacggattttagtggaataaattattttcagactcaaagatctttaatgcaaacaatctgagctgtctttcatttgtttcttagctgtctcttcacgtgtacctgtctctctatctgtattttggacaccttgggctgagtcatcttcatgtcttaggtatgcaactctctggtctcctggtagtctgcctgtatccatcaaggtctccctctcaccaccagcagccagaggcaccttctcaaaacccaggcctaaccctgccactggccctgttggaatccttcaatggcttcccgttggaaggaaggtggaatttcagaaccaggcctggatgggtctccattgtctgcctcctacctttcttcctactctcaggtcctccctgcatctgcctccccctggctttcttttaccccatcaggcaacttgtcttaaaacctgtcctactacccaggctgtcttcccctcagggccatctccccagccaactcctccttccagtaggcttccttcctctctttggctaagtaatgaccactccgtgctccaggcactcttgttgcatttgcagtttcatactatttcttgtgtgattatttgtccaatattgattatttgaataagatctgactttgcaaacacattgcaaagttctatgaaggcaagaccatgcagtgcatcctactgttacaggaaaggggtcccgagccagaccccaagacagggttcctggatcttgtgcaagaaggaattcagggggagtccacagtacaaagtttattaagaaagtaaagtggtgaaagtacagctactccatagacagagtagggcgttcccgaagctaagaggaggaatgtgtccactctaggtacagtacttgtttacatataggataaaaaaagatcatggggtgatgtgctctgctacaagtgtttgtgataaaggattaattttcttaattgctatattttacaagaatcgatattattatatttaaagcaaaattaggaatgcctctgttctcaagatatcagggtgttaggacactcccagttctgggtctgtttactaaacattatcaatctgttcccttaaccgtaaacatctagaggctaggaacacctaactttctgggagtgcagcccagcaagttccagcctcattttcctagccctcactcaagattgagtcgctctggttcaaacccctctaacactactgtatccctacgatgcacagcgtgccttagtagatgtttagtaaataactgctaaatacatggatgaaaaaaatagttccaatgccatattaatacaatactgataaaaattatatatttttggatttcagtcacacaggcaaaaaacaactttctgatatgatttagccaataactgacaccaatataaaaaatgatctgtaacccccccaatggattatctttgcccaggtagagcttgtttatcaagacagaaatagagaaagaattgaatgcacacagagccagttaaatgggagaccagagttttattacccaaatcacgctctctgtgcatttggagactgagttttttttaagggaggtagggggttaggaagtgaggaatgctgattggtcagattggagatgaaataataggggcccaaagtgggttcttcttgctgtcttctgtgcctgggtgagattgcagaactgattgaggcagattcctggtctgcatggcaccagttggtagatcagatcacagggtctaaaaaacatcttcaactccaatcttaggcattccaatagtgacggtatccctaggaccaactggggaggttgagaatcttgtggcctctgactgcaggacttctgagccatactttctaaacttgtggcgaatttgttgtcctacagaggtggtgtgtccccaggcaaaaatgggatttttttccggaaaaggctgttaccatttttgtttccatgttaacactgtaaattcctcctgtagttagctcagtctgtgttcaggaatgaacgagggcagtctgcaggttaaaggcaagatgtagttggttaggtcacatctctttcactgtcgtaattttctcactgcttttgcaaaggcagtttcagatctttaaccctgtctggggtttcacaaactttagccttgttctgttgagtttatatcctcaaatagggtgaagcctaatacctgttaaaagattttatccagtgaacctacccaagattccagaggaaagcaaaaacgtctgctgcctggcagcaagtttttttttttttctttatagagttttaaactaaggtccatgaatttcctgccatattttcctgtgtgtgcttcagctgccttactgacaatcacttaataagtatagcagttccttagtttatactgcatgtgagatagctggcttatgagaataatttttctatataaaattcatatttaatcctccattttaggagtgagttctatagaaagttctatggaaattctctattttaggagcgagcctgcaatacagttttcaaatacaatattatgatatttgaagtcaatcaggaagtgatccatctatactacaacttctcatcatgtttcaatataaaatgttggaagagtaatgaagtgtccaaaattagattgattttataatttagggtcacagccttctaattttacaataataatcagttgacaaagaatggttagtataatacttgtgttaatcgatcctactttctatctctattttattaaaatcaactctgaatgttatagcatagtagaaatttaccacttattataataaatcgtgttttcacagtttcctcttctcttaacttaaaacttaggttcttgcttagacttctaaatttttatgactgttttagtttctgggagtccttagggtttttgcagtttctttccagagcctgaggggctttgctgtatgtttgtgtgatatttcacacctgatgaatggagagccagttgatattagtcatctgtcaactttatttatttcaagattccagtattcagagtgggggttgattaagtacatagccaatataatatacatttacaataatgaatcagatgtcatttccttgcttagttacttatgttctttgctttttaaaataaggcccagaccagttattctgagatccaaactttgactcttatataaatttaaggacatttttctttgctagaaataaaaaaaaaaataaattacctaataaaacccttagctttggagacattaccatacaaatgtaaaagataagtatgtgaagcacatttaataacactgaacctaataatgataactcaaactcattttgatttcctacctacaaaccacacatttgaagtattagaaaactttgtgagctttcttttttttttttttaataatactgttgtgtactttatttcaaatattatcctaggtcctcttgtatgagaatatctagaatcagtttagtctttaattcctagttttcttcttagtcctttgaaaatattatttaagtaatattttttgttttttactgctaactccccaaatttgttataaggaatatttttgttattttcttctttcatcgcatgggggaagattcaataactatgatgtaattcctttaagaaaatttttgtcagacatgtcggaaattttgaaatcccgtatattaactctagactctcaaatttcaaatcatattatgacgtctctgatggaaaaacatgcttcagctttctctgcctctgacatgtaattgataacctcatgttctcattttgggagatagaactagtgaaatgggaccaagcaaatgctaaaaacaataaaatgagctctcttgctgtctttggatgtttcttggaccaagcatgaaaaagatggatgaaacggaaagggaggaggggagatgatttttcgtttgtgtgttcagtgacgggaaggagatgccaaggacaaaaatggatgccccagtgccacagtgaacatatttccttagctctgagtttggtagtgggggcttctgtggattcacaccaagaaccgcagtccaagcatattttgtagtctcatctgacacatttctctaaagcttagcccttcttaaactctcatgtttcaaccactttgccccctttcccctgttcacctgcaagccacacatgaccctcagcacatatgacaagagctgtctttccacatgcagtttgctttgccacccacagtttaaatgaagctatatataaaaccataaactggttagatgggtggatggatggatggatggatggatggatggatgatagacagatacgtagataaatgatagatcgatggatgatagataggcaggcagctatatagatagatgatggatgcatggataggtagatggatggataaatagatggctacatggatgatagacagatatatagatagatgatggatgataggcagacagatatgtagatagatgatagataggtggatggatggacagataaatagatggatatatagatatatagatatctagattgatatataggttgatgtcagatagatggatggatagatagatagcagtttccatttctgtacttttatggttttcatgttgagaatgttctcaaagggacatgtttgtggttaaattttctgaatcaacaacaaatatcactccttcaagattgctctctcagcataaaaacctaaaccaattttgtgtttttatagcctctcttttctcacacacatacttaactttttaatttttttttggccagagttgtggctttatgaatcattattagaatcattattattatagagaagggtcagcaggccctccacctagtgaatgaaatttcatttccatcctgtctcctttctgcttgtgctgtgggaggtatgttctttcatcacatccatttcactcttcaaaggcattcttctcaacagtaatccactcgcaagttgttattgcttcatggtttgtgtagatgtgggagatccgctgtgctttagggaactgcgccagagatttcatgcgtttgtctttgaacactgatctagagactttcagctatttgggcttcagggatacaagaacagagaagcctttagagagtccagatctgagccctcctcagaagaaggaattgtctatgtttgttgctaggatggacccctgacaacatggccacctgttctgttttctaatccacgatgctcataatggttaattttaggtgtcagcttgactggattaaggaatacctagagagctgctgaagcattacttttggatgtgtctgtgagtgtgtttccagaggagactggtgtggccagctacagaaatgaggactgtcattgtcacgagtattttctccccattttgttaagaatacatctgtgtgtatatataaatatatttagtatcaagataaaacataaatacatgtatttagcaaatatctttgttttcattcctctcttattcctttattatataacataaggtatattgactttatatcagtatatgatatgatggtttgtgttttcctgttgagagcgttcttggagtatctttgttattgactcagaaattttgaccacaaacatgtttgtttgagaacattctcaacatggaaaccacaaaaatgcatataatatataaaccactctattgactacctctctatcagtatttaagtattattaattttacctcatggtatttaagtgatgggatgtcaggagaagagtcaacatcacccaaggacttgacctcctcttccggggaaggggattactgcattttcagctgtgtgcagaatggttacatcacgttaggtggaactgttgtaattttcttatcttcatttagaaattaagtatggtttaaggagatgcttatgggtgccaagttgatgatgggtggatttgtgatggttgattttaggtgtcaaattgactggattaagggatacttagagaactggtaacatgttcattacttctgggtgtgtctgtgagggtgtttccagagggcattggcatgggagttggtggactaagtgaggaagatccaccatcaatgtggactggcaacatccaatcagctgggggcccagatagaacacaaagcagagaaaagagttccctctctctctttatctctctgtctctctccctctctatctctatctctgtgtgtctctctgtgtctatctctctctatccatctctgtctctcgctctctatccacgtccctgtctctctgtgtctctctccctctcttcatctctctctttctttccctggttttgtctctgtctctccctccttgcctgtgtctctgtttctccctgtccctctctttctctctcttcaagctgagacactcttcatctctagccctagaatattagagctccaggctctcccacccttggactccgggatctatgctacccacgccacaagttcttaggcctttggcctcaggctgagaattactatacttagaacattcttccatggggcaaaaaactctaaagattagaaatctgtattagttcatttctctgcaacaggtatttattagacacttaccatgtgcttaaaaaataggaactaaacaaatttctctaaaaaaaggaaccttgttagttttttctgattatgtgacaagggacagctgcacagggatcagagctcattaagctgaagttctctaaattagggtctctttaggccaattgtaagcccaagttcattttctttttattcccactagtaaaaactatcacatttgaggagcattgtgaatttatgacactttctccatcagtaggaatacactatgattaaattgtactttgtaaactgtttttttctgtttataaaagtaagtagaacattttatatatacaagaatttataaagaatcatataaaaccactggtagttctgctccctgcaaactaatcccaaataaaattatatcatcattctttccagttatgtgtatgcctttctatacaaacatatgcatatgaaacatacatatccatatgcaaatatatatatatatagagagagagagagacagggtcctgctctgctgcccagggtggaatacgatggcacagtcatagctcattgtagcctcaaacttctgggctcaagcaattctcctgtctcagcttcccaagtaggtgggactacaggcgtgttctaccacgcccagataatttttaacttttttgtagagatggggtcttgccatcttgcgcaggctgctctcaaacttccgtcctcaagtgatcctcccacacttggcctcccaaagtgctgggattacaggcatgagccactgcacctggacagattgtttttcacatttgtgctgatgttgcctttatatcatgtttggttctgccttttacaccctaaaattataccataaggttttatatatgaaaaaatattcttcaaaaatcgagaatattctagtgtttaatttattttttcttcaagtctcctacttcttaattttctaacccaagtgttggcatgccataatatttgccaaatcagtaggttaaaaatagcattttccttgtgtttaaactttaattttctttgatttcctggtgaggttgaacattttccatatttgtattaatttacaattgttttctcattcatcatttgtcttttgccattttaaaaaatattagatgttgattattttctctgttgattccccttctttccttcctccctcccttccttcctccctccctcctttcctcccttcctccctccctccctccctcctttcctcccttccttcccttccttttcttcctttccttcctttcctcctttctctccatcttctttcttccttcccttccttcttccctccctctcttccttttttctctctcctgccttcctccttccttttttcctcctcaccttttctctctctccttctttcattccttcatttttccttccttccttcccttctttcttcctttcttccctctctctccctcctttctccctctttcctcctaacttcctctctccctgccttcctttctttccatcccttcttccctcctcccctccttccttcctctttgcttgcctccctttttttccttcctttcccttattcctccctccttcgctctctctcttgctccctaatcagttacttatgatatccttctccactctgagaccatggatagtcatgattgttttgctgacctgctttgtggccccacatggccctaggccaggtgcttctgttgcctgttgttgtacacacactggtgggcttgggcatgtgtggtacccagactccatggacaacggaagaagaaatataagatttggagttgttagtaaaatagacttttgggcaattgcacaatcatccatgctagcacaggaaagctcttagcaggtgtttctccttccagtttactttgaaagaagaggggctttccctgcctacacaccaacatcctggtttcatagtgaggaagagaaagaatgggaatgtaattattgcaattattattcatcacgttttgttgttccccccaagctaaaagtgacaactctatgctgtggttctttggggatattacatgtgagagtgcaaccacagaaaatcacatcaattaggcatgaaggctttctccccatactgactagcagcttgcttgggagcagagaccttcagcttgaggagcaaatagtgggcactcagtgtattcactgactttattcaggggccaatgcaactgtgtctggaggggttggctggtataaaactgtaggttggaaattatttggttttctttttctttttctttttcttttcttttctttcgttttcttttcttttcttttttctttttttttttttttgagacagtttcttgctctgttgcaagagcaaggcactcctggctggagtgcagtgatgcgatcatagcaatctcttcctcctgggctcaagtggtcctctcacacaccaccaccatacctggctaattaaaaaacaaattgtagagacaaggtctcgctatattgcccagtctggtctggagctcccaggctcaagcaatcttcctgcctcagcctcacaacatgctgggattacaggtgtgagccaccactctcggtggaaatcatttttcctctggatttcacagtcattgcataattgtcttgtaccactcagggtaaaggccaaagccgtgatttgattgtatgtaacccatccacccactgcaccccctatgcacttaggattttgtcttggtcctctgtatcctaaggttccatgaaaatgggctttgctctgggtttatattccttcatcgttttgggcccccaggcctgttcaatactgagattcatgcccttcagttctaaaactatattttgttttattgctttggtaatctcttgctctctctcagtctcttcctctggaatatctattagctgaagattgggacctggttatgatatcctaattttcatgtcttttctctcctgttatcaatcaccttggctttttgttccagttctctttgagatgtcctcaccttgatcttcgcagcattctgctgaattacttcatttatcatgttccgcatgcccaaaagttctattttgttctctaaatgtacttttctcataccatccttttattatttatttacttattgatcaatcttttcttttctttttttggttctttgatcgctgtccatatatgaccagccatatgacattgctgatagttaaccatactttatctgcaaaaatggctatttcaaatgattcatcctatttgataaagagatgttatctcacttatcaataatgaaaacccttctttttcattccaaaccaacatagagctgtgtgatccaagggccttaaataagaggcatgcaggtatctgtatgcataaaatttaaatcttaatttaaggaagtactaacctgaaagctatgctgaaggatttttgttgtgaatttgattattattagatacatcatctcgatccaatggtcatcagagggaaaaaacagttacttagttttggtttggcagacacaattgatattctttttctgtactccattttaatagcttaaagttttcattaaaaattacaccttgggcttggggggcaatggctcatgcctacaattccagcactttgggaggccaaggagggtggattgcttgagcccatgagttggagaccagcctagggaacatggtgaaactccatctctactaaaaataaaaaagtcacttgtcatctcaattactcaggaggctgaggtgggaggatccctcaagcctgggaggagggggttccagtgagctgagattgtaccactgcacttcagcctgggcaactgagtggcaccctgtctttaaaaaaaaaaattacacttattctctcatgcaaaggaaacacattttaaagagttgctgattgatttttctgcattgcccaggagttgcatttttattcaagaagtaacaactagcaccctgtcctcaaatctcttttgcattgccgacatgaatttgttggcattgtcttcaagcatttccaggatatgtgcaagttacagggatttagattgtacctggaagtacaggattggagaatggtggttaagctttaacaattcagtcaagaaattctttgttatgaacacttttaggcagggaggaagtttagagttttccatattgattggatttatacatattaatttttttctaaatgatgtcataaaagggtcttttaggtaatgatgaaataaccaagtcccagtaggaaggtttcaccatatagtacaatgtaatgatagggaaattcagagttcaaagtattttaatgtcataaaccaattttgagctttaatggaagaaggatcattatgcacaaatgaaattgcatatatattttgttatgtttttgtaaaatcattcataattataaactggtcaggaacttcacaagtaactgaagaattatactataacttgacagaaagaatcggctattcgatagcaggctcaggggtacacatacctttttaatatcatgacttgtccacaaattgatgtgtgaaacaattttccctgttgtactctgctttaggagatgagatgattgtagggggcaaaagaatggtttcccagcctcctggtttgcaggacagcagaaaaaacagccattcagttggatgttattggaatcaacaacaaagagactgaaatgctcatttatctattacggtaaaatccaacatttgcttcacatacggtgatacaaagcaatagcatttgccgtggtatttgaaatacagtaaaaatatgagttaacaaaacttgggcattaagctatttctctccaagagataatgagtgtttcttattcttcaaccctttatactttattttttaaaagtgtctttgtttttaaagaaaagagatatgcttattgtaaaaaaatccaaaaatcagaaaagcatagaaaagaagcatatgatagtctatactcaccatggaaacagtttacagatataattccagaattttctatgtgtaatatatagaaatggcaggttactattcattccactttataattttctttaaatattttgtgttgatataattatagactcacaagtagttatgaaaaaatggtacagaggagtctctcctaccctttaccctgtcttctccagtgataacaaaaactgctgtttttcagcagatcttttttcttgtatttctagacttggaaactcctcagtagattcaaataatttctgtctccacctcccttcttcctctctccctttcttctttctttcctaccttccttcctccttccttatatttttcctttcctttctgtaatttccaaacactgctataacacgttatagtgaactgagtgggttaaaactatgtaaaacaatataaccttacagttcgggaagtcttaagcacaaagtgggtttcactgtcctaaaatcatggtgtgggcagggctgctttcttttctggaggctctaggggttgaattcctcttcttgccttctctggcttctagagggcacctaccttccgggctgctgggcccttcctccatcttcaaggctggcagcatagtgtcttccagtctctccccacctccttcttagaggggcctttgtgatgacagtgggcccacctggctaatccaggaagttcttcccatctcaagatccttcatggcacttgccaagtgccctttgccatgtaaggtaaagtgtgaggtgccagggatcaggctgtgggcgcctcgggcctgaccattacttagcccacaacacgtccctttcttctttctgttttgggactggaccatccagccaatagattctgggccttttttacatgtaggggtggtgccagatcttccatagcaggtaacattaagttgtagttcaatcaatatttgtagatggaattaaaaactgaattgcaatacaaagattaataccacagattttaaaaaatatttattttcatattatgtattttatatataattttatatataaatgcatatatatgtatttatagaaatatatatttttatacttactattatatagtataaatgttttattttaaataaatatttatttaaatattaatatatttagttaaaatatatgattaaaaatgaaaaaaattatttttaatataatttaaaaatgaattcgaatagatgaataccacagatttaaaaaaatatttattttcatattatttattttatatattttatttttatttttatttttatttttatttttaaatttttttcttttgtattccttctaaaaaaaactgggatacatgtgcagaacgtgcaggttagttacataggatacatgtgccatggtggtttgctgcacctattgacccatcctctaagtttcttcccgtcacccccacccccaaataggccctggtgtgtgttgttcccctctctgtgtccatgtgttctcaatgttcaactcccacttatgagtgagaacatgcggtgtttggttttctgttcctgtgttagtttgctgaggatgacggcttccagcttcacctgtgtccctgcaaaggacatgatcttattcctttttatggctgtgtagtattccatgatgtatatgtaccacttttctttatccagtctatcattgatgggcatttgggttggttccatgtctttgttattgtaaatagtgttgcagtaaacatacatgtgcatgtgtctttatagtagagtgatttatattcctttgggtatatacccagtaatgggattactgggtcaaatcgcatttctggttctagatccttgaggaatcaccacactgttttccacaatggttgaactaatttacgttcccaccaacagtgtaaaagtgttcctatttccccacagcctcaccagcatctgttgtttcctgactttttaacaatcgccattccgactggtgtgagatggtatctcattgtggttttgatttgcatttttctgatgatcagagaatatgcatttacttatatatatctatacacacacacgtattcatagaaatataaaatatttatatatttatacaattatacaatataaatgttttattttaaataaatttttaaatattaaatatatatttataaaaaatagatgtatgtataataaataataaacacttaatacatattaaatatataaattgatgtatttatatttatacataaatgaataaatatttttatattaaatgtataattataaataaatcaatgtatatataaatgtatatttaatatatactaggtgttatatgttgaaatatatattaaatctataaataatattccttttaatactttataatattttaataataactttttaggtaaaatatgcaaataaatttctaaaccaaatatcccagcctgagatctctagctttggatagaaaagcatttactttttagcaaaattaatttttttaagtgaaaaattaaaattatgtatatttagggtatacaacatgacattttgttttttatatatatatgtatgtatgtacattatggaatggctaaatgaagctacttagcatgtgcattacctgacatactttgtggggagaacacttataatctactgttttgtaattttcaaatatccaatgtgttgttattcactacacatgaatgttgtagtcaccatgttgtaggaaagatctctggaactcttgctcctaagtgaaactttgtatccttagaccaacatctccccaatgaaaaacacttactttaatattcactccactgtattcattttctattgctccatagcacacagtggctggcaacaacacctgtgtatcttctctttgggctcaggagtccaagcaaggacagactttaccctgctcaggggatcgccaggatgaaatcagggtgccagctacgttgtgttctcccctgagcctcccggtgctattccaaattcagtgcatgttggtagaactcagttccttgaggttctgggactgaggtccccattttcttactgctggaagtcctgggccactagtaatttctaggtctgtggaccccacaggaagttcacatcatcaccgtcagcttctttgtgggcaccagttggtgtccagcatctctgtccgacttctggccatcttagaattctgcctactactcccacgaatttttctgggttggcttggccttgccccttgtagaaagttgctctgcagggaaaccactctctttgtttttccaaccagtatttctcatgttccacaatgtgagtatatctgtgagatgctccagtttcctgggacacctatcattttgctaagatttccaacaggcatcaaagtctctactggtgggctttgaggagaaggctgacctgttcttatgccccagaggcactgcctatctttctttattttttaatctcagggccagagtcatccctgccctgcccaaaatgggaataggacatctcttcatagagatcagagctacatataaaagccaaactgggactgaatctaaacatctgcatttccttcctcctccccttcctttcgggacttcctgctgcagatcgcgggagcagatacgtgtcaatgtattccttccctttgcagcctgtccatttgggccagtcagaatcattcagcaatgcataagagaagaaatataatatgcgctgatatccaggtgtatgcaagtgataatatggctaatggaagatgtgaattgagaaggggatgtggttattaatgattacttatgaaagaattctgggccaagcacagtggctgatgcctgtaatcccagcactttgggaggctgaggtgggaggatggcttgagctcagaagtttgagaccagccatgggtaacatggtgaaaccccatctctactaaaaaatacaaaaattagccgggcatcgtggcacgcacctgtaatccccagctactctggagactgaggcacaagaattgcttgaatccgggaggcagaggttgcagttagctgagattttgccactgcactccagcctgggagacacagtgagactccatctcaaaaaagaaaaaagagaaaaaagaaaaaagaattctgtctcaagatactagggacgctaaaagtttgctgtttataaaggggattttatacaatgcgtacctttgactttgtgccttcttgccccaggagttactccttttaaatagatagctcatctacagatcctgcagataatccttctggtataaccagaatacgtagttatttatacatatatgtcccataattttttcctttcaaggtaattgatgaattatactaaacaaacaattttctggctgacaagtactgtactttagtgaatttgcttgattaaattgtaataatgaaattaaattttatgcttgctgtgtgtctacaaatgcagttcctgttgaaaatgagacaatctgaagtgccttctaatggacatcccacttccttaatgtttcttttgtatgtgtaagggagaaagtctaatgtctgttctttccctcatagattcttagttgagacactctcctgaaaataaaagtcagattcacaaaagaaaaactgttgagcccagactggtctcaaactagcctcaagcgatcctccttccctgacctcccaaagtaccatgattacaggtgtgagccaccaccgccagcctagattaacagtctttaaagtagatatgctgggataggtgagaggaagtgaaaagccaactgggacacacaaaaacagccaggagcagcctaggaggatgacatatattctacccatcacacaggagaggcctcagttcaaaaatacttctctctcaaggcagtggcttaggggccttgctcaaataggattttaacaaagagccataaatcctatgtactgacaagacacagaggagaacatctgcaggctaccaaaaggtaaatttctggaaagagtaaaatctgcctctagctgctgtagtgctgtctctgagctaataggcgagagttgtaaaggggaccatctttcggtgggaaaggcaggcaggagggcaggaaggtggcaaaggcagacaggtggacagaagaccttgtctttgtaaattgctgtcttgctatgaggaaggcagatggaggggcagtgtgtccactgcgttttaggattcttcttttcaatcaataatcctcattattttaaaaagggatattttggtttccttcgtgtgtaaaaactgtatccatctccaagctcaggaaaggaacaatttacagtcaccctcccaggctgctcctgactgtttttgtgtgtcccagttggcttttcacttcctctcacctatcccagcatatctactttaaagactgttaatctaggctggcggtggtggctcacacctgtaatcatggtactttgggaggtcagggaaggaggatcacttgaggctagtttgagaccagtctgggcaacatactaagaccctgtctctagaaaaaaaatattaaaaagttagccaggcatggtggtacctgcgtgtagtcccagctactcaggaggctgaggcgggaggattgcttgagtctgggatgggaggttgaggctgcagtgagctatgatctcaccactgtaccccagcctgggccacagagcaagaccctgtctgaaaacataaaaatataaaagattgtattaattgtcatcatcatttatataaaatgcaaagcatgcctgatacatggtaggaagacaataaacactatttacatgtttttcccccttgaacatgttccctttttctgctgagtcacattattttttgactgattgcggaggggggcccccaatgcaaaattagtaactctggcagctttctctatgtcttccttttcctaacttttccataaaaccattcctccaaagccttcacatggtcacagtggccttattgtctctgattaatcacagttgaaactggctatctagaaagaatgactagctgtcttaatactctaatggaaatctgagtcagtacactactcctgttttttaaaatgtcttctcttcccttgtggaatgaaaggaatttacacattacacataatgagaacaaggtatttttatttatgcttttatttcaataggtttttgggaaacaggtggtgtttggttacatgagtcagttctctggtggtgatttgtgagattttggtgcacccatcacacccgagcagtatacactgaaccctatttgtagtcttatcactcacccccttctcaccctttccccctgagtccccaaagtccattgcatcattcttatgcctttgcatcctcatagcttagctcccacttatgagtgagaacatacaatgtttgattttccatttctgagttacttcacttagaataatagtctccaatcccatccaggttgctgtgaatgccattaattcattcctttttatggctgtgtagtattccatcatatatatatatgtgtgtgtgtgtatatatatatacatatatacgtatatatatattatatatgtatatatacatatatatacgtatatatacatatatacgtatatatatatattatatatgtatatatatacatatatatacgtatatatgtatatatacacgtatatatgtatacgtatatatgtgtatatatatacacatatatacacacacacacacacacacacatatatatatatatatatacacaccacagtttctttatccactcgttgattgatgggcatttgggctggttccacatttttgcaattgctaattgtgttgctgtaaacatgagtgtgcaagtatcttttttgtataatgacttctttagctctgggtagatacccaggagtgagaacaaggtgttttggaggcagacaaaccagggttccattcaatgctccccctctggtattcaacttcttcaaatcctggataaatgtggggaccctctaagcctcacttcttgtgcaatggggagaaaaacattaccatctaatatggggtgagaaaggagtgatgcagttgtggatttagggctcctgatgaatgatacctccagtggagactggcctggattggaatctttcctgttatccctggaacccctctacctatccccacctgttctctaccctggaagaagcccaggatgaacggcatccataggctgtcttgccttttctgttgtcctggttgtttctggccaaggaaagtcaacaaatgaaagggaaaggagaacaaggttggggttttcatctcctctgttccctcctgcagggttgcccaggattgcaccctgcactcctcaaaggtcatcacaagctctgggatcactccttcgcctttgggcctgagtggtaccagcctcagggatgagccgtcttcctcctcttcctgtccacactgctgttagctgtcttttcagtaaattctcctctcattgtcctatattccatgtgtctcttcttttctgctgggaccatgtgaccaatgctaggtcctgcttggcacccccagggaaatgacagcctattcacagaccacagggctgtccacagcagaggaaccagagggctaattaggagctcatgtgcatagcaaacatattggaatgtgttgctcctccaagctggtcagagacatttgccatagtcactgagtcatcagtggggttatctgccttgcaacctaacagtgatacaactgacatcttaagagatggagcagacatgcacctgcaccccctttttatcaacatgatggtgaataagtgacatgtggcttccaatagatgcagaatagcaggatgctacatcaagggctgtgattctctagtctttagggggtctcccaggaaattttattttatataaaaatcaaacttcaacagggctgcaactccattggtccaaaagtctccccggttggtatcaaataaaaaaacaacaaatgcagacttagtaaggagggacttttattcaaaaagcttaatgcaagagggaaaacactctaggtctgcaagcctctcaaaggctaggggcaaaaatggtttttcttttatggagaagagtaaacaaggctagaaaacataacaggcactgaccttgaatttaagggtggcctgattagacagtagatgagaaaacatttgctctgaggccagactgttcccaggaggaagtgcctgctcactcagactgaggatgggcccatgttcagggttctgggggaaagagggaaactgatccaacatttgactagggaggacaagtggctcagctaacttataactgtttataagacaaagaattaggatttagagggtctgtctctgtcctattagacaagggacatctgtgagtcttttctcagtcatatggggaagggggttctttgcaataagccattttccagaacacaaggtgtgggaggatgttaaggagtattcagtagcacttgataaagcacagtaaggaagactttattcaggaccatcgcaacaggtgcagggaccacagcaatggggacttgcagtgggggagaaagattgggctcagatctgaatacagcatgggaaagtggggattcatagccacggaatagggtgcccatcagtggatggaaaactactaagaggaaacaccaagggccagcgagattcctcctaaccgacctagcaggattctagcataaggccaaccaggtgaccacacatcccctgggggtggtggaggctgaggagcctgatccctgatcagatactgaggttgaacagatggagggggggtccagtagggtgttcttgctaaattgacttaacaggcttcttgctaaaactggattttacaagcaagtgcacagatgggcctagaagaaggttgaaggtccccagaggtcagacagctatgatataagaggttttgagcatttgcatcacataccacattttctaggcactaaagagaaggtaacaaggctttagcttttagaggcctccacatgatcaacaccttccctcctgagcatgtcggccccctatggccatgcacttgccagcagcctctctatggcaactttttgcctttttattaaaattgctcgggcgtatgagagccagttctagtcccaatagtatgcccatctcatccaacctcttactgcttcggaggtttgttttgactcttgtttggttttcctaaggaatctggttgaaagagagaagagagaaaaatatttttcaaatcaaatttctgccccaggtatttgtagagcaaagccgctgcttcaccaggctagagtcccttccccagggcccagtaagactttcatgggccatgaaggcaaaacatattaaatatgttttaatatgaaaatatattatgtaaaaacataaaacattaacatttgtattttacaactatattggtgcaaataccaatatgatcttcaatccccaatgttcattttcttctgattataacacaaattaaaacattttgtgagcccctaaaaaggccttagagtgtgtgcctgttgggtaacaatctggcctttccccactctcagatcatggaggttgggactgttttgtgtcttattcctctctgcatttctcagcctctctcttgaactaagaagggagttgatgaatctttgcagaactggaacttgtattccccattgcttgacatcaagctggaagtgtagtaaacattccccacattgttgaattgaatcacattagaaagcagggtattagcgcacagcatttttaattgccaaggaaaattttattttaactttgcattaatatgttctaaggaacctttatacttgatgcaatcagattcctgagagaagccaatacttttcctgtttttgtgttttatcctccattcttcatcgtatgcccttcaaggaaatctgaaaagttggcttttttgaatcattagtcacattgatatgtagactgcaattttgcttttcctgcgggattgctgaccttgtaaaatgatgcttatgtatgcgtcactaatctatgtgcttaacttttaacatctatgtaatgctaagaatatagacatcgcctgggggcaggtggaggttgaggaaccctatagagaatgatctgatatcatgtgtgatcagatagtgagggtgagggcttcttgcaaaaactggattttacaaagaagtgcacagataatcttagaacaagattcaggagactgggttatatttggtcaaggaaggaatctttgtcaagggatttcttaacctttgctgttttccaagatcaaagggttcgggtggaatgcgacaatgtcggtggtatttcaacttagcaacctctttttttgttttgtcatggttgctgagctgaaagggagaaaatattcaagggatccaccaagaaaatgctcacttaggctggaacagcatataataagagatatgttgtggttataagatcaacgattgccaaaaagctcacttgagggtctctcaggctgacaccacttgtcacttagcagcatgatgcaacctggctctgcagttagcaaacctgggctttccaaaagctaaaaccacctcagcacaggtgcagcttttatagaccttaaaataaagcttactcttataagaatagcttaaactatctttaggaaagaaatgcctggtcattgacccagactgaagacaggtataagagaggggggaaaatcccttaaactcccgttcagtctcttatctgaccatctcattctctatggcccatgtcactggcctgttcctgctgtaagtttcataacactgctgctagcataaaccgcttgggtatcagattgtgtctgcatttatctttgacacaaatcataccgaaggggagaagttgccccttctgaagaatccggtttaccaggatcacctgaaactcccaaaagaatgcagcaactaggcaaagagtgtctccgcctcacattatctgcccaagcacagtgctgttggccaagcctccagcagctgacgggacccagctgtagtgaggttgcagtgattgagtaggattggcctgcttcaaagcagaggtttctcatgggaatatgcttattaaactcccactggtgcagaaaccatgaacagaggatgaacaagtgaagttgcaatctcctccatcacagctcagttccccaacaacaggatcacaagctggagatgcctttaaggtaagcgtctattcccctggccaggctgggagtttttaaccctgaaacatactagttgggatgttcacagcagctacctgcttgtgttgcatattctcccaacatgtgttgtcttgttcttgtttcttaaatctgtttttgcttggtaatttccattgattataatgattttctgtgaggcttagcgagggaacattttaggagaggttataaatgcggctaattagtgacatgcaaatcgcttttgtggctgtttcaaaacatctaaatgacctataattaaattttgttgccaaattatttgttaattatcatcttcctatcaagtttattgcatcaggagatgtcattcactgtctaaaaggtggagtgaggaagagcatcatgcatatgtgttgcagagtgggaaagaatgcttgttttgttgggtttctgtctccattggtgtgtttttattttttgttcccacttctatgtatctcagatgacgagtttgtctatgggctgtcggaatcttctggttgagaaagatggtgggagccactttgtttaaatttcctaattttccataaacgaatcccttctgcaatatccccgacagatgcggcttttcaccctccacccaattccctcatgggaggaagggactttgagaggctgatcatttcgtggtctggcagcacttgtaagtccctggttctgttctggacactgtcccagctgtggcttctgagacaatggctaaatcctttctctcttttacagaccaccattcgagcacacttaagtgcaactcgaatgccattttccgctctgggtgaaatgttaccgattcctaagaaatcctggatgtcagatttttttttttttttttttttttgagatggagtctcgctctgtctcccaggctgcagtgcagtggcgcgatctcggctcactgcaagctccacctcccgggttcacgccattctcctgcctcagcctcccgagtagctggggctacaggagcccgccaccacgcccggctactttttttgtatttttagtagagacggggtttcacgtgttagtcaggatggtctcgatctcctgatctcgtgatccgcccgcctcggcctcccaaagtgttgggattacaggcgtgagccactgcgcctggccatcagatggtttttatacccttaagcatcctgatcactctcccttgatatgccactgaatctccatccctcttaaatcgcagggatctgcactgaaaaatattccgactctggtctgacttcgtgtaaacagctgagtggaactcatcttccttgtcccaaaagcatcttcttcttaacgtacaccaaactagtattaacttcagtcttctcagtcattcccttccccaactgacaaaacttgctttgtagttgtctaaagtcttcttcgtaggagctgcaagtaggtcacgtctgaatattggcatctttgtgtcattgattacgtttcttaaataagaagattatgtgttttccccattgcatttaattttgtgacttccatcttttgttccacttctcaaggtcttttctgaatctctgttctcttctgacgcacatgccattccccatgttggataaatattctgatagtcgattcatacaaatcattgatgtaaattatggaatagtgcagagctgtatagcacaggctcagtaacctctctggttcggtacaaagctttaatcagcacccttgtggagcgtttgtttagctagttacaacttttagatgctgtaacacatgattttctaattctaagctagatggctattcattctattgctgatattactggaaggaggaagtctggtagcattacctcaaaagacaggaggccaatgtcgttcccagagagctcaagatggcaccaaaagttcacggtttagcttcctaagtgcacaggaaccatctttaggaatatgaattcaggaatcttatgtcagacaaattttgcattgactagtctaactaaaagaaagataattaatatcttctttgtttatttaaaaataacatggttgtttataaagtgacatcaaaccatgtgcgcctctaggcagtaaatgtttatcggtggacattcacctaatatacacagcatactctctggctatattgggcatcttttgtttgcatttgcataagcactgttatagactgcttctgactccccaaaattcatatgttgaaaccccaacccccaaaatgatggtatttggcggtggggcttttgggaggtgaagaggttctgaaggtggaaactcatgaatgggactagtttcccatagtgattataaaagaggccccagagagtccccttgcttgttccaccatgtgaggacacatcaggaaggcaccatctatgaaccaggaagcaagtcctcactaaatactggatctcttggtgccttgttcttgcacttccaagaacagatgtgttgttccaggactgtgagcaatatatttctgttgtttataagccacttcgtctatcgtactttggcataacagccaaacagaccaatgcaagaaccattttaataaacaaggaattgtcattggctaattaagtagaattgtgtaatcatgttgtttgaatttggatcttgttggtttattgttgccataactgtctgtctgcaagtaacaataagcttgaagcctaagcaaacttaacatatgaaaatctgtgtcaagggcatctctgctttataaaagacagtcttcaattaggacccctccccagtgggattgagcacaaaaacagctatttgtgagaaaggatgccctcagctgcaaaaaaaaaaaaaaaaaaaaaaagatgttttcagtctttttcaaaattatgtttaaagacaactatcatcattaagttttttgctctatctagactttgcaatgttttccatctcagaacagaaactactgccctaaatattcaattaatattaaatggccctataggaatttatgtctaagagatagcattcattatctgtattttttcctattgctttttaggcatttatttatttttatatatttagggggtacaagtataattttgttacagggatatattgtgtagcagtagtctggacttttagtgtacccatcatccaaatagtgaactttgtacccattaagtaatttttcaaccctcactcctatctcactgcccaccttttatactctccaatgtctattattccaattagtatatccatgtctatccattatttagcacccacttataagtgacaatatgcagtatttgactttctgagttatttcagtaatgataatgacctttagttccctccattttgttgcaaaagacatgaattcattcttttatatgactgagaagtattccacggaatatatatataccacttttttttatccaatcctctgttgatggacacttaggttgattccatatctttggtattgtgactagtgctgagattaatgtacaagtgcaggtatctttttaatacaatgatgtctttccctttgggttcatacccggtagtgggattgctggatcaaatggtagttctatttaattctttgagaaatctccataccgttttccatagaggttatattaatttacattcccaccaacagtgtgtaagtgttccattttctctgcattcttgacaacatctgttgtttttagactttttaatatagcccttctgatggtggaagatggtacctcattgtggttttgatttgcatttctccgatgattagtggtcttgcacatttttgttttcatatgtttgttgggtgcttatatgtcttcttttggaaaatgtctgtttgtgtcatttgactcctttttaatggggttatttgtttttgtttttttttctcattgagttgtttgagttccttgtggattctagatattagcactttgtcagatgcatagtttgcaattttttttccattctgtaggttgtctatttactctgttgattgtttcttttgctgtgcagaagctttttagtttaagtcctgtttacctaattttgtttttgttgcatttgcttttgaggacttggtcatgaagtaaagccaagagtgaattagatatatttttttaagtttatggaaaccagcagaagacatagactacatagacattcatttttttttcactttcctcatcatggaaatattctgagacatgaaacatcactgtgacccaaggagaggcattggcgagagttagttgaaagagaaggagaaaggaaaagagtggaatatcattcactaaacacctcccatctgccttggaagttgggtgcacttcatctcttttaaaaatggagataatgggacatggaagcttggagtgataaagccaatatttgaaaaggggacgagttgactttatgatctgatcttttcacttaaagctctcagttcttcaatgagaaaagtaggtgtcctggacattattttatactagccaagttctgacttgagcaggaattaaaatgtaatggtttcaaagcactggataattcatcaaccagtagcactaagcacaggggtagggttagtccctcctcataccaattttatggctgtcattagagttaagcatttaacctccctggacttcagtcccttcacttgtgcaatggactgactgtttatttcccccccaaattcatatattttaattctaacccccaagatgatggtatttggatgaggggcctttggaatgtgattaatcatgaggggtttgtcctgaaaaatgggattagtacccatataaaagagaccccagagagctccctcattccttccaccatatgagaacatggggagaaggcactgtctatgaaacaggaagcaggtcctcaccagcacagaatctgcaataccttagtcttggacttccagcctgcagagctgtgacaataaatttctgttgcttataagctacccaatctgttgcattccacgatagcagcccaaatagactaagacaatctgtaaaataagggtattcaccacccatgaggtctcatagaaccttctgggtctaatcgtctgtggttctcaaagccttccccatttgaaggttgatgtttcctacttggtggaacatttctcttgcttccaactttattttgctctttctggcttccttggctgaattctctcttccctgtaattttctctgcatggcacttgcagtttcaccagtgggctatggaagatgtctttcaaagcctctggctaaggtgtaagaacagctggggtcctcattgggaagccgattaaactttaaaacagtaggctgaggtctagaactgttccaggaggtgagatgacagcaattgtccctgtgttcataccctctggttaatgtgactcccagctatgaatcaacctttatataaatgcattttggctcactggactgaatgtagctcggattcaataatagaaaatgtgtgggaggagacagtgagaaccccgaagccagaatggtctgatgttgtttcttgtgctggaggtccccaggttcagcgattcaccagaaggactaacaggctcagtgcatagtggggctcatggctaagatgtatttcagcaaaaaaattcagaacacattgaacaaagggaaacggcacatggggtaaaggctggcagaatccaggcataagcttccaggtatgtctctgaaaggagtcacacgggacatacttaactcctccagcagtgagctgtcaacacatatgaagtgttgcctacaagggaagctggttagagactcagtgcccaggttttttattgggagctgttcatataggtgccctttgcctagtactaccaaaattgcagactcccagacaggaagcaggtgttcagcataaactatgttgtttgtacaagcatttcaggcagagtgagccattcttgttaattctgggaagggtgagaaccctccccaaatctaattcccaattgccaaccaagagcacatgttacaagcaggcctttctaaggagagcaatctcaggtcctctatgttaacttctttctgcatatttctaaagtgttttatatttattatctttttaaggaaacaaactctgtcaccatgaagtcctagatgcatcccggaatgtaaaagctagaggagaatgttggatgtagcccatgacttcattttatagataagaaagccaattctcttctttttctcttttcttatttttagtatatttttatgagatataattttcctacagtaaaatgcacagatcttcaatgttccgtttaagttttgataattttatacaaacatataatcactgtcccaaacaaaatatatagagcatgtccattatcatctcagaacgttcctgttgcccctctctaatcaataccccagccagagacaaacacttttcagagttctatcaccacagacaatttttgccttttcttggactgcatatgaatggattcaagccatatagattatttggggtctcacctctttcactcaacataatgtgtgtgagattcttatgtgttgttgcatgtatcagtggttcatttattttcatggctgagtagtcttaggttagattgatgttccagagtttgtttatgcattctcctgttgatagttatttggattgtctccagtttttggttattgtgactaaggctttgggtggatagatagttttatttctcttgtttaaacatcgagtagtgtaattgcttgacagtaagatacatgtatattcaattgtataggaaatggccaaacttttctctaaaacgtttgcatgagtttacacttcaacaagtgatatataagagttctaggggccaggaacggtggctcatgcctgcaatcccagcactttgagaggctgaggtggaaggattgcttgagcccaggagtttgagaccagcctgggcaacatggtaagacctcatctctacaaaaataaaaaaattagccagggtggtggctaatttgcctctagtcctaactacttgggaggctgaggttgggaggattgcttcaacccaggaggtcaatgctgcagtgagctttgttcgtgctactgcactccagcctgggtgacagagcatgaccctgtctcaagaaaaaaacttagagttccacttgttctgcatcttcactagcatttgatattttccgtttttcgttgttttgttttgtttttattttagccaccgtaggggttgtaaaatgctatctcatggtggtaattttcacttctctgattactaatcaggctgaatacctatttatttgcttattagccttttgtatatcttcttgtataaagtgcatattcaattgttttacccatttcattgtttcattccttttttattattgatttgttctttacatattctggatataaatcctttaaaaaataattgtcttacaaataagtttccctggtctatgttgcttatctatattcctttttccttaatttttaaaaaattgaatgttactttgaattattttatctcatgtatcctctcaatagtcccactctcttcacttgatgataaattagaagcatctaaaaaaaccaatcattccccaaaaagtaaattaaaacctttctatagccattgttcagttctagttactctattagccttgttcaaatcgttgtttttttttttttttataaaagcaagctttattttgctatctgatgagacaatatgctagtttgagagtttggaataaaaaacatggatatttgtattattaaggaaagtttccaagcacatagttattaaggaaagcacatattattaggccaagtttccaagcaaaagtcttagaatagacataaagatgtgaaataatgaacggtgaccttagtatttgccattgtcattgttccatgcaatatgtttaaaaaatgtttttatttgatagtgataagaatactatcagatctaacctcttaaaattttaagtgtgcaatacagtattgtcgactgctgatacaatgtttgactgcaggtctctggacttaatccatcttgcttacctaaagttttatgcctgctgactcataaatccccattttcccttcccctatcccctggaaaccaccactttactttttggtcgtatgaatttagctactttagatacctcctgtaagtggaatcatacagaatttgtctttctgtacctggcttatttcacttaacataaggttctcaaggttcatccatgctgttgcatattgtagaatatccttccttttaaggctgcatagtattccattgtatgtatagaccatgtttttttttgtttttaatccattcatttgttgatgggcatttaggttgcttccatatcttggctatggtgaatagtactgcagtgagcagaggagtgcagatatgtctttgagatcctgatttcaatgctgttgggtatatttccaggagtggggttgctagatcacaaggtagttccattttttaatttgtcaaggaaattctgtactgtttttcgtagcaacagcacctttttgcatttccaccagccatgtgcaaagaaattctccacatccccactaacacttgtctcttgttttttgtttttttaagagcagctgttctgacaggtgtggagtgatctctcattgtgtgtgggtttgagttgcattttcctgatgattggtgatgttgagcatcttttcatgtgcttcttggcatttgtatgtgttcttcggagaaatgtctagtgaagtcctttggccattttttaattgggttatttgtagttttgttattgagtttgggagttcattatatatttgggatatatggttatcagtatatggtttggaaatactttctccccttccataggttgccttttcactccattatttcctttgctgcacagaagcttgttagtttgacgtagtcccacttgtctgtttttgcttctatggcctgaagcctattcacattcttaaaagtatcttttgatgaatagaaatagttgcttcattttaccttttactctttacattttaatttggataattttcttgacctgtcttcaaggtctctgattcttttctttgcccatgacatgaacttcttatttctgatgttacatctattttgttttatagctagcatttctgtttgtttcttcttttgtattttcatcttgccactgaaattccccatctcttaacacatgctgtttgcctttcctgctagattcttttatggatttcctatggatgtcttaaaggatatagatgaaatatctaacatttgcatacctcctgctatttcacatgtcatacgtgcaaacataaatatgcatgcataatagacattgattataaaaaatagtggagaccgagtcagtcatattttcgcctagaaaacatcacacgcttcatctgtgtggccccttggtaagctgccatttcagtgtggttgtgatttgtttggttttaattaggttccgctcacccccttggcttcagatgctttgagaggggatccacactttccctttagcagagcttaggatctgagcattggtgagactcttaagtcatgctctgtttgcagcctgactgctcacttgttgggtttttgaagggtcctctttgttttctgtcttgccctggatttggtcattccaaattcccatcctagctggggaacagggacaggtgtgtggctgcccatggggaagatttggagtgccttggaggggtgcatctgagcttccctgcactgcctcactctgagttttttttgcactgtgtggtgtacgattccccagggggcttcatgaagactgcaggagtgcattgaagggttggctgcaggtgggctgtctggctggacctcatcaggatgctgatctgccgtgccagcctacctacacccagtcgttaaaaactcctttcagggtcagctggattcttcctcttctccctactcctgctaccaggggtgaaagcaactgaaggtttcttctttgtaggaaggttcatcacatcctggattctagttcatttatgttttttctgcatcttcagccttttttttgtcggggggcggggggacagggttttgctgtgttgcccaggctgcagtgcactggtgtgatcatggttcactgcagccttgcaccccggggctcaagagatcctccgacctcagccttctgagtagctgggactacaggcatgtgccaccatgcctggctaatttatttatttatttatttatttgtagagatggggtctttctatgttgcgcaggctggtctcaaactcctggcctcaagcagtcctctcgctttggccccccaaagtgctgggattacagacatgagccaccaccaggtccatcctcagctttttgatggatcttaaaaagccatgattttaattggaagcctcataaatcactgttgggaatgtgaagtggttcaaccactctagaaaacattctggtagttccttcataatttaaacctagaatttccatatgacccagccattccactcctaggtatgtacccaaaagaattgaaaatgggtgtgaatgttcatagcggcattattcatgatttccctaaagtgaaagcaacccagacatgtgtcagctgaggaatggataaataaaatgtggcacagccatgcaatgcaatattatgtgggcattgtattggtccactctcacactgctataaagaaatacctgagactggataatttataaaggaaagaggtttaattgactcacagttccgcatggctgggaaggcctcaggaaacttacaatcatggcagaaggggaagcaggcacatcttacatggtggcagatgagagaagagcaagtgaaggaggaagagccccttacaaaaccatgagatctcatgagagctcactatcacaagaacagcatgggggaaactgcccttatgatccaatcacctcccaccaagtctctccctcaacacctggggattataattcaagatgagatatgggtggggacacaaagcctaaccatattaggcataaaaggaacaaagtacttttggtaacactgtagtatgtttatgccgatattatcaggtgggtgagcctagaaaacatcatgctaagtgacagaagccagatacaaaaggcctgattattttccatatgacccagccattccactcttaggtatgtacccaaaagaattgaaaacaggtgtgaatgctcatagtggcattattcatgattttcctaaagtgaaagcaacccagacatggtgcatgattccattcatatgaaatgtccagaataggcagatccgtagagagaaagctaattagtggttctcaggagctgggagagaggaatgaggagtgaccactgacaggcacagggatctccgtttaggggtgatgaaaatgttctggaatgagatacacctgacagttgtacaacattgttgtacaattaaattgatgtactaaatgccactgagttgtacacttaaagtgctttaaacggtgaagttgatattacgtggttttataataatttaaaaagaaactatgagttcaaggcttcatggcttctttaccttgtcaatgtgtgttcactggtccctttggctttccacgtcttaattagtgtggagtcctaattagggagagaggtcaggctagggggatggagggaaagtagaaagagaaggcaggtaagttataagtctccctttcttcatgctccagaacagatagccctcctgtgcaaataactcacagtctgcctacacccagctatctccagacccttggctgatagaaaattgcaagttatctcactgcaaccttggcattatcggtactgcacaaagccctcttcagcacacagcacaagcaccatcctataaaatccccagcaagtctttgtctctttgcagtcagctcttctctcactgacctgcctgttgcacgcttgcaacgtattttcatactctctctaataaatctgctttttttttttttttttcttaacctacaactgtcttggtaaattctttttattcctgcaccaccgaccgcagatagtcgccactcacccatgacaattagcagttaaagctgactgctcttttcatagcctataactttaaatttgtttttttctgtaaacattttcaactggccacatatgtcttgagtagacagaggctaattgtcagcttttgctttctgggttgttctattagggtgctatggcatagggtcctattaggatcctatggcaaagagcaacagtgagggtaagtggaaatttttaggaaaacttgaccacatctggggtaacaaattaaggcccaggggccaggagtttggtagaagcagcgtgaatcagaagctctgggggaaatggagtcgtccccaaaagcaggcaccagctgcaggtgcatgagtgaggagggagggatggtgcatttatacactgcattagggctagcgaaacctttatacagtgcattagcgttagcaaaaggcacttataggactttatcccctttattttttttaaccaccttgagaaatagagaatgggtttagagaaggcagagtgacatgcattttgttctgttgcaatttgggtattcttatgccttagtttgtctctgatatcttttagccaaggggaagaggctggcaaggtttccattaaaatttattttcacctttacttataccaatttggtagatatagcaggcgagcagtttcctaccttgaacaggggcatgagaagaatgtatctgcttttgctgcagacagcccaggtctggagaccctgcgattgggaaggctggttccactgggtagaagcactattgtgaatagtgatgtagtaaaaaagggagtgcaggtggtatggtttggctgtgtccccaccacaaatctcatcttgaattgtaatccaaattataatccccacatgttgggagagggacctcatgggaggtgaccggatcatgggggtggtccccccatgctgttctcatcgtagtgactgagttctcacaagatctgatggttttataaggggcttccccccacttcgttctgcacttctctctcctgtcgccatgcaaagaaggtctctccttcgccatcaccttccgccatgattgtgactttcctgagacctccccagccatgtggaactgtgagccagttaaacctctttcctttataaagtacttggtctcagatatttctttttttcttttttttttttttttttttgagatggagtctcacttcttcgcccaggctggagtgtaatggcgcgatcttggctcactgcaacctctgcctccagggttcaagcaattctcctgcctcagcctcccaagcagctgggattataggcatgtgccagcatgcctggctagtttttgtatttttagtagagatggggtttcaccatgttggccaggctggtcttgaactcctgacctcaagtgatctgcctgcctcgacctcacaaagatatttcttacagcagtaagaaaatggactaatatagcaggtcttcctttggcacattgatatatttccctttagataaatactcattagtgggcttgctggatcatatggcagttctagttttagttttttgagaagtctccatacggttttttataatggctgtactagtttacatttccacctgcgcaggtcacctgctggtcatctaattaccaaagcaatttttacaaaattcctctacatctttttatttatagataatcacagctgtatgcaccaatttatgatccctgaaaaaagagcagcaattatgagacagcttgttcaggggaaggagctcagtgtacaggttagggcctcccatcgctgtcttcctatgtcagatgcccgggctgattaccatgtctatgaaatacctctttaacacagagggttaactagcttgctgcagtgggaggtaagaataacaacagcctggccatccactgatcctggaaaatgctcatccacagagcagctgagccaagatggtttgagctatctttgtcttgtttcctcatctggttgttaaatcccagaggccctctgatattgacagcgcagatgctgatatatattaaatgtgtggaagcacttcatgccatccccaaatcccttgctttttcttctcctcaaacttgtgtgtattttattttctctccttttacatctgctgcccatggttttgttctgcctgatttcccctgtaacataacccctggttaccaaatgctggaaagtcagataagatgggaatgctctatggcgtttcatccaggggatcctggaaaatgcaaatatacaaaacctatcatgaccaaagcttcctgtgaggtccctggaaaaactctgtgcacagagatgccctcagggggcagaataacactttattattttctccactactggtcctcaaagaactctcacaggagactgaattctgcccagagctcctttcctgcatgtcccagacatccaccatcatttcctcctaagtccagactgactgactgactctgttgccgacatgcaaggaaagggacttctcttggtttaacaggaaaggaaatagagggacagagcaaataaaagggtggtggagctgtagggctgggacagagactatatgggagagtagatgttggacaaggagggaaaattgacactccagtcagaggcagctctggcctcttagctcactgtcattcttaaggcagtctctgggaaccttggcttctttagaacactctacctctgaaatctgtgacctaacccatgacttcaaacttgagcatcctttaggcacttggaggatgtaaagactatcctcatcctcatggagagtttattgttcttgaatctgatccttttacaggagaaagaagaagtcttaggctcaccctctgttaagtacaaaagtttcaatatatgtttctagacgtgttttttttcttacaaaatccttctataattcactattaccaatgaagagatcatttaaacatagccttctcaaccttttcttcaaatcccaccatcatgaaccatttgtccactgttctacagtgccaagaactctccaaatatggtggcctcttaacatgccagagaggaatgttttcagactccccagattgtttaggaccgctatgggacacagtcctctccatcaaatttggtaccttgtaaataaatgaaaatattaggtaagctgtgatgagtggttcatagcaaagcatttggatttggaggttgggtagaggtcttagatctgagcaagagagaaatggctccttccacatggtaactttatggtgagcaccatttatatcttgcctcagggagagcacacatattacacataatgggccttctggatctcattagagaggttaaaaccaaaattgcaacagaggtatcctgcctatgatggcactcaaatgtatcccaagtctgtacatttgctaaactaacagggatgaggagcttacaccaaggtaacattaattccagttgccttggtctgtggtatgcacttgtgtttgaaaccttgaaccttcttcagaaaaactgtttgaaaaatatttagttagccgggtccattggttcacgcctgtaatctcagcactttgaggggctaaagtgggagaatcatgagcccaggagttcaggaccagcctgggcaacatgacaagatcccatctttacaaaaattttttaaaaattggccagacagacacagtggcttgtgcctatggtctcagctacttgggtgggaggattgcttgagtccagaaggttgaggctgcagtgagctgtgatcatgccactgcattctagcctgggaaacactgagaccctgtctcaaataaaaattagtcttctgaaaaacatagggaaattaaaggaaattgaagtcctagcagagatatccaatgttggttattacacacttgtgtatgtgaatgtgctctttttattttctggttccttttaccttgttttatacataacctttagataagctttgaattagacaaaacatgttcactttgtttttaacaagaatgtttttctacaatatatatttattggaaaatacccaaataaagaaatacctattatttaatttaatataactttatattctaaattatgaccaatttaactacaagtatttatcctattacatttatctattttattttgtttacctagattatttatgaaaactgtgatagttatgatttaaagttataaaacccccattgcaaaattataactgagacagtgaaaaaagatttgacctaactgactccatcttgctctgaacctccaggctgtccttgttcattcctgggcataggtcaaactaactttgggaggaacttagtttatagattagctttgaaacagagatgataacagtcctttcccaaaacaaacctccttactgcctgtggactagactgcctaaagccacgagattagaagttatggtaattttactaaataattaaagatgtagctattttcattaaaccaatatcaatgtcttatttattaaaaattacacaagcaaaggtcgttctgttttgggctgggtttttagttttgtaacccctatgccaaaatttgacaccttatagtatttggcagggataagtatgacattgcttaattaataaatgcaaacaatgcatgctgacaattcttaagaaatttctaatattacttaccaataattttaaagctaacttatttattaaaggttttaagttatataaacttgaaaaagcatttgactagtccttttttcctgataaagtatttaagtgtttttatttttctttaagccaattaattagagctcttttatatatttttagtagtgaaacattgtgtacacaacgcataaatacatagatgcattaggtatgcgaatgaaagtacattttgtagatccataaagaccatcctttttttttttctatcttagactttcagattcttgataacctgttttacaaccttaggtggttgtcagctaaatagccttaaaattgcatgttaaaggaaaccactcaagtaaaaatcaaacagcaaatttacatcataaggcagagagagaaaagatctggtgttgctagagggagatccttttatttttctttgagcagatcaaacgtaaaattacacatatctattatgtgattgcataaggacaccaattttgtttagataaggactatctatcttttaactagatttctgaactctggccagaacccccccaaaaaccaaagatttgctcaaaaaaaaaaaaaaagacaagttcttaggagagaaaaacaaaacaacaaaacacgaaggccttttaaatacaaacatgcacacacacacaaacacacactttttgttgttgttgttagtagagacaggatttcaccatgttaaccaggctggtctcgaactcctggcctcaagtgatccacccacctcggcctcacaaagtgctgggattacaggtgtgaagtaccatgcctggcctcaacatagtattttaaagttcatctgtgtattgcatattgcaatatttcttcattttgtaaggttaacaatattgcaagaataatactgtaagaataatattgcattgtatgttgtgatggttaatttcatgcatcaacttgactgagctaaggaatgcccagataactagtaaagcattattactgagtgtgtctgtgagggtgtttgtggaagagattagcagttgcttatttttatttttatggatttaggagtacaagtgtggttgtgttacatgaatattttgtgtcatgaagtctgcacttttagtgtacccattgcccccatcatccaaataatatacattctacccaataagtagtattttctccttcaccccttcccacactcccatcttcaatagtcttcaatgtctgttattccactctgtctgtctgtgtgtactcattgtatatctctcccttataagtgagaacatgagattttttacttttgtttctgaatcatttcactagggaacattttctttgctgtggtaaagttcctgttatgtaagcacattgtttacatgtcttctgcagcaacatggatgaagtgtcctccagtttcatccatgttgctgcaaaagacatgagcccattcttttttatggctgagtagtattccatggtgtgtgtgtgtgtgtgtgtgtgtgtgtgtgtgtgtgtgtacacacaatgcgtggtgtagatagatagatagatagatagatagatagatagatagatagatagcacattgtttttatccagtcatcgttgatggacatttacattgattccatctccttagctccaggtagattcagagaaaaagcatcagattatagaagcataaacatcacagggttttagacatgataggagcctttttattgtacagctgtagaaacagggacctgcaaagactgggtgacatgtccaaatgttgacagctagttagcagcagcaacaggatggcagctaccatctctggatccattgctgattgtcctcccctccatctcatgatgcatcaactggagcaatgacagagaagggggaaaataaggggaaagccaggagtggtggctgacacctgtaatcccagctacataggaggccaaggtgggaggattccatgagtccaagagtttgtgataaacctggactacatagcgagaacccatctctacaaaaatttttttaaaaattagctaggtgtggtggtgcatgcccgtagtcctagctactcaggaggctaaggcaggaggattgcttgagctggggagttcaaggctgcagtgagctgtgatcgtaccactgtgctccaatctgggtgacagagtgagaccttgtctctaaaaattgtgtttttaatttaaaaaattaaaaaatcagcaggaaccaatagaatcttcacacatgcaacacttagtgtgtcttcactaagtgaagacttcagtgtaaagacttcaaatgtaaacaaacaggttaggcaaggcttacttttttaaacataatttttaattagtattttattaatactcaatgtatattataatgaattcaactatactaggtataattgattgtattgagaaatacaaagaccaatgcaccaggtactgttgtatagtcgatagaaacagattcgctaaatcaataaaacatgaacatttattttagaaaaatcacaagtgatttaaataggtatttaaatctatagaaaagtctgtttagacacaatttcagaatgggttttttctgtcctcatgtcagactatttttctttatcgatttaaaacaggacctttgttggataatagcactttgtgaatcaaatttcaccagtgtacataccttggattgaacgaagctgcttttcttctaaaaaatattgtttgtcgtgcaagtttttctctgtttttaataagccttcttccccatcgagcaaatagatcaggaacattttctttgctgtggttaaagtttctgttacgtaagcacattgttaattttcttctaatgaacaaatttaatataattacatctctagttataaaaatgttcctttgtctctctctttcctaatgatgctgttgtaggaatagctgctttctccacaaaaaaagtttttcgtgctcttttgccaaattaagtttgttcagaaaaataatttttaaagggaaaattatgcagtttttcagaagttaatgtgccatgttcttaatattttggagtggagcagctttatttaattttaagtacttttatgttaactgactctgtttcagttttttgaaacctctttatcaataccttcttgtaagccaggcttgtaggaaagaaaaagcaaagtccacttacttctgctggtaataatttatatacagtgggattctaagtggctttttttttttttttttgagaccgagtgtcactcactctgtcacccaggctggagtgttgtgtctcgatctcggctcactgcaacctccgcctcccaggctcaagcgattctcctgcctcagcctcccgagtagctgggactacaggcaagcaccaccacgcccggcagattttttgtacttttagtagagacacggtttcaccatgttgaccaggctggtctcaagtgatccacctgccttgacctcccaaattgctgagattacaggtgtgagccaccctgaccagccttaagtggctcttaacaaacttaaattttcacacattcttaattgggctagatggtatttctcatcctagtcctgataatatctacctccaggcacattttggaggtataatgaatgatatgctgagctaaccaaaatcattttgtgattcagagattaatataggcatgaaaaattattaatgggcttttatcctattgtgttcaatttcaataaaatggtctgcacctgaactaacccttttaccacaaagcatagaaaatggaaatgaatcttctccaaggagcgcgcgcgcacacacacacacacacacagatatgtatgtgtgtgtgtgtgtgtgtgtgtgtgtgtgtgtgtgtgtgtatatatatatatatatataaaatggatcccttctatgatggcatcttggtgtggaacaaattcataatcttaatcctccagtatttttaattgttccctacccagctaatgggaccagtatctttccaaggaacaaggctgaagtcatcattgactgttgcctctttctgacacttcacatccaggcaattaccagctcatgttgattgtgtctcaaatcggctcagttctctccagttctctcccacctgcccctgtgctagtctggaccagcttccttggggggttatggccattgtcgtgcgatccactccagtttctgcccaacccttctgccagggagcaaccagaatgcctgcgggagtgaaacgaaaccatgcctgtcatccctagtgtcctcaatctctgcttcatcacttctggataaagataaatgccccaaacctaaaacaacagaaaggaaaaagataaatgccctccatgtctgatcacgatgatttatcctgacctcttctccacctcacagtcagacttttgcatggaaaaaataaccaaccaaccaatgcgcacagtttgtaggaatactgcaacatcagcaacttatacaataatgataaaaaacaaagaacatggagagaaacacacatattacctgagtggctctctgagtggctggttgatgtttctcttttgtacatttataatagtaaaaatacaacaaaacatttatttaaaaaaatcaatttttgtgtacaaaaatcacaaagcataatagtccaaagtaggtctctaaatagctaggtttttttggtgagattttagttagtcctcatatagagcctgaattttgctctatttaatctcttttttagccatttccctttggtctaccctaaatgcccttttctaattcaggtgctttcaactttcagttataaaacaaaaattcatttttacatggttgctgagcagagacatgtgtccttaaattgcttatataaattctgagactcattactaatgaaacatgttcttaaaataagttcaacatgacatttcagagccgctgtcctggggagcttttttctcgtcctcattgacaaaattgaccttctcacctcaagctattggagttatctactactgtgtaacaaattaccccaaaacttagcagcttaaagcaacttgcgtttgttatctcattgtttctgtaggtcaaaaatctgggcacagcttagctggatcctccttagcttctacgtctctttcaggctacttcaggtgtcatggctgtggtctcatctgtggtccaaaagtagcaggatctctttccaagctcattcagatagttgcaggcaggacttagttccttgcaggatgttcacctgaaagcctcatttttttttgctggctgttggctggacacttctctctttttcttataacatgggtctctccacaatggccacttacttcatccacagccagcaagcgatagagtttgccagcaagatagaggtcatagtcttttacaacccaatcacagaattgacatctcatcactttttccatatcctactcattggaagtaaatcactaggtccagcccatactcaacaggaggcgattgtatcagatgtgaataccagaagggaagtcactggggccacttttagttggctgaccacatttttgttcaaaactctattagtgtacttattatactctacataacattttattattattaatagttgtaattttaataataactttataagttaataataacttaatattattaaataactataatgaacaactatggcctcttactatgattcccttgctgaatcaataagtactaagaacccagaaggagagaccctgtctctataaaaaaaaaaaattaaaaattagctggtcatggtggtgtgcccttgtaatcccggctacttgggaggctgaggtggcaggattgcttgagcccgggaggttgaggctgcagtgagccgtgatcacgccactgcactccagcctgggtgaaacagtgagaccctgtctcaaaataaataaattaattaataaaaataaaaaggtcctaagtgtgtagttttatcttcaaaataatacttgtaaggtattattattcctttcttacagaaaagaaaactaacaggctaaatatatagcttgtggtttcactgctagcaagtgggggagaaagaaagaaaacctcaacagcataaactgcagttctgactccactgcccaccttagtgggtttggtacttgtgcatttcctcatttgacctgtcagagtcttgcagggtgactgtgtgtctcatacaatcatagaaccaccataggactgctataatgtcatctttctgggttttgccctgtatttgtggaattgaaatagattcggttgaattctcagtgaattgctttccactggaaaggtgtagctagactaaaatgctcctaacaagttacatttgtctagcactttattattttggaaacctcttttggggttggatagggcagggtcttactctgtcgcccagagtggagtacagtggcgcaatcatagctcactgcagcctcaaactcctgggctcaggccatccttctgcctcagcctcctgattagctgggactacaggcatgtgccaccacacccagctaatttttacattctttgtagagatgggatcttgctatgttcctgcagctggtcttgaactcctgagctcaagcaatcctcctaccttagcctcccaaactgctgggattgcaggtgtaatctactgcatctggtcgcattttggaaaccttttatcgctagtatcctgagtaactcccccatggtcaaggtgacatcttagggtaatgtgcagaagagtgattcacaaggagaacatgccttctaaagcctcatggctggtggcctgagatgaggccagagctctgactcttatttctcctctcattctgctagttcttgacaagcagagaataaaagccagcaaaaagagaattaaggagagttaggaatgagagggtagctgtaacaaaaacaaacagagactatcacattccctgggttggttatctttcaggaagaatcgtggtgatctgcgtttgctttttatgaaaaggggagaccccgaaaagggagggaggtgagaggactattggaagtaggtcaggggagagagagagaattttatgtttcccaggctgggagctgtgtctcacgcctataatcccagcactttgggaggccgaggcaggtggatcacttgagatcaggagttcgagaccagcctggccaacatggcgaaacaccatttctactaacaacaacaaaaaaagattagccagctgaggtggcaggcacctgtaatcccagctaatcaggaggctaaggcaggataattgcttgaacccgggcggcagaggttgcagtgagtcgagatcacaccactacactccaacctgggcaacagagtgagactctgtctaagaaaaaaagaagaagagtatggctcccaatgactaatgtgtaggagtaaggattctttgactggggttcagacaggcaaggagcatgatgctgttgtgcagagtgtaactcctgataaaaatgtaaggtagcaaaagatttgccacatggacaaatgacaaaataagcaacttagaaggcatgagaagaaggaatgcttgcagcctaatgttttccttgaagagcctttttggagatggttgcctatgtgcattagaatttaagagcttccataatttgcggaagtatgttatacccgagaaacattgtctgttaacaccgaagatgtacttgtgggtgcaaatgagaaatttacacctactcaaatggtttggcatttccaaatcctttggtagatgccgatctgcctacatacaggagcagagggaatgaattgcaattctgttatgttcaggaggtgaaaattctacagatgatagggcgggtaacatgctagcactaagttggtggtttcagctggggacagttgtgttccccagaggacatttggcaatatctggaggacatttgttatttcacaactaggggagaacagagaagttggggacagcatcctgtcggggtttagtgggtagaggccagggatggtgctaagcatcttacaatgcacagaacagccccctccccaccaataaagactcatccagtccacatgtcaatagtgttgaggctgagaaacactattaacaaaatctgaggtccctaagtcaaatatcaactcatgataaaaacatgttctcatgttattttttcacacaggagaaattggttaagaagtaggtaaagcagttacagtgcttggtacatactaagcacccaaaaaactgttattttaaaataagaaaagttatgtatttatttcctgtatcaactgaaacatgaacctagtaatgaagtagagatgcagaacacagcctgctggctctggccttctctgatatgaatgctatatgttgcactcttatggggacaggaggttattaaactcactcttttgcaaattcctggtattagttatggatttgtaagccattaaatctacttagggacccctgatgctccaaccctgagcttttcgtgggcattattaatggtgttttcagttttcttaaaaacctctagtgtgtctcactcttcatatttaaagacggatgctaatttttgaatcttctctgtgccccgtaaaaccttccagccatttaaaaaaatagtgcatggccctgcttaatttcctctctggttgaactggcatgagggccttttaattaaacagaataaacatacatttttgatttaatgtggctttctttgatacttgctcaaccagcccctgctcacatggtgtctacagtctaattaggaaggggaacaatcatctgatctcagatttacaacccttctctgtcattatttattcatttgcctagtccacaaatcttgactatttaatgtgtgcgaagcatgagagaggatgctagggatatagccaggaggcatttagacttcttcctggctgcagaatgcttccagtgcagcagggaagattaaacgcaaaataactcaaactgcacttgcttgtatcatcagtgctgagaaagaaatgcacagtgataagaaaaggggaacttcctcccatgcaaggaatcttagagggtgtccctagataagtcacatgaaagctggggatgggggctgaagattggcctctccaaattatctctgccctcctctcattcttcagcctttccgcacctcactccaatatgaggtccattgttacaatcgtggtgttgaaggtaggagagttcaccttttattacacccacctagctatttaaacacaagcatgtagtacttgtatagatatatttgctcatatttgcaatttctctgtcacggatgtggggctggagcctggatttgccagccaaagagttaacagatgttgaacgcaatgaagaattgtctcaaaacagctgttccaagaaagggatagtgtttcgaataaaaagaacatttgttagagcacacatcatcttgagcctagccgtaaaaaaacccgttcacaagataagccattgttcgctctttgttaccaagtttgtgtttaaggagttaagatttgggagagactttttttttttttttttgagacagagtctcgctctgtcgctcaggctggagtgcagtgagacggagtctcgctctgtcgctcaggctggagtgcagtggcgcgatctcggctcactgcaagctctgcctcccaggttcgcgccattctcctgcctcagcctcccgagtagctgggattacaggtacccgccaccacacccggctaatttttttttttggatttttagtagagatggggtttcaccgtgttagccaggatggtctcgatctcctgacatcgtgatccgcccgcctcggcctcccaaagtgctgggattacaggcgtgagccaccgcgcccggccctgggagagactttcaacttagctgcaggtcctgcccagcacagtgttcacagtctgcaaggaaggtagcagggtattgcatgggattttatgttaatgatgttcaggggatgataattctcacccgggaaggaaatgatccattagttacactctcagtctgtgtcttaggccagcatgaagccattacatatctttagctgcaaaataataattttatgatgagataaggggtagttttatttctggcctattttaaaagagagaagatgcaaggcctacgccagggactaaatcatttcacttcagactttgtatagaattcatgtcaaataaatgtcataaattataaataagacataagtgtgtcacataaaataattctatggtaatagttaatgacagagctaagctgaataaatatagcaaatatgtgtgtgtgtgtatgtgtgtgtgtgtgttttcatgtaaacattttcctctatcatagaaagtgaatgtgaccatcgaacacatccttgaattctaggattagtcccatggatttaagtctcccaaggagataaaagtgaagagacttaaaataaaacaaacaaaaaactcttttgccctatttatttgaataaataagagtaagatagtcaatcactcaatcactttgcaaagcttaggaatctaactgaataacaaaagtaccaactcaatgtagataaggagaattgagtggatcaggagagagagaggtgattgactatgattagtagtgtcatgtgtgaaggaagtacccccggactgccagtcacatagcttcccacatttactctgtcttctttaaaaaatatcatgcttctcaaaatacttcacattctaagagtgcagctgcacgaacatagagttgatgattgcatggaacaactgtataggatgttgtaagaaaatatacttctcttggagctaagagctatgtagttgacagtgacttctctctcattactggatgtctactctctcacaccagcttcctcttttgctgtaatagagtactattcaagcaggagaaatttttgtctccctttctcccagcaatggctggtagagtctggagacatctttggatctcataactgaggggagttatacatgctactggcatgtagtgggtagaggcttgagatgtgctgaatatcctgcaatgcacaggacaggcccctacactaacaaatcatccgtccccaaatgtcaatagtgcagaggttgagaaatcctgatttaatgcaattcatgacctgtaatggaacccattatcctggctaatttgcatttgtgtgtactcctttactaaggctcaattaagtaatttagtgaatatttattcactcgcagggccatgggggagaactgcaaaagaaaattgagggattataaatacctaatgggaaggcaaggtgaacacacatgaaaacaaaccaaaaaaattctacttcaaaatgttattgattttctccagaccctaattatgtatattctatcatttgcagtgcataccctttgtctgtctttgcaaactgtcaattcagataatatagtgtcttagtgaattgttgccacaataatgtcatgtaccaattctcttccaagctcaacagattaacacaacagtgtatattttcattggtttgtctgttggctgaaacaaacaagctccaggctgtctgttgggctgtgtctgctacaatgcatttactctggggctcaggctgaaagggaggtagcacatactagagaaagagcttcttgtggtgatggcaaaagtacaacaggaccaagctaaacatgcaagcataacgtttctgtttccctcacatctgatagcatcccattggctaagacaaatcacatggttgagctccaaatcaaggctgaacaagtatactgtggtctctataaggccaatgcaggatacatggcctcactcaataccggtgggtcagagaaaggattgcgttattttaactaataagttcattttaatatttccatttcaaatttaacattataagaatttttcttgtttttttaagatttattactatttataattgtggcaaaatacacataacataaaattttccatcttaaccatttttaagtggcattaagtatgttcacactgttttgcagccatcaccactatccatctctagaattcttttcatcttgcaaaactgaaactctgtatctattaaataattattcccaattcccctgggattgagtacttatttaaaaaaaataataatctaccacccatttttaatgggagcaaggcttatttttatagagataattggcatatagcatgcatttatagttgtcagcccaacctatgcccaaggtgtattctatccaagatacagacatgtatgtcttcgggacctaaggtaggagccccacagaagtgtgttttactcagataaaaaagccttttgggaaggaattccttccaagttcaggccgagaagcagtatgggccatagccagggagcctgcattagagaaattggttgacattcagacccatgtccatcaatcactcaacagggaagtctacctaattctcaggttccaagcagtagtaggttaatccaagggggaaaaagtgaagtgtgcttttactgaaatctacatggaatattaggagcttagggcatcagcagcatatagctggcagcttcaggagcaaccagtgcaggagccagccagctggcagcagtaggggctttagcagtgttaaaccccagagcccatgagatggagctcagtatccttatcatcagccaccagtggtgggactcagactgggtaggcagtggttgtgaggtcctttagacaggacctgtttctatcagcaggaacaggaggcatcactacagagccctgggaaatgacaggcattattcagtagccaagggaactgctcgagtaattagaaaagcactgaagtctccaccatgtggaatgctgaaaagccctagaaatactgggttccagggacaatctgagagagaagagccatagggagtcctgggtgctagtctagataccacagcttgctatgagtatgactagggcaattcattgaatctctctgggtctttgttttcccttctaaaagtaagagaattgggatacatgatttgcctggtcttttctaaccgatactgtattacctgaatattatatgaatgttgttatatgatctcaagccaggctttatattcatgccacgttttggttgtagaaagtctgtattctttatttatttaattggttaattaattagagagagtctcactctgtcaactaggccagagtacagtggcgccatcagagctcactgtagtctcgaacccctgggctcaagcaattctcctgcctcagcctctcgagtagccggaactacagacgtgcaccaccatgccgagaaaatttttaaatttttttgtagagataggaacttacatatttcccaggctggtctccaactcctgagctcccccagtcctccctgctcggcctcccaaagcactgggattataggtgtgagccaccatgaccagccaatctctctgagtctttgtttctccatctgacaataagagaattgggatacatgatttgcaagacctttttgaactgaaattatattatctgaatgttgtgatttgctctcaagccagcctttaagttcatgccagattttggttgtataaagaccatagtcttaaaccatgctttaaaaaaaaaaaagaaagaaagaaagaaagaaataggcaatttctcatttctttccaagcataaatattagcttaagcattaagatagacaaggtttttgttgtgatggcattgtataactggattatttcatgcagtcttatgtgaggaattcagtaagaagttactttgcatcagctttatctgtatttagcatttagcagattaagccgaattgagggcctttagactaaatggcaaaaatggtttcacgtaataatagcagggtgctttttacattcatgatatctgtttgaacatgttaaattcaagataccagatatatgtctgtatggagaccttaattcagtatttggatatacagtctctctggacataaaacttaggtgtttctaagcattcattcagtatttaatctcaccaagacagcatatgtatttcataaaggtagggaggagatgaggaaagcagaaagtgtcttgaggctcacaacatttaaagtgcagactggacagtggacactcagaagtggcaccaggccaggaaatatgtttagtcgttgtttgattgtttctttgagtattttgcaccaagttagcctacacatttgtttaaattattaaattgatggtcatacaactgcacatgcaaatctgtgtgtctgtcttctctttaaaaattggaagctgctacaagggtgacattctttaggaggggtgcaagctcttggctggcaaagcccctccccatattgatgactaaacccaggccatttcccatcccccatccagcctctgtaattatgtggggttgtgttcctgattctgaggtccatgaatgaggaagaaccagcaaacagagactctgcagaaagagagacacaataggaaactcagagagtatgttcaaagagcagtgcattcctgagcaagggaatggctcactctgacaggtgttgctggaaagccagggaagagactctgccacaccatgtgcactggccttgatgtccagtgtccttagtgactctgggggagctgtctgcatgcaccaaggctggtgtgagtgcaaaaatagatgcagagtgaggtcaagctcacatgccagttcacacgctgaaggactgtcagtgctcccagatacacggcaatgagggtccagtgtcaggagagaacagataggtaaactaaaagcccagactccaccactacacatgcacgtaagacacctgcgctgtaccccctaaatctataaacatttttaaaaattaaaagtaaataaaattggtcctcaccatcatcccagctactcaggagactgacatgggaggatcacttgaacccaaaagttcaagaccagtttgggtaacatagtaagacccttgtctctaaaaaataaaaataaaaatattacccaggcatggcagtgtgcacctgtaattctagctgctcaggaggctgagatgggagaatcgcttgagcccaggagttggaggctgcagtgagttataatcacaccactgcactctaacctgggcaacagagccagaaccctgtctcaaatttttttaaataaaaataaaattacttaatagaacaaagaaattgttcaatttctttcactttacagttaagaaaactaagattcagagaactgatatgattaacacctacccctgactcccccacctagaataaaggtcataaaatttctccccgggccagtgagaaaaataaagtataaaaatttctccccaggcagatgagaaacagaaagagaaagtagtgagttttgtctcctgatgtcagggtcagagccacagagacttggttctggaagtatttgagagtaagaacctggctcaaggctgtgaaccagttgctgggagaggtgttgcctaccactgctggtgggaagactagaaggacatcgatattgagtaagtaagacctcaggctaccacactgcacacctacctgctaccttccggggaaccaagccaggcctctctctggctgggaaacctgttgagcaacctcctcatatttgctgccaacataagctccggttctaaatggagaacctgttgcagggtggggcagcaaaacctcaagagtgagaagagaggcaaacagcaaaatgaagtagaaagcccacgtcctcctcaacaagaaggggtctaactcaaaggaagcaggttgctggaacacgtacacagacctccatacaagaaagacatcatgtgtgtgttcaagccaccatcctccccaaagattccatcacctgttattcttacaaggaatgaaatgcagtgaggtgagagcgtgttgggatggcagacatggacgatggatgaattctcttccctctgtacattttccagcacaaagagctgccccaggctgttgaccccatacactttgagttttgaaaggtttctgtgtttcccttagaaagctactaaaccaggacaggcacagtcgttcaggcctgtaatcagcactttgcaagggtgtggcaggaggattgtttgagcccagaagttcaagaccagcctgggcaacataacaagaccttatctttacaaaatccacaaaaattagctgggtgtggtgacacatgcctatagtcccaggtacttgggaggctgagacaggaggatcgcttaaacccaggacttcaaggttgcagtgagctaagatcctaccacctcaccccagcctgggcaacagagcaaaaccttgtctcaagctgacatccttcagttcctttttgtgtccttgtcctttacaggaagatgaagatccctttcctcctactgttctttctgtgggaagccgagagccacgcagcatcaaggccgaacatcatcctggtgatggctgacgacctcggcattggagatcctgggtgctatgggaacaaaactatcaggttggtaatgcagctcctcagtaaacacatggctgtattcataggcaacagtccccgggatggttattgttgatctacagagcacagaacatgtagaaacgttcaaaaccctccaaaccatgcctggcttcatgtagatacactgagatgtaggtgtcatgaaggcaggtgtgagtttatctgtttgactatgaacagggagctggatgagctcagggagatcactaagaaggtgtgcatcacagttcttctttactaatggctacgatgctgctttccacacattcacatttccatcccttttgttcacctatttcgtcttctccttttggcatctggctttattctggttggttatgggtctgtactactctgtcctggctcatcagtgacttactctcactctcactctcactcatgcccaactctccctcttctagcccaggccctaccctgtcgtcagctatgcaggctgtcttagtctgtaaaggctgctatgacaaaatgccataggctgggtggcttctaaacaatagaaatgtattgctcatagttctggaggctggaagcccaagatcaaggcatagcagattcagcgtctggtggggacgtgcttcctggttcatagacagaaccttctcactgtgtcttcacatggtggaaggggggagggagctctctgggtcccttttataaggtcataaatcccatttacagggcttcatcctcatgacctcatcacctcccaaagaccccacctcctaataaaatcccattgagggtgagcatttcaacatctgaatctgggggggacacaaacatcgagaccatagctgacaatcaggagaggtatcatgttttaggacctcataacttgccagtaattatcaaaacagtggcaacaaggcaatcaaacgagactcgaggtcatttgacccttgggtctgaacatcctcccagaagtgggtgttttgtttctctccctctgcgtaaaatcaacctaacataagacctattttaaggacccttttgtttaaaaaggaaagtaagcccttggggagtagaatactgacattaaaatttcactttctcttcctaataatgtggagatgatggcataaaaatagttctatggagagcttcatcacatgaaagatcaatacaaactgaattaaaggagaggatgaggaaagagattatttgcttctaccagaactttcttttttctttttttcttcttcttttttttttttttttttttttgagaaggagtttcactctgtcgcccagcctggagtgtggtggcacgatctcggggatcactgcaatctctgcctactaggttgaagcaattttcctgcctcagcctcttgagtagctgggactacaggtgtgcgccaccatgcctggctaattttttgtattttttgaagagatggggtttcactatgttggccaggctggtctcaaactcctgacctcgtgatccacctgcctcggcctcccaaagtgctggggttacaggcatgagccactgcgccggcccagaactttcttgtaggatatgtgaatactaaatacctgaagccaggaatggacccattgccaagtgccatggggcgctggttattttccttccattctcttactcctcatcttctttttaacatgagaaatcttggacagtatatttaatcattgcatatcagaccaaacaaaaattaaatagattatgatattaaggaaaatctttcccacaagacatagccaaatatgtctcactttcaatctgaaactttgcatcaaatgttgctttttatttttttaagagtatattgacttatgacattgcttaaattttaaaaagcatatgcaagggtaagatctgcaattttaagagagcactttaaatgtcctcttaaaattgtaattatctttgtatgttttctgccccaccttttgcctacttttgtaaaatgtttacagatcactttatacatttgtgatatagatcttattaatttagtttttcttatcagcatcataattttattcagctttttcattttatctgtttctttaatattatgtattcctaagatatattgagatagtagataactgttcctaccaagatgtcttaattaaaaagttaaaatcaagcctttgaggttaaatctttaccaattatcaaaagaaaaaatgtctataaagccccatggaagaattcatggcaatatataccctaaatctgccttggtctctgtattagagtcccattatttctgaattacatttttcatttttatattttgtaatatcacaccccaaaatagtcacttttttttgtaggccactatagacactaggaagattaattcaaatgtaaaaacagtctctgtcttctaagcatctcaccctttaagaaaaaagcaaattagaaatattggtaattaaacacattcactaaattaataaatggtcactagtttgacattacagatgcaataaaattatttcccccttcaagctatgcatcattgcagcactactctgtgagggcactgatctagggaagccatgggaccaatgaacaagatgtatactcccaccctacaggcagccatcttgaaggggagcacaattagccatgccattgctttacagtgaagaagctgcttgtctggtggagtatggactactgttccaaatataggtcaatccccttgcataaacaaggaagggcactggaggcccatgagaattccatctgtacctggaactgaaggatggcagatgacaagccaggcagggaggaatggacctggattcctggtgaaggacgtggatatatcttgtggggtataacttggtatggtccaaaaactaaaagatattaattcctaaatgacttcccaaaatgttcagccaatccattcatagagaaaggctaaaggtatcactctacaagtgagctcataaataagtatttatgaagcataaaaaatataagccagcaaagggtatgtgggggtcgcagcatctaatttcttcactgtagtgtttgtgccttttccctggagcgtattaacccatttattgatgctcactggttgaggcacatggagtctgattattccctgtccctgggggcatgtagaaattaggcaggggctcattaaagctggttgtgggattccctttggctgtggttggaaagagaggggagtcagattgaccctggagatttctcttttggtgacacagaggtaacttaggagatgtggatcggagaagagtgaagcctcatcctcattcaccccttactttccctccctgcagtatcctatttcaaagacttggtttctctcttctaattcagggctagtgggaccaggagctcagagccctctgtaacatgaatggaccttttggggatgtcccgcctgcatcattcacacatctgcatggttttgttgtagcttgagtcttgattctgtatcacttcttccccacctcccctgcctctcatctcgcctctctttcccacataaccccagacttgcctttgctcattgagaagtttcccagtataaagagccatagacagtttcattttgaaaattatcacagagctgggcacagtggctcacgcctgtaatcccagcaatttgggaggctgaggcgggcagatcacttgaggtcaggagtttgagaccagcctggccaacatggtgaaaccctgcctctaccaaaaaatgcaaaaattagccaggcgtggtagtgtgagccgagattgcgccactgcactccagcctgggtgacagagtgagatcctgtctcaaaactaaatacatgaacaataaatgaaaatgatcacaaatgctatgattcttttgttctaggactcccaatatcgaccggttggccagtgggggagtgaaactcactcagcacctggcagcatcaccgctgtgcacaccaagcagggcagccttcatgactggccggtaccctgtccgatcaggtaacctcctatctgcatcgcaggggctgtggtcaccttcgggacagtctcccacctcgaggtatctcctggttcctaagggttgattttttcctggtccaggaatggcatcttggtcccgcactggagttttcctcttcacagcctcttcgggaggacttcccaccgatgagattacctttgctaagcttctgaaggatcaaggttattcaacagcactgataggtatggacatctatgggatgggaaccatctataggtatgggaatgggagggaggacttggacaaagttagcaaaagagtgggagaggacatcatgacagttatcttagggatgactttgctggtacactttgcataactttaaatggaaacaaaatgatttcaattgtaggttaaaacacaatgagcctatctggactactcaaatgtatagatgtgtgtgtgtgtgtgtgttgtgtgtttgtgtgtgtgtgtgcatgtgtgtatagataaatagatacttaggttatacctaatgatagatggatgaatggatagatggaagaaagcattgatgaatggatggatagatagataataggtagagaaatagctagctagctagatagacagatgcagagagagacaaaggtgagatagatgggatggatggatggatggatggatggatggatggaaggaatagatgatagctagctagctagctagctagatagatagagaaatagaaaaacagacatagatagatagatagatagatagatagatagatagatagatgcagagagggacaaagatgagatagatagatagatagatgcagagagggacaaagatgagatagatggggtagatggatggatggatgaaatagatgatgatagatatgatagatggttggatagatagatagatagatagatagatagatgttatatataaatagatgcagggagagagacaaagattacataggatggatagatagataatgaggcaattggatggatgaaatagatgatagatggaacaaatgaaagatagacatatacatagaaagaatatacaaaactattcacaccatgctattgataaagattttcattttactttccaatataaaattatgtcagaatttgtcttggttgacacacccactgattttatcatgtagatagggttgacaccttcctttttgcatgaagagcttgaatctaagcaggccataaaatgaatcctagcaaatctcagaggagcaaaatgacccttttctttcttccaacatcttgttaaaaaactatcatttttttcttttgtgaggcactcattaatttagtgatctaattaacattttataagaaattttcagaggtgcttaaaataattgctgagttactgagtgtgatttcctcatgcctcaggggtaggttctgaagtaaggattcgtttccacttttaacattcaaggaacaaaattaagttgcttctaaaactttaattttaagggcctgtctcagaaaagcatctgaccaggaaaaagaaaaaaaaaaaaacaaacttgtatttttctgtagagtgtggtttcctgcctattaaagatattagctagttttctttttggatttttatctgattggggttttttgttgttgttttgtgttgttttgttgaaatcactaaattagttcttatttcttggtagagtgagtagaggatttttatctggttgagattttgtttgtttttttgttttgttttgttggaatcgctaaattagttcttattttctggtagagtgagtaggtaataccttagcgtttgtggggaaaaaaaagtgaaaaattctagggtcctatgagcgggaaggctagcttcatgaaatagtcagaaagaacctccttttcagcatgtaggaacagaagcttggattggaatcagggtgtttattgggactgaagtgatcccccatttgtcttctcagggaaatggcaccttgggatgagctgtcacagcaagactgacttctgtcaccaccctttacatcacggcttcaattatttctatgggatctctttgaccaatctgagagactgcaagcccggagagggcagtgtcttcaccacgggcttcaagaggctggtcttcctccccctgcagatcgtcggggtcaccctccttacccttgctgcactcaattgtctggggctactccacgtgcctctaggcgtttttttcagccttctcttcctagcagccctaatcctgacccttttcttgggcttccttcattacttccggcccctgaactgcttcatgatgaggaactacgagatcattcagcagcccatgtcctatgacaatctcacccagaggctaacggtggaggcggcccagttcatacagcggtgggtattgccttgtcctctgatgctgcctgttaaaaaacattctgggttatttctcgtggaggtggaagaaccaacagggttttgttgttgttgttgtttgtggtttgttcgtttttttgagacagagtcttgctctgtcgcccaggctggagtgcagtggcgtgatctcggctcactgcaagctctgcctcccgagttcacgccattctcctgcctcagcctcctgagtagctggaactataggcgcccgccaccacacctggctaattttttgtatttttagtagagacggggtttcaccgtgttagccaggatggtctcgatctcttgacctcgtgatccgcccgcctcggcctcccaaagtgctgggattacaggcgtgagccaccacgcccagccagaactggtagggttattatgctagccacattttcccttccatgcctaacacatttcttcagccagagctcgccatagcacatgtttaatggccttagaaaggtattgcaatgcagtgtgctctccttagagtctctttgccaacattccccacatcctgggctggaaaggcccatggcaaattaatgtctgctgatgacaaaggaggtgtcagatatcccactggttttttgtttgtttgtttgtttgagagggaatctctctgtgtcgcccaggctggagtgcaagtggtgcgatcttggctcactgcaacctccacctcccaggttcaagtgattctcctgccttagccttctgagtagctgggattacaggtgcctgccaccatgcctggctaattttttttctatttttagtagagacagggtttcacaaacttggtcagtctgcattttgaactcctgacctcaggtgatccacccacctcggcctcccaaagtgctgggattacaggtgtgagccacagtacccagccccactggtctttaattttcaaatgtggccatcaagagaggcaagataatggcttatgtttagtttataggttgtccttgtgatataaacaatgtggaaagatccaaaatattttggattaatctctgagcaaacaaaacaaaacaaaaacctctgtgagtaaactgggtgaagtgaatgatgtctcttgggtctgtcaggtcccattgagtttatagttttggggattgcaatctgtaaatggaataaccatcaacagtggagcagacagcattcctgaattacataggtaggtataatatatatctatattataatacataatatagagagcataagtagatataattaagtagatattatatagaggctatgtcaaaaacacttgctattcaaaacaagcaaataaaagtattttgttccacttgtaactgtggagaacaggactctaaagagaaatggaaagttcatctgaaaatcagacgtttggtctttatggtgacttaaactctatgagagatgtaaaagagagttgggagggtgatttaaaaattataaaggagacagaggaaatataggtaatattggtttgtcatccaattaattgcatgacacaaaattgtaaaatcaatctctggattgaacaatgaatgacaatgaaaaggaagttattgtgatgaagggaaactatattagggatttaatttaaaaacaagcaaatatgctcagcctaagaagagaatacatagttaaggtatgtggaagctacataagttagggctggtgagaaaggtaaaaggtaacgtactctatgaaaattatgttgtcatttcctcacatggaagatgttgtgttcctctgtccagatcttgtgtgcctggagttgatgctttactggaggttgggaatgggcagtggttctcctcactctcttcttccagttatgaaacagcataggagcaacccattcacctggaggtacaacagtgtcctgctacccacaacatcacggattatgcaatagataaatcatagggtgtattttagtatatctctctggtatcacaaaagtgtttcatcaactctgacagaagcccacatatggtttgggtgtctgaacagactacgaagtgacttacacaaaagttgcaattgatagtatcacttcctccttctaaaaatgagacacaaatagaatgattagttcttatagttcacaccgcctctcagttttgacagattttgttaaaatctaaattgtcattgaactgtgaaatatataaactggtcattggtcattttaagtattctcagtttcagcctctgggacttggctccagagagtattctatgtactagctgcccaacggctgagggagcaccacacaatttaagtttttattttggttaacatccaacttctgctgccagtttctgtttttgtcagtgaagactgacaaaatctcagtggattaacacttgaagatttgtttcttgcccatgcaaaatctattgctggttgggtgatgctctagggaagctttgctccatgaggagactcagggatccaggttgctaatatcttgtggttctgtcatctcaatagatggccttcccagtagcgtccacaggagaaaagagttgaagggtcccttgggggctttttgttacttcactgacccaggggtcagcatgtagaccaggccccatgtctccaccctgacttgacatggggctaagaggcagtctccccatgtcttcaggaagaagaaaatgaaacggccttgctgaacatatagcagtgattttcctactgcaaacagtgattttcaaatttgttttaaagctgaggaatatttcagatgaaattttatgagaagctaagtatgtcagagggataaaagttgcagtgcttgggtgaacctggaacagaggactgcatttggaaattgctgacatttaataaagccccatggaaatctcatgaacagctggagagaaagggcagactctgcaacaaaagaataaaagaacatgtgagcaaacatctagttagtgcagactctaggcaaattaatatttaacagacatttgtaagtaaaaaaggtaggcacaccaggagaaaaatcaacaccagccttggaattttaaaaaagaattgatattacagctatgtgagtggaggttgaaggaatttgcccaaggttatagataggtgtaaactaaaggggctattttattataaaaatttggattgcagacatgtaccgcataataacattttggtcaacaatggaccacgtatatgacagaagtcccatgagattataatggagctgccttatgcagctgtacgtttgtatcttttttgtttttttgagatagagtctcgctctgttgcccaggctggggtgcagtggtgcgatctcggctcactgcaatctccccctcccgggtttcagtgattctcctgcctcagcctctgaagtagctgggattacaggtgtgtgccaccacgcccagctaatttttgtatttttaatagagacagggtttcaccatgttgaccaggctggtctcgaactcctgacctcaaatgatccacccgcctcggcctctcgaagtactgggattacaggcatgagccaccacgcccggccacgtttgtatcttttatactgtattttttcctgtaccttttctatgtgtacatatgtctagataaatacttgccattgcattgcagttgcctgcagtactcagtacagtcacatgcggtgcaggtttgtagcctaggagtaataggctttaccatatagcctgggtgtgcagtgggctataccatctaggcttgtgtaagtgcactgtacgatgtttgcagaatgatgaaattgcttaatgatacatttctcagaacatatccctgtcactatatgatgcatgtctgtacttgaagcattgatgtgaagtatactgcttattggtattttaatattttcatcagagaaaaatagagtaaagaaaatctatagtttggtgttgtgttgcgtttgtgtgtgtatatatatatgtatgtgtaaatatgtgtgtgtatatatgtgtgtgtgtttgtgtatatatatgtgtgtgtgtgctttacacacatatgtatttaatttacaaagagataaattattgaaattgatttccaagggaagctataggagatatacatgtacagcagcagcaagtattaatgtaaagaataaagaattttctgcccagggttggataatagccactaaaagtcctttaagcaactatttatagatctatcagaattcaggtaagacatgagctatttgtcatgattttcacaggtttgggctgacaggcacttgctggaggggttatgagtcgttcttgggcaatatgcctgttgtctgggtgcctgtccttggtaaacattgggatctgtgagtaaccatagctccatcatgtcatgcccatgctgacagcctgtcttacccaggtgccagagactgcagaaacctctcggattctgctcacagcaaaatggcatggtgaaggatgtcgtgcaattcctaagagaggaaggaagacttcaagctgtcagtcacactcctgaacatttatttccagtattatttgtacagagatactgcagagttagtgcccgtggtcagcccacacagccagatgcaggcattgcagggctgaccacctgcctcctgggcatggcgcttggttcagaactgtacattgtagggtggcctttgctagcctagtgtatggtggcgtataatgtaggatcactatgacttcctgcaggtagacaaagaagggaaaagggagagtccaggactacaggggtagacaagtgatacctcagactttgcataaggaaaaccccagaggtgcttattacagctgaagatggccaagatgaactctagggactgtcacagagtagttccaaatgagactttgcatcagcattttaataagcttctcaagacattctaaactgggtgtttcataggacactctaagaaacactgggtttcatatacatgtatgagctttggctactgtgcagaaacactgcagttatttgtcacctagatttttctagaaggtgatgctgacaggtgatctcatgtaaaagctttggaactttataagatacatcattcagttatatcatcatctagtaaggtgcacatagatatgtgattaaaacaaaagcttatggaaatgatctttctcttactagggtgattgccctaatattttctaccccattttattctgttttttttttttttttggtaataatctggttttggaactaattaatttcatgatgtatcaatgggtcacagtctacatgattgaccatgctcttacctagtgtgtgagctttactgtgtttgataaacaggagcacagccattccaagatggagcggcgctcttgggcctatttaaggcagaaaacaacagtgtgctgtttatcaaatttgctgggaaagctggacatccttatatcagtcttcatctaccacaaatctctcaaaacgagacaaggtggagattaatacagcgtccattatacaatggatagtcagaaatgatacttggcttccagggtgaatcaccttgtatgacatgtattttgacagaaattatttaatctattaggtatataaatattcatatgattacaagtcattttaatgggtatataattttgagaggggaccaaaacaaatttattgatcatgaggatattgaagcctgacaagttaatcttgattatctctaattattagagagctgagattttcttttagaactacagatttaagatgttctggcagcaccaaagttgaagggatggttattgaattacaacaaaaggattttttctttaaaataggtgattctagtgtagatggctattgtccacattggagcactcacagcatggttaatattagtgaaaatgctagcatcttgtacactgtgtacattcacaaacagcttcttacatactttatctgaagatacaaagatttaaagcacattgttacaatcatccttgggtagagctgtctatctgtgttagattagttatctgattcacaaaatataatatccaagggtcctgagagaatggccttgatatgttaccaaagaatcctaacattggtgacaccaccatgttcataaaacattttttcaatgtctgaagacacatttatatgtgttatttcattatccagaatatcctgagcaatttagccaggtcttaccacctttgtgagaaatggaggtagagttattcagcagccgaaaaaggaatgcctgatcaaagcaatggtagtattagtggaatttactcaaatgctttcaaatttaaaaatttccagttacaactggtgccttgtttagatattttaacatatatatatatatttgtacacagctgcttctcagttcatctgtcaaaggtggtgaggaaaatgatttaaaactcctacttctaaaatttatagcctttctctacactgtgttactgatatgatttatactcaagggtttgctcctgagatgctagcttgcaatattagggtatgaatgacaaggaggcataaggcaaagatgcttcattggtttgtgattcttgcaaatgaggtccacttagtcaaacccagtttgtggcctgggattccaagcacatattttcaagttgaggagagcgatgatttagaatgtataaccatccactccacaatccctcaccctaattgactcattcagggataaatttatctgggggagatgcttctattattagagagctggataattagctcaccatatgttatacactgtatagtaattcaggagatgggtcatcctgaatgcactttaattagccagaaatccttgctattcttgcataaaggagtgaattataaatttcttggagatacccaactctctgtatgtgccctgtagggtcatcccattatcacagctttcggttttgccatccctgtcttcattgcaatgcaaaacagatccaacttaggtgcacagcagaaatggtaacacataatgggacatgttcaagtgtaatggacaccgtggaatggttgccaattatacgtcaggtgctgtggatacacacattgttttgtgcacctcccacacccattgcttccttcacaccacataacaacctcatgaggtcggtaaatagatgtctcactgtggagaaactttgaagctgaaatcctttgaatgaacaaagctccacaggtaataaagagtagaggctgaatttaaacagaactaactcaaccttttaaattttggaatgcttcataaacagttgggggaatcttttccatctactctagtgcggtagacttattgagtgaggattagtccgagtgaggattagttggaagaagattagggcattgtatgagtgtctcaacacctttctccagatggaagagtctaggtccaatgctcaaggaaggagaatgcatctctgtaattcttatagataagtttgaagatcagtagttttatcattactatggtaatcgagaagtacctggatgctctgaagagaaaataaagcgtaaggatgatgggtgaatgtagcaagttaattttattcacaaacagcttttttctttagttcaagtcaaggctaatttttaaaaaggtgtcatgctggtgggtagaatgagattcatgttttatgtcttcaatagaaagagatggatgttggtcactctgctttgtgaaaaaacagatatgttggcctcttctctgaattcattgaaacagtgcttcattgctaggaaaaatatttaagtaaatcacttcgtgtttttctctgaagatatatacatgcccacttcgaacagtagatttccaagaatggcaatgactttatacacacctacataatctgtatagtatgttatacagttatgggatttatagatttatctggaatttgccattagtataaggttctccaggctgaagtttattaagttgtttcaatatattaaatatatgtatgtatattttgagatattttaattagaagttcaataaaagctaataagttttagtcaagctcaatgtaggataactcttgttctttatagatgaattttttcagcaaagggtttatggatagcaaatcaaaaatttggaaattatgtagagttctgtttttaatctctgacttcccggagtggtaagatctcctgttctgaaaacagtaaaccctgctccctgacaactctccacagaaaacacaccaagacatcagcatgatggaaagtatcagtaatcaaggggtgggggggaaacacctacatgaaaagattatacatttagtggagagccatggggaagaatctctcctaccatttcctatggtctgtacttttatgataaataaatactcctttctacaagcattgcttgtgtaatcataattccctaaaatctatgacagctgataaatgtattattggaagaagatatgaccttttgtcctggtctatgtactgctatcaccatttggcacagtcacaatcccgaaatgcatttattgggttcctccagcctagcctctcccacttccagctggaccccagtgtaagtggctgtgatgaatagctgtgatttggctcaaagtgtcttttgaataaagggatctttaggaggtttcattagtttcgataagagtgtaagccaggaaggaatggggtgatattgattttaattcatggtaagaaaagtaaatcagattaaacactaagagcaatatacagggacacacacagatgctcattcaaaaatggaaaaagtaaataattaaagaattatcaaagagtcacattattcaataactgcaggtaacacatgatttgtttctaacttttgtgggcctatgggatatgtatttaaaaatgagggcaacgggcacagtggctcatgcctgtaatcctagcactttgggaagcctaggtgggaggatcacttgagctcaggagttcaagaccagcctgggcaatacagcaagaccctgtgtctacaaaaaataaagaaatattagccgggcatggtggtgtgtgcctgtagtcccagctacttgggggactgagatgagaagattacttgatgccaggagttcaagaccagcctgggcaatatagtgagaccctgtctctacaaaaaatcaggaagtattagctcggcatggtcgtgcacacctgtagtcccagctactcaggaagctgaggtgggagaatctcttaagccccggagttgtaggctgcagtgagctatgattgcaccactgcactccagcctgcacaacagagcaagaccctgtctctgaaaaaaaaaaaggaggggagggcttctcttttgaatgaacctctggtttcgggctgagcatattgtaacaatacaggtactgagggatgttcgtcttttgccatactagatctagtgggtccatggcattcccaactcactggggcatagataaagaatacttacacctgaccctggaaatgcctctccagccatacatttctgtatctctgaatatcatgcctgtgaatagctcgaaagcctacatgtttatggaaatcattcacaaacactgtcatgctatgtgaaccattgaaagctacctctttctgggagcaaattctgacccctgccaggttgagataagttctcctctgaattcattctctgcagcactgagtggggcatttaagacagcttagactagctgtcaatgctcttgtctgaactgtgggttgctgatggcagggtccggtccagtctctctttatatttctggtgcctggtattgtgtgtcagcagaacatttgcttaataactgcaaaacttatagatggaagacatgaacagctgggtgtataaatccacctgctgcacgcagaggtggtcacatgaactttgtgggggttgggggtggcggttgttgataccgctatctgatttatgccatactctaattaccagcagcagaaggtagccagaaggaattcacagacatccctatttgcattcctgttattccctatgcccactgtagttggaacaatactacaataataaaggtcagacactcagatgaagattattattccgaagatcctcaaaagtatactttatggcagacagaaaaaaaatgccttagccatcttcttgtgtgaattttcactcctgcctctatagaatgtaaatcttttgattctgagattggaatgattacatgttgctggaaaggctcagggctgtcttctgtatttttaacaaatggagcgcaggcatgtagcagctgaaagttctatcttttcgcacagtgtgcaagacagtggcaataaattttcagaagagttgtttactgaagtactccagctaataaaaaaggaattaagctgttattgagaaatctttcttccaccaacttgctgatgtgtcattcagctttcaaggtcgtagagaggaagagaaacccagatctccttcctgagcctgggtttgaagcaaatggtctttcctggtctctcaaaggatatcacaaagcaagaattccttcacctgggcacaggctgtcagttacaccccaggtgtgtgcaggaaagccagtgatttatgtctgtctagccaacattcccatgcaccgttgatttcacttctgttcctgaatggtaaatcttggaacagtgtttttgcaagccaagtatgcttttctctgttttctgggtttgtttttgtatgtcaaacctaatcaactctactcgatgcacagagtatacataaagatgctggtatctctgatgtcacccctatagaataaaaaaccactgctttatagagagatgatagaaaacaagttccataaatatgtgaattttgataataaacacattaattcccttctccccttctaaggaggattcccctgcattccaagacaaaggtcatgttccgtagccttgattgaaccctgaagctcaggtctttgactcaactgttctttcagtcctcatgaaccagcttttatttcaggctttattatttgccggttgtgtcatctttatcatttatttctttatttccacctcacattttaatatgccacaattttatgatcctgccaatcatgttgatggatgtctctttcttcttcttcttcttctttttttttttttaacttttgagcaagaggactgctatccaaaattggagaatccaagtcgaaactggactggagcccagtgctgggcatttcaatccatgcaatagctcctcgttctcagcaaattctgtcactcacatcctgtatgaccatgtactatgcttgggagattgactttttaagctttcttatctattttccttaactttaaatctaaaaataaatgggagaacagatgagagtgaaattgcagtgagattgttctcatacataatgtaactctctatttaggaacacaaagactgtaatttcatgttcgttttgaggaatctaagccagtttaggggaacacaatctgcttctggggaaggaggtgcaatttgcccaggtgtgagtaaactttccccataataagtaggatggaggcttcacagtctgctctgtgtggccaagctctctaacatactgtggctccatttcagctcctccaggttcctcaagggcatcttctcttagaaggagccaaacacatggcttggtagagatgctcatatgtaagtcatcagctaggatgacaattacagtgcttccatctaagcagtagtatgtcctcttttctttctgagatctaacagtgaatgttatagaccaggtccagtgggctctcattgcatgccttcttattccagttcctgtgagaggtgagacaagccactcaggattttttttttttttaactttcttggctgtgagatattaacaacatttccttgtttcatattcttgtaaaaaaaaaaaaaggttggggggtacctaatttgccaccaagtactggaataataaaacatggtactgatgattaccaataacttgttagatttgatctgcctgttttcagagaactggggatgcctggcttagctctaacccaaagtgtgctgttttgtgctaattttctctttcaaaggagtagggggttaataaatgtaagaactgaaaagggaagtgttacagccataggtgtgagcagttcgaggagcccaaggtatattaacattagcaaaatacaaaatgcatttagaaaagcatatatccatttattgtttccagaaaaacttattagtatttgtgacacccagtccaaaatttggaatgtttttggctatcatgagaagttaaggaagccaggaatacatagaagaaaaattaatttaattacatatatatatatatatatgtagtcttctgaacttttactggctggtaaagatgtggaccataggagatgaccccttcaaagtaagaagagacttaggagagaagttctgcagagtagtccctgctctagagcaactgttacataaaccatgtcccgtcaaagtaacaaaagactgaggacagaagttctgcagaggaatctctgctctagagcaactgttacataagccacattccttcaaagtaacgagatttaggacagaagttctgcagaggaatccttgctctagagcaaccgttacataaaccacatcccttctaagtaacaagagacttaggcagaagtctaaaccatatgcaacataaaccattcacaatgcaattcacattgcattcccaaggccctgtcgttcacttgactgctgggcggggctgccaatgctcagaaagcaaatgcagtatttcatccaatagcagagatttgctgaattcatgccacctgccaatcactttgcgggtgtcaggaacaccatgatataaatgacacctcctgcctggtggtctggtgggagaagagagcacataaagagctctggtgtcgtggaacacatactttattagcatttgctaataaaaattgaatctccgggctgggtgcagtggctcatacctgtaatcccagcactttgggaggctgaggcaggaggatcacctgaggtcaggagtttcagaccagccaggccaacatggcaaaaccccatctctactaaaacaattacagaaattagctgggcatggtggtgtgcacctttaatgccagctactccagaggctgagacaagacaattgcttgaacccaggaggtagaggttgcagtgagctgagatcatgccactgcactctagcttgagcaacacagcaagactctatctcaaatataaaataataacaaaaaaataagctccagaccctacaaccatgcctggcctgtaggggatgcttaacaatattgttttagggttcccttttctgagccccaacagggaaactagagaatactgaagagaaagaggaaatgaccagcagagaatcatctcagtctcccctgaggctagccatacaaactagaatccctcttccccaaggcaagttatagagaccagaaccccttctccctcaatcaagtcataggactgaaaaataggaccaatttttcctcatcctttctatgtaaaaactggccataaagaaattccccaacctaccttgactgtgggtcctagcactcccattccagagaaggtcctaccccacacttagaaagaaggaacgctgctcagagaggccaagaacaatctagacagacaggccttgccggctttccccactcagttcattagcattagatcaggccctttttgtccaatcctatttctacatggctgtacatactttgttgaacctaagcataaaaatagtcaatttcccctttatctttgggtcttcattctcaaggctcctatgtgtacacattaaatgaatttgtatgccctttctcctattaaaaaaaaaagaaattgaattcctgcccccatccatgcattcattctctcatttgtttggcaatattattaagtatcttctacaggtcaggcatggcactagggcctggagattcagtggaaggttaatgctccatggtgctcagccctgatgggacttcctggaaaaggggaacaggctctcagaggaggtggcattggagatggcttctgaacaatgactgcttgccagggagagggggaagtaagttttaggttgagaggtgatgatgtgcagagcattgagctgtgaatgtgcaagctgtgtttgggactggttaccatattggggtagaagctgggctgtgtgagagtattggcatcaacataaggcttcgtcaggactgttcatgttttgataataaatctgaagtgtagttatttaaggaacccacccaagttcacagaagtagttaaaggaagagcttgaatcacagtaagaagaagccattggggagtgggcagtgaggcaggggctgtcattaaggtgtgtctgtcccctctaagcattgcagcttcttgcacaaatctctcagagctctcaccaaccctggggaagtggacacttgtcctgttccctgatagccttcaaaaaggcctctcacccagtattctctttcagcagaaaggaattgctaattatttcccagacgagaggtaaagattgagcctacgaggtgaaactgagacacagcactaaatgcatttctcagagggcaacccgatgtgaagaagcacccatgggacttattgatccctatcagcagactcagttgtgaaacctcataccttcgtatagcaacatcgctcacagcccattgtagcaaaggccacgcattgacagtgacttataactcttgagtatctgtgcattctaatcaattcaaatgaaggaggtttaggtgctctctgaattaaggaatatgtttgcattatcattcccctctctcgagaggtttaggccaattgaatgaatgttctatttaactttgaaaatttcagtattgaccatttagtgttcattctaggagacttgttgtattatagaagagggtagaacacaaaattgagttggagttcaaacagcattgatgaaagtaattgacaactgaaggtacacaatggaatactattcacctttaaaaagaacgtaatgctgtcatttttgacaacatggatgaacctggaggacattctgctaagttgtataagccagacacagaaagacaaatactgcaagatctcacttctatgtggaatctaagaagaaagttgaactcctagaagcagagagtagaatggcagttaccagggactggggttaggggagtggatggggaatggggacatgttggtcaaaggataaaaagttttagttagacaggaggaatagtttggggatgtattgcattacatggtgactgtagtgacttacaatgtattatatatttcaaaattgctgagagagtagattttaaatgttctcacctcaaagaaatgacaactatatgagaaaatgaatattttgattagctttatttaatcattccacatggtaaacatatattattgcactgtccccaacaagtctatacaagaattatttgtatatatcaaatgatacctatatatacaaaatttgtatatatatttgtataattgtttgcatatatcaattaaaaattttaaaaggtagtcttctctagcagtgtgtgtatgtgtatttgtgtataaatttttttcccaaagaaatactattttcaaggtgcttgaattcatattaatcaccatatagagaaggaagaacagaattaaacaacaacaacaaaaaacaaatataggcaattttctattaaatctcttcctgagttgggtctttgggggatgtctcaataacataattcttcacttactgatccatagagggtaacaataagtcacttcatagagacacaacagagacttacctttctctgacagaagataccatattaggcaattaacttgtaatattttgtgaattttcaaatagcctgctatgataataggtggatcttaatcagaatggtggcagacatacttaacattatctgtggtcttttttttcctccctttttttttttttttttgcaggaacactgagactccgttcctgcttgtcttgtcctacctccacgtgcacacagccctgttctccagcaaagactttgctggcaaaagtcaacacggagtctacggggatgctgttgaggaaatggactggagtgtgggtacgtttctcctcagtgagtgcttagaaagctgctaagtctttgcctccttgtgttttctttcctgtgtatttctatctttgttcctgatgcctttagagacagcaaatgtatggggttttttgaaagtaaccaaaaatgcattgatcctgaaaggtaaatagaatacaaaaagcaccttcaccagcctcggcaacatagggagaccccatctctacaaaaaataaaaaaaaatcagccaggtgtggtggtacatgcctgtggtcccagctaattgggaggctgaggtgggaggacgtcttgaacccaggaggttgaggctgcactgagctatgattgcaccactgcactccagcctgggtgagactgagaccttgtctcttaaaaaaaatatatatatctttaccctcttttgcatgtctgcagttcctagtggatacatttcaggggaagtctagtctgtgggctgcagatggaagagattcatggacgaaaagagacaaaactttagtccttattatcccttattctatcaacaatgaaatatgaacaatgccttgtcattagcagttaaatgtgtgatggattttggatccagaatacctgcagctggctacagccttggcgaggctctcagggcaacagtgacgagatcctcgtgttcttcttgctgcatctaacgatggcaaagctttgcttgttctccaaactccttctctcccttcctgagcaaataaccctatttctgagaaacatggcatttttcactgacattgggaagacttccttactgaagctttgtttaagttaaaatgcatgtcttccatatctacatcatcatccctatgcttttattttgtcttgcagagctcagagatcccaggatgggggattacacctggggtctcttagctgtacacagctaaggggttggctggcatgcaatctcatgctgaatgaggtagggaaggccttagtgtgtgagttacgcaaaggagtgaaaaatcagcattccagtccactcggaacttctcacaacttccagtcttttctagcagcattgcctcttacttttacattgctgggctcatctggacagtatcagagtgacagaagagatcattttgtccatattccagtactcgcccaggttcctgaagattttcatatatttgtttccttttactttttctctctctcattcttccttccatttcttttggtgaaataactcaatagtttctaatctttggatccagatgttttggaaatccatgaaagttgcttcctagttctgtttgtttgtttgtttaaagcagaaaattgatggcagtggtggtcacctactgtggtgattgtcagaacaaattttgttctgttttgttttaaatcatgaaaggagcaccttcttaagaaacaagactgggctcttcttccagcttctagatgcttctttaattatctctgtgaacttgggagatgttttacatcttcaggcctctcctctatcatcttgataggaggattcaaattaggcgagttctgaggttctttttttctctaatagtctgtgattctataaagtaatgagagtgagtaccatttgtaatactaactaggaaaaacaaaaccagaacattctctctaacaagatttataagaagaatgcattacgcttagggctcgtacatataccaatacaagcctgcctccttttattttttcctttctaaaatgttgcacataaatcaatttatatttttcgcatcttagtgtaaatcagtagaatattttctctttttaatgagtgttctattttaatgtgtcaggctgcttatgcaactctaagatttctgttggctagcaagcaacctcacgctgatctcatcacacctgttgattaaattttatttaattagcatggcatacatgcctgactcattagaaagtctaacttccagtgttgtctcactactagttcctctaaagtatttggagagtattttcaatcttcaagacctgccttagcccctgatttatagatgtttgtgttgtttttttgtttttggcggaaagataaaatccttcccctaagcattccatgaatttttaagaaagtttttgttttttaaatccaatacatatgagtgttctaaagaatatttcttctttccaagaagggcttttccttattacacaggacgggactgttggattctgaataattatgtaataaaataaaagggggatatttgcttcataagaaacactccctgcacaaaggaaaactgagatggaagcggttaactagtgagggtgcatctcagtcactcagagcatgttctctccacatgtttgagggctgtataattctgtggatcatcactttctccactgcaggtttctctaagcctggaaaggcatattcagtgaccaagaacctttattatgtaactgtacaccagttctactgcccgtgattgtggcttactgccttattcttagctgagtgagtgctgtgtctcatattgttatagtaactagagaaagactgacttcatacagatgttgtgagagctgcagaaggggcttctcagtacaaccacacaagggcagttgaaatccaggagatacaattctgctctgcaaattcacggggtggtcgacatgattttaatcatcagagtgactaacattgagagctggccgtatactgggccctgatagcacatgtatttgtgggagccataggcttttggtcccataaaggttgtcaagaaatcactggcatgaggcagattgattcataggagaaaagacatactaatttattgaatgtgcatacacaagagccttcataatgaagacccaacctcccaatggggtccagaagcttatacaccatcctgaggttacagaaaggttgggggcttgggccaggcatgggggctcacacctgtaatcccagcactttgggaggccgaagcgggcagatcacctgaggtcaggagttcgagaccagcctggccaacatggtaaaaccccatctctactaaaaatacaaaaattagccgggcatggtggtgtgcacctgtaatcccacctactggggaggctgaggcaggagaatcatttgaacctgggaggcggaggttgcagtgagccgagatcgcaccactgtactccaggaagaaaaaaaaaaaaaatatatatatatatatatatgtgtgtgtgtgtgtgtgtgtgtgtgtatgtgtgtgtgtgtgtgtgtatatgtgtgtgtgtgtgtgtatatatatgtgtgtgtatatatatgtgtgtgtgtctgtgtgtgtgtgtgtgtgtgtgtgtgtatgatgggggcttggatcctggtaaaacaggttatgcgggtcagggagaagaggagttctgttgaggggcaataaatgattgctagggagaattattggatacaggaacagagattatcttgtaatttaaatgatccttggagttagtcattgtacttggaaaagggtctcctcaggggtagtcatatcttggtcttcttttctgcaacagacaatgaaattacagggaggggaagggaaaaaaatgttctccttgtgggggtctggatcttaggtagataaaagaacttcaccttctatgggagaaactgtgtgtgggatgagggggaggttagagagacttgaggcttcttcggtttagcatgtcaaaatgcaatctttggggatatcagtttctgagtcccagcatcttacctcattttgtgctgccagtggtccctgtgcagcaggtgatgttctcatcattcgcattccacaggtaaggcaagtgaggcttgcaggttaggtacacccacctcaggttacagaattcataatgggtgagcatgagttccaatgcaggtgtcccacctagaacatgaaatctacaccactttgtttcttttctttccatgtaataagaaagcgtgcatcatgtcagtgcacaaccaacaacatatctccgggacagatctagttcattcattagtcatgttgactggatgctaactgtgtgcttaaatgttttttggcagtgtagggtgggagtggggtgcaatgatgataagactataggtttaggggagaatgttcagcctacaggatagtaagaaatttaagattctttcaggagatcctataacaactcagggcagaaagtgaggaatgtcatgagggaggtgcagataaagtgcttgaacagtttggaagcaggaagggcagtggtgctgtgcatgttggatacagcagccacatcatttcagcagggcacacccacagtggaattctttgggcaatcatggtgctattgcaaagtctgattttcaatcccagttaattctgaagcagcccaagcatcagggaagaacaaacgtgtaaaatctcattgttctccagtatacaacaagcattttggaggcgtgtcattctggctgtttctcttcctttggaaatagactgacatttttcatagacctgttcatggttgggggtcaggtggaaggatggatgtagttctcaccgggggtttcttatctacagcttacaccattatagtgatcacagctagtctgtgaagtggaatttgcatgcaatcagcattcactcagagccctgtgctattaatagaacaacatgaaggaatcataaatcagcctttgctcaggattagactagcaagttctgtactattacaaagaaaaattcaagtggagaacaagaaggtgaatgctaaaacaaatctctggcttccaatcaaagcttcctggccaggtgtggtggctcatgcctgtaatcccaggtggatcacctaaggttatcagttcaagaccagcctggccaacatggcaaaaccgcgtctctaatcaaagtacaaaacttagccaggcatggtgtcacatgcttgtaatcccagctacttgggaggctgagatggaagaatcacttgaacccgggaggcggagattggcatgagccaagattgcgcccctgcactccagcctgggcaacagagtgagattccatcaaaaaaaaaaaaaaagccttgctatggaaaaaaaaaaaagaaaaaacacccttccactgctgagagttggaatcaactgattttatgagattctttcaaacaagaatggcaagtcttcatctttagatggagttccagaagtctttgtgcatttgtcgttcagttgctcaggattggtagcttggcatcccctgttggctgagcatgacagggcaaccctcagtttgatttctctcactctcctctgccttccctgcaggaggacctggacattgctatcgtaccctctgggcacagagaaccaacctggaggaaaaataagtggtgaattcatgagatgagcttgggggatgttacagaatgaatgcgtgtttgccatgcctgacatttagtcagtcatgtgcaactcaatgtagcagcaagggccatgcacccaactcgtcttgagggatggagaataaattggaaggcctcattcgtaagagctcaggattgtgtcaagaacctcaagaaacacaagaaaactctggcaatggggaaccataggtattggtctaagcccttcaaatttgcagtgtaattttaagtagggcctggattatcagacatggttgtaatggattatccattttaaaatagactcttttaggaggtttggattaaaatgattgtgaaagtatggactgtagcatgcaatgaataacccctctgtatataggttcatttacatggacaaaagtcctctgattcaatatacgtagaagacatctacttttagaatctgtaggggccatggggaaaacttccccttcaccctctgaagtttctctaaagctcaactcacaaaacgcagattaattggagaaaagtcataaaaactatattaacctgcacacagggagcatcacagagtggctacccaaaccccctatgggataccaaagcttgtataccatattgaggttacagaaagaatgggagcttgcatcatggcagccctccgataaaataagtggtaaatggtttgtttgtttgtttgtttgtttgttcgttttgagacaggatcttgctctgtcacccaggctggagtgtagtagctcaatcttggctgactgcaacctcgacttcctgggctcaagcaatccttccactttagcctcctgagtagctgggactgcagatgcttgcccccaagcccagctaataattttattttttgtagagacaaggtctcactatgttgcccaggctggtcttgaactcctgggctcaagcgatcctcccatcttggcctcccaaggtgctaggattacaggcgtgagcctccatgcttggccagttaatgtttctttaagatctttaaagtgtaggactctcatttcgtatttcctagatctggacgagggaagtcctggttacatgaatacagagtttctgcagatgcaaatctcccccacaaaaacagctctccttgcatgctgtctgagagccatctcgcatatatgaaataaatatattttgtggtaaaatattttgatttccttcaagttctatagaccaggtacacattaggtgctcaataaggaagttttaaaagtgaaagtatggcggtcaggtgcctgatatttgcaaagcctgatccaaggtgccaggaattactaggaacacagatatgaataaggttgacttggctttctcctatatatcaaaatagtagtccaaccatgggcatggatgagattgttctgcaagaatatttcaggcagttgggcaacctgtgacccacaatttatctccatctaatccaggataagagtttagaaatcaaccttcatgtctttacttctcaaaactgtaagacccaaaaaaacaaaagcccatgttctatttgacattctttgccctatacagagtctagcctggatcttaaggctttgtatttcccttggggtgtaatgcatcacttttctatcttgaatttcttaaacattcttatttttgatcaatgcaaccctctttaaaaagtgacaataatgtgctcacttctggtgcacagtgaggatggaaggtccagtccagcatccaaaggaaggtcacggcagaaagaacctctaaaagaaaaccaaaagaacagccaaaaactgggaagacagactcagagaagtgtgatcagggaattcaggagcaaagagcatttcaacggataatgatcaataccaacgagtacttcagagacatcaagaagggctgaaaagggacaagtgaatgtaactcctgtaaattgtagaattatagtgtattacagagaatgatatttgaggagctgaggtcaatgaggttggatatttctttcaagaggaatggaagaatttgtgccaagggatgacttaccaggctttgtctgagctcatctctgcttggagaccatgaattgggtgttggcacataggtatgtggattttcagttcaatgcagggccagaaagtaggatcaccaaacttattgatgattgaagttttgctagcagggagtgtcacaaaaggcaactgggcagtggaatttgagtgattagcaacagaaggactgaagtggcagatggtggtgggggatgaggaaggaagagagctggtggcttgtgatgatgaactggagattcaaacaagattgcagcaaaggtgttggaaggctggggcagagtggaagtgtttatattccagaggttgaatcattccaggtattcccaggtgcatggcatgcctgctggatgatgaatggaaggcaagttcctggcgttggagaggtcatggaattgggaagccagagtgttcagctggtgccttcatatgactgtgcaccagcaaagatgccatgcacggctgtcctgtgattcctagggctgattatctttattcactttcatggtggaggtttatagccaggcagagagaggggatgcataatggtttacttgcataatggtttactttgtaaggaggaatgtagaaccattatggactgctcattcattaactgagcttccaatattatcaaacactcaaaattgaggcttgaaaattatttcaatcgttggttacctgccaacgtttcaggtttttaacaggtttcagggagtcagggaggtggtccatgcacactaagaaagctggcttccctctgtccagcacagacccatctgttagctcaatggcattaaggcagtattaagagctaactgctgagactatacaactagttatctcttcatagctgtggcacacatcccagtgggatgtgatgtgcagggggatgcacttggagcaataagaaatagaacgtggaagcattttgtcttaaaactcttaagaaaagcaaatgtatcccctagtctctctctcatctgcttccgcagcaatggttggatgtggtatgaattcttaaatgtgtttttaattttcattttgttttaaacatgcgcttcatagagttcaaataaagataaataaatagagcatagagccatgtgacactggctccagactagacagcatgatggaacagagcaggaagcccagaaaaagaatttcatgtaaaatgtaaatgtaaaggtgacccttcaaggcagatggctaagaatggattatacaataattgtgatggtatgattaaacttttaggagagcgattgtagttaattcactactgtctggcattgtggtgctttgcatgtgcttaaatggtataataatggtgttgtgttgatggtgatggtgatggtggtgatgctgatgatggtgatgatgatgatgatggtcatgatagtgataatgttgatgatgatatgatgggtatgatgatggcgatgctgatgatggtggtaattatgatgatagtgatgatggtggtgaagatggtgataatgatgaaaataatgaagatgaagaggaggaagcagggggacgttgtgatgctcaaaataaagaagtcaattttacaagaagtatagaagattaaagtaagttgcccaaagtcatggagatggcatatgatggctaggattttaatcttgtctgtcttacatactatgctattcttgctgttcctcatatatttaaataaattccccatgcagattgtgtttggaaaatggaagtactgaagaattccaaaaaatatattgagatatatttatctgatatacaggataattgagaaaggtctttctgagcacaaaagccaagaaataactaactcaaagagaaagattgcagaattttacttcatgaaatctaaaatctcctgatgtcaggtaaaaatataacataaactgaacaaaaagaccaatgacaaaagacttaaaaagcatgtgcatcatcaacataaaaagaaaactcctgagatataggaagagctcatacaaagcaaatgatagaaagataaatatcagaaaaagacattgattataccaatttattgtatcagttcattacacatgttctagcattgggcattatgattttaaaaaattaaatgtttgctaaaataactgaaagagatcagctctttttaaaaattacacataccacattatactgattcctgaataggtcagacttttttcttgtatttttaaaaaaataattaaactacaaaaaaaatctgttgccatttatccagtggagtcagaatctttccttaatccccaatgcttataggaggacctgatgaaatctatggccactgaatcccttatgagtctgccgctgataccatattactgttgtttcagcttacgaggcatattttaaatattcagccaacacctctcatttatgaatcccaaggcatctatgacacaatgattaaaactcaagtgaagcaacaaattgggctttattttcacactgatgtttttcttcattggaaatcccctttaggaaatgtctttcaaaaggctttaggttatctgtgtgtgtgtgtatgtatgtgtgtgtttacacatgatattttacattaaatttatctcccactcatcctaaatcacactttttaaaaaatgagtctgtgaaatctacttattttaataatgctaatgtaatgttaattccccaaagtggaaactgcagttaaaaaaaaaggaaatccattggtttattcagactgtcaactcttggtatatgcttgcagtcatagctgagctctggatcagatgaaatatgacctctgatcgtgtcattgcacacccgtattgctgagattgctgtgataatcatgaaattgcagatagacagtatcttctcagggacttttgacaggggctggtattaagcctctgctgcctaatgaaccaattttttattcaagcagatctagacaggagagaaatgaaatcatttccattacagaccactgtttacctgaatgcaacatgcataatgaggttttgaaacttcaggaaaacatctaggaggtgatgacaacctctacattgcaaaggaatgactaatacaaacccacttatgcgtgattctctttccacgattgccaaacgtatttaataaagagacagtttaaaaaccgccagttacatgcttgactgtaaagatatatagtacactttaggatatgtgctgttttgctgtttgggagtgttttgtatatactttttaaaatacaaggctttctcaaataggatagaccatttgttactggaatataattttatctagggttcttactccttttcattactgcaggaagaaaatgaatttttggtaaattgaaataaaatcacatatgtcaacattttctattgattgtcactttcagaattgtgtgtttgggaagcctttgtgagtgacaaggcgtggaatggaggagacagtagctatgagatgctcgctgactgtcccagagtttatgcttttcttgtgccttcctacgatgtctggacagctttctcttcatgcagaggcttaggatgaagtcactgagagctaaggtctatgatttaatgtagttcaagagcagagttctgggggtgagtgtgagatagcatgtcacataccactttgcaacagaaaaaaaaatttaaattgttgcctcagtcttctgtgtttttttagtgttttccacactttgtataaatgtttttctgattaccaaagtaatccgcagtatgcaaaaccgaagaatatagacacaaacagtacagaaagggaatgacccatgaaatctcacccctaaataggcagcatcattaatagtttgctggatagatttatttcttatatgttgccagtatgacatattaatatcaagatttgactattaagaatattttacacaaactctatatgctattctgcagttttttcttttcgctcaactatctatttggtcatttttccatttcaccatttcgattttcattttacctttcttagactacaatttgtttaatcattcctctgtgagggacatctgagttccttttttaaaatttttttattttttattttatttatttatttatttatttgtatttcaggtagtgctataagtgaatattctgtaaagctgtgtgaactggtgggaataattttgaaataaaaattcagccgagatcaaatttgctggatcaaagagcataaaaaatttgctttcatttgatattgcctaaaataggtatactctttttttcaccatgatagtaggatacccattgataatcaatgagaacgctaatttcctcatactcttagcaaccctggatattatcagtctctttttcatctatcgggtgaaaaatgctagttcactatttttttttctattgtgtgtagggttagtacagtgttgtatttcttctcccaaggattctttggtcacttttctattggattgtagatctttttcttattgatttgtttgcactatctatatgataagaacattaatattttacttattgtacactgcaaatatttttcctgccttttttttttgtcttttcattctatttaaagagtcttttgcaataaatttttgtagttaaaccttcatgatgtctggggcttgtaattggaagattttttttttttaaagcttttcttactcccctacaaattacaggttgagtatccaaaatactcaaatattcatccaaaatactcaggaccagaagtgtttcagatttggaatgctttcagatttgggaatatttatattatactcaccagctcagcatccctaatccaaaaatctgaaactcaaaatgctccaatgagcatttcctttgtgtgagcatcatgttgacactcaaaaagttcaggacttaggagcatctcagatttcagattttcagatgtagaatactcaacctatatgtatacaccctttcccttgtattttcacccaatatgtatatggcttcatgctttacagttagatatttcatctgtggaggaaattctgtacgtgtgtgtgtgtgtgtgtgtgtgtgtgtgtgtgtgtgtgtgtgtctgtgatggaccatgtgttatttgcctattcttgtgaatttgggtcttgattgatcagtactcttggctggtgtgggacctcttaaaacttgggtaggacaagtgttggtggcccagtgttatactttgtcttcaggtggtaggaatccagttaggatcttttctgcaagggctatgcagagggtcaccataatgaaaccactggaagccaggtggctgtagcccagtagtctcttcccatgaggtccagcattggctgattcatctagctagatccacccttgagtgggcagcaataattagttcaaacctacactgtcactgcaggagattgggagtgaagccaagctccccttgcaagtacatgaggtcctcatggtggtcgtggcatccaccagccaaatgagttaggaccacaaggagggcttcaactgctagagctgtcaagagcaacctatggtttctgggagctgctgatggcttctaacagcctcacttttggactggcttctgtagccaccatttctgggtggggttttaggaggaggtgagggtcatcaggtggttgggcttcccttggtcccatggggcagcaacagtgatttgcaacccatgtgagcaggcaggggcaaggttagggctgggaaagtagtttgcacacaggggagggtgggatggtttggtgactgtaccctccaagagctattttcctcaggtgctaccattcccacttggatgaggagcacaaagccttgaaatcaagtgaaggaggggcttttctcaattgcctccaaagggagcctcctgctttgctcccacatgtcttccccaagcagtgaggagggagcagctggctggtgctactgtgcatccttccctgacctgtgggtccttacctgtggaatctcatctgtatccaggtgtacagccatgtcccccactcagattcctatgatggtcatgaatccaggaatatgtcttttttttccttaagagatgaggtctcgttttgtcacctaggctggagtgcagtggcgtgatctcggctcactgcagcttcaagcaatcttcctgcctcagccccccaagtagcagggactataagcatgtgccaccatgcccagctaatttttgtatgtgtgtatgtattttgtagagacagggttttactatgttgcccgggctggtcttgaactcctgagctcagtcagttcacccacctcagcctcccaaaatgttgggattacagacagaatatgtttcttctagagtagttatgtcacttttgcaaagggagctaggaaaaagaaggaggcagaaattggtctatgttctccttgtttctggaatcttatgaaaccagtgctcaagctgtttagatttctgcatttagaaaagagggaagagaaatacaactcatgagatcatttgaagagaagacatttctatcccatgaatgaatgcatacttaattgaaagcagacagttcttgatctgagccctttctttggcatcatgggaccattttcaaaaaccaaaaggcccttaatggtactggcagcattaaattgggggttcagtgctgtgttgccatctcttctccttgctcttcttgtgttcactgtcacattagactgtgtcctgttgtcacgctgccgctgtcatctgctccactgataatattaatactactactaataaagttactcgttcttctctcactatatacttactgtctgccaggtgttatgcattcatagtagttctcatggcagccttctgcgaatggaactgtattatcccattttaaagatgtgtaaaccaaggtgcattggaaggcagtaactagtctcagcaagctcacaaaatcagcagattgcagaggcaacattcagagccatgtgtatatggttccgccccacacagtgtatactgggacgatgatatcataccacttctggcttcagcatattgatggcagcagcggtgccaagaaaggacagactttgtgaccagattgcatgtgattctatcccccactgaccaacctctggcggttaaatgtgggcaggtgacctctctcactgagcccccacttctttctctgtaaaatgagatcatttcattgcctttcttgctggggatgttttgaagagtgccttcggtgtattaagcactgggcaaacattcactattgttaggaagccttcacacagagcttttgttgcatcacagcgtcagttgattctcttttctgtgcatcttgactttgccgtctctcctccaagtatattttattttgctttttggtaggaaaggggagcaaatggccatagctctcttagggcacaatttcgtgtgttcgagtcttgtgacctttcgttggtttggtatctcaccatgagaaaaatggagtaaatgaaatatttccataactttgtcatctgagatcatgtgagcacgcctctctgcctgcaatctgaagagtcacttctccaacaagcctcgtggagtagaaattcaggattgctcacagagtctgctgggagctaactgtctgtcttagggtgatttctgggctcacccacttggactgcatctctcaacatggcatgcagcgcccgtggtttgggggcaacagtggcttaatgctttcttggggaggtaaacacttaggaaggaaagtttctttacaacaggattctgtaagtcattttatttgctctcaagaagtagaaaaaagagaaggttataacatagcatatactttcgtatattactccttctcagtgcaaaatggatcttgttcattgggtaccccagataccactgaagcaaaaaaattaaaacagaacaaacctctgctgtttctggcgttaccttagtgcctgccatacttaacacaaaatttcatttatttaaggtcactcacagtgagtgtaccctgactaatttagctcatcaattacttaaattttaaaacaaatactgatgctcacctaaatgaactccatttagtcagtcacggcaaaatctaactgttgcacctattcacacttccagtttgtagaaaattgttagtgaaagaacattgttgtcataattttttttttattctaaggtaagacaatagccagaacaaaacaaaaatgacaaaattacagcattttaagtcttttaactttaatcacttgaaggtggaattacctgtcaaatacctgtgccgacaatagctatttcttgtctgccaagtttcatcagtaacaaccatctataaatgcttttatgcatccgatttgttgcaagtaaatataccatactttaggaagaaaaaaacctagagaaaacaagcttctttgacaatctttgaagctttgagcgctgactttgagaaaaacgattttgttttgtttacacaacttgacattttggttttgcgtagtgctgccttgcaattaagcataggaaggagagacgtgaaatgacattacaatttatttggaaacagagagaattgccatacttacagatagagtagatgcttctgtgttactatttctttgtaactttatccttgcagaacttcccgagagggtgtcccagcatggggatgcatctgtacaaaacacagctcttgtagacaggagtgggtcttgctcagatatcgttggccaagaagggcttcagtctattcagtttgggagatggaaagggagtctttgtacagaacagtatacactgagttataacatccacaagtggtgttactgcctggatccacatcatagaatatacatccacattcatatggatttgcataaaagcatgcagcgaactacacataatatgtagcatatttccttccaccatgtctcacccaaagccagtaaatcctttagctactcatggctctgcagatggcttctgcttggtttggtccatagtcttgtcgttccttaccatgttctgcattgcatgccatgtgctttgatccactgcatgccatatgccaagttgaccattcacagaatagtcatttcctggaggaaggtctttattctaatgaaattgctcagtccctctgcttgcaattgcatcagagtcctgcttgaagcatttcttaatttaagagtattccaaagaatacttttctcactttgccactgaaccagtctagttaggactgaagatggaggtcactgggcaaggtcatcctttcagtgcatgcttcctgacttcaaactatattacaaggctacagtaaccaaaacagcatggtactggtaccacactgtctcaatgccagttgcctgatatttggcattggcttctctttgtgcttttaaagcaagagtgggtagggtggcagggcttgcctctgttttgggagggagaagaatgactttctaggtgactgctgtctaaacactagttcaatgcaacaagcctcattggctctcagttgccatctctacttccgggttagacttctgtgcccttgggcagcctcctggagtgtgatagttgaactattcatgcccctgaacatgagccccacaaaaatgtttattggacttctttacttggtactttttaaagagttgaggaatggaacttctacataaagccagtatcaactgaagtatgattaaagacaaggccggaacactagggacataaagatgagaaactcttcattgcctctcctcgactatctggtatgagtggcagtgctggagttattttccactgaattcctcaatgattctttttgtgacccatttgcccactaatttgatattccccatatgtgctgtagtcagaatatagcatgctttcaatggcattaatgttaaatcctttgctcttgcaggtgaatccacatcttcgaaaatggcatttttttttcttccatcatcctattcttgattttaaatgtatgcctcagttacacccatatggaaagctcaaagtaaaccagggtatcagaaaacccagtgataacagtgcagcaagaatgaaggatatgtagatattgtgtatgtttttcttctctctccactttctatttgagtttccagtaaatctgcatttgtgacaaaatagtaaactttgcagaaagaggtttttgcaacctcagattacagatggaaacagtacatagcaggaaaaatagcagaagggttagcttgagaccaggtgtttgaggctacaatgagctatgattgcaccactgcactccagcctgggcaacaaagtaagaccccatctctaaaataaatttaaaaaaaataaaatttgagagagatggggtaagggcattatggccagaccaaggtaggcctggagagccaaaaaaaacttttaactgtaatacatagttgaaaatccattgtatagagtattgattttggtcctctacattaatttagcttataaatcattaatctctgagtcttatcaagtctataatgatgttaccatgtttaaacatctgcaaacctaatttcaggttcttgagcctgaaactaatattatcttacctggaatttgtatctcaaattaaaattaatagtgtttaatgttgtcttataaattatttctatcgtttccatggtatcttccatttattatggtatcttccaagaagataccataagaaattatcaaagaatcaagttatcaattatcatgaccacgctaaaatggtcatgatggaatgaccattaaaagaccatttggctagttaattcagatgggattaataaaagtacatgagagcatctgaatactatcaataattagcagcaacacaattgcaccacaataataataaacatttaagacttacaatagctaaaatgcaaaagcatttagtctattttagtcacatctctaagcacaatcttagtcatgcgtctaaacatggattacttaatgtaatccctacaactatgctacaagatacttttatcatcacctctggtttaaaggcaacaaagcaaaatttggttaggttgagcaacttgtgtcaggattgcccaacagccactacactatagagcttcttggctgcatgagaagagttctggattgtgaattgaattcagacagtagacctacctggttgctggggagagtctcctgctctggagctgcaggttgtgtataagacaagtctgtttggaccaatggcctctgacagttttcttctcactcctgtattctagtattccatcaagtcctgagttcttgagtttgcctcagatactataaagatatctgggttcaaagttaaacaagggatgtggaggacagtagaagctatgggtactacaagggtgttttgggtaatgctttttctgccatctaaccattccaagcacatttaattttgctaattaagtctttcaaggcatagaaaggaacgacattagaatccatgagtttgagttaaagctgtgttctaaataatactccactgaataccaatgtgtatatttgaaaagtgaggtcaaaattaggggtcagaactagagttgaatacctgttgctttaaagtcatggcccaattatagctcagtcaaaaaaatctagtggaacattcctcctccatgaatttattcagcctgcttgaaataattgaattaattaattggattaaatgaagtaatatatttagagtagtgagcatagtgcctggcttgcaagacaggctcaataaatggtaactgctatcattattattatcattattgttatgattactcttctttccacagatgtgtaaagcatctttgcttaaaatgtgcctatacctccattacattgagtagaaaaatcatagatgagaaaacgtctataatggaaaactaagcagatatttgcatcatcttatcttttttattactagctcaccttatatttaaggtatctctggtaggacccacggtccctagaagggcccaccaatagcattggtattaaggatcttggggaaagatctgcttctctcgactaacactgcaagtccccacataaagcaaacagatcatcctggagttaggaggatattgcaaagaagctgtgactggcaaactgaaggttgcatggattaaggaggttgcaaaacataaaagatgagtttaccaaggcattaatcaatctgtccatgttttaattcaagtggaaagaaaggcttggacctgtgactgatgtacaaggtgtcagcaaaggaaaacatcattttcaattttgtatcttcagctttagagatggtaaaatccaatgcaaagacctagttgtagcatgaacgtgagtctcgatggtgtggtagagcatcataaatatgaagaattctgaagggctttgtttcccagtccattgttcatagcctctggccattctcgactcacagtcctccctcccttgtggctcagtctggaggtttaaggttgcacctccagttggatattgctggagaagttctggctgatctgtgtccagagctttgcattgacttctgtcatagaaatgatgcaatgagcatctgtgcaacctcctactccatggcacaggctgggttacctcccagggcaagttcagctgatggccataccaaacagcaaatggctgtacccgattacccaatctctatctttgcaagaagagaaagtccaggaaatacaatggcattgctggatcaagaattgaaagacagtgtgctcactttgaactctgctctttcaaaacatgtcctgctagtctgaatgcccatggctcagggaaaccactctattgtgatgtcgataaccctatggaaacgatgtccaaagtggcttcccttgagctacaggcatgctgactttgggtcttctcccagacaccggaaggagtatagttccacagaacaggtacaatgactttgttcttccccgcaccttttcccatctatgcaggaaaacactggtgtgccccatgaacgtgagaacaagttggagttatttaaattatttccagcaaatgcaacaccctggaaaacacacaagttattgttaatccaagaaaatagtggagtagatccgtgaaggcatcccagatggtgagagcagatgcaagtgcaggagggtaaatcacacattacgactgccattagggcaaagatgggtttaatggaggaaatcacaacattatcacaacaaccaggtacaacacaatataagaattaattaccaggggacaatatgaactcaggaacaaaccaaagagggaaacccagtcaagtgaagacagggttatctgtagaatggcgacattgcactcttacagttttccatgttttaagtaccctaataattccgattatatgcatagtatgattatttactatgtttgaaagttatgtgtcaaattgtctgaaactagccaagtctcattatgagcattgttactgagaactgtgaaattccagccatctctttttatatgtcaacattgattaagcatttagtcgcaggtaacctttcctctcaaagtgtggttcttgggcaggtaccatcagcattatgtaagagcttttttttttttttttagaaattctcagatccccactctaggtttactgaatcagaaccttcattttagcatggtcatgaattagccaattgaaattcaagaaacattggtatataaggtgactatactatgaaacctatatgctaagtacaaggtcttgtgtgttagtttggttcagccagcagaattctttaaaaaattgtttaagttaatctaatcagtttccgaatatcacatttgcttacttttccatagttatttaaaaaacgattagggatgtcttcttaacatgttttgaatgaaatttttatgttaacttatgacatgtgaaagtgagtaaattaataaaaagcatgatgatacacaaattaatgcatgtagtgactagttgaatgggaagatcttgcattgggtacgtccacccatcaccgtcgaagagaaatttatcctctaatccaagaacttcagagaggatgattctccatcatctatttgaggcagacaaatttgcatttattaacataaactgcccatggcagaagtttgagccccttgtctcttgctcagtcattaggggagataggagccactcttctcttgttattcaggaagtagatacagtatgtgctggagttcaccatctgcctcccagttccttagttcctgcaactctcctgcaagagtttcatttccagtgccctccttagaccttgctgtccacttggcatttgactgattgaatcccagatgaccttttatgcaggagttgcattagatccatgttgagtacagcaaagcacaacttctcctatttaactattatgccattttgcattcttctcttgaaaaaaaagggaaaagccatacaaacaccaatattccctgcagttacattgagtaggtaggaaagacttccttaataaaccccccaaaagacagcacatcacttttgtatctcaaccaacatacaaaatgcagattatcaactttatgcctttttattttggtcctatactatttttcttttatgtgtaaacttttagatttgattttatactgtagataaatcatatgctttccaatgtctgatctgaagggtcccttgagctccatatggatggaggagatcaggactaaagttttggaaatcttgaccatttatttcaggaagaagtactagattgaattcacctatatgaaatggacattgtatcaaactggagatgatacacctatttgtgcagtgacagatataccctgatgtatgggacattggtgttacttctaatcctaacaaagaattccctttctgggactagtgacagcagaatatctctgtgccactccacaatggttcaggagagcatgagaataacgctccaaaggccacatccctgaagtaacacctagcattttatatggccagcagagagtcgtagccacccccaggtggtacaattattgcaactcttatctatcttaaaattctagctttagctgaaatactggagtctcgccatctctgttggtcagatgtaggagtaacttgctcaccagcatagcttcagggagactttagggtaccattgtgccctggagttacactgagtaagtgaagaggctttcttaattattaacagtgggtgcctgtttaaggggatatctacctatctatctagcatatgtgatataaaaataaaacacctatgttttatattatatattaatattatataaaataattatatatttatatatatataaatatattttatttatatatttatatataaataaatatatttatttatatataaattattttataataattatgttatatgtatataacatatataagtatatatttatataattataatttctatataaattgtataattaaaatttatatataaagtatataaatatataaatatataattatataaaatatataaattttatataattatatataattataaaatttataattataaattatatgtaagtatataaatataaataacatgataataaatatataattatattaattaaatttagaaatattataaaacataatttacatgtatacttacaaaattataacattctatataaatttatataatatacgtataaaatatataattttatatatgtgtatataaaaatatatacacatatataatataaaacatatatacatatatgtgtgtgtgttatatataatataaaacatatctatgttatatttaatgagcctaatgcttccaaaagtataactttcatatatatatagtgacttcatagcactttgctccagtattctgtctgagtgtacctaccttgtagaagaaaaggcaaagcgaaatgaactaaaatgacaaggatttggtgaggcaagctgaggttctaactccattgtaaagttaaggaacagtgagcactccctgtacggccagtccaggatgaagtgttttgggtggaattcctcattcttccacagcaaccccctactattatccattatcacctctgacttagtggcagaggatcccagtgagaagccagagacttgggtttcaaaccaactcgcttaagtcaggacctagaagcaagaactttagcacttagtcctatgctgtggcacctcactcacctaagacctcgaattctgctttcatgtttgaaacccttctctctctgcactttgtagctcagtgcctgactcttaatagtagcttagtgcttgtttgtgggctaaataaatggaatgacagaactttctagaatttaggcttcctctgcaacccacatccacacttgacagaggaaggagccagatttttgcatttccaaggtttcttctttgggactgcaaaaggtctggttaggaagccctcacattgataagcttgttcttgttatctccagttaaataacaaagtgctcttgaaatggcttattttctatatttgtttccttcagaaaacaaaggcagaaagctttggagatagaacatttcatttacaagctataatgcagctcaccatcggcaattcaaaactatcactctatataaatcagtgtcattatatcttgagaaccttcctgagaaataatatttgcagacctctaatttataatagattgctctgaaagcaaaaataatacagcagcatttgttctcatgggagatttctgttcacagtgtttaggagggaaacatgttagacctttgtaggatcaatgttataaaaaattaaatgtcgaatgggctctgggatttacaaatgagattctggcttaagacctgagtagtatgggatccagactgtatcttttgggaaagaatgggctaaaaggaaattagaaatctgaccatttctcaggaagttgagctaaatattctaccatgcatacgtgcatggcagcctcagctactttctcttgtactaatcccagcccagttgtatagggcactttaatgaaagtgatcactctaggcaatgaagaagaaacttgatgaggacatgttaaatatcatggtcatttgaaatattggaatttggaggagatatccagggataagcattaagatggggaaggatgcaggatatttcagttgagagaatctgcataataaatgcagctgtaaatttgtctggagttaaaaataggcaagaggagaagctgtaagtaggatgtagctggccttggctttggggataagagctgtccctgaaaaactctgtgacaccccagcctttagcacacagcccgtgtaaggtgggcacttcataaacccatgttgaatgaatgcatgaggaagtctaggagtcaaaactgcatttgaaaggcatttaaaaaattaacagaaggaggctgaggcaaggggattgcctgagcccaagagtttgagaccagcccgggcaacaaactgagacccaatctctacaacgaatacaaaaaaaaaatagccaggcatggtgatactcacctgtagtcccagctacttaggaggctgaggtgggaggatcacttcagcccaagaagtagaggttgcagtgagccatgattgtgacactgcacttcagcctgggagacagagtaagaccctgtctcaaaaacaacaaaaataatagactatttttgagcagttttacatttacataaaaactgaacagaaagtaaagagtgttcatacactctcccctgcacatagtttccttattatatatattatgtattcatgtggtatatttgttacaattgagccaacattgataagctgtgattaactgaagtccatagtttccattagggttcactcttcgtgttgtatgttctgtgggtttggacaaaggtataatggcatggatccacaattacaggatcatacacagtagtttcactgcccccaaaatcctctgtgttccgcctcctcatccctcctttctcccaagcccacggtaatgactgatctgtttaaggtctctatagctttgcctttcccagaatgtcccatagctgggatcatacagtatgtagccttttcagattgactcctttcacttagaaatatcttaagatccttccatgcttttcatggctttatagctcatttctttttagctctgaaataatctttcattgtctggatgtaccacagtttatttatccattcaactgctgaagggcagtttcattgcatccaaggttttgacgattataaatagacatggtataaatatttgtgtgtgggtttttgtgtgcacatgaattattatgggagacacatttttataggaaatttctttgcagcattttctttgtgcagatacttctacatatagaaagatgaattttgtttcaaaggagggtgtatggtcatatgccctttactaaatactaactacaatacacggaagcaaattcctaagtcctctgctacctgcctaatctgtgttattttacacagaggttgttgtatgagcaaaagggggcatttttctttcaaagtataaacgggggttatagcgccttattgtttccttctatttcaactcattaagctaattaccattttcaaagtaattaggcttaaattagtgtctcagccaaacaaccccaagcccgagagcacaggtggtttgcttagctgcaccagataacaccataataaatgtctgcctgatcatgatttatcatgggagacaaattgctaaaatggccctcgggtgtcttattttttggttctgagtatgacatttacatatatggtgtgggttctgggaatgtttatcatttgagttaaaaattgagaaacattgaacatactctagcccgtggcacttgcaatcaaatagcaaaaatatgccttgccacaaatgacttggttgttgcttttgcatcagaaatcatctctgccacctccatgggcatctcactctgcagtccttctccttccccttttcgggaccaagtgggtgtgagtgcaacctggagcgaagggtctggcactgcagggtgtgatctacctgctggataggatgtattccaaatcctatatttaattatttcgactgcagaggatgcctgcggccattgtagaatatcagttgttgtggacatcctagtgtgactaagagcccacccaaaatttgattcccatgtctagaccagtgacagcatgcacacactaagaggatatgaaaaggcttattactcatataatgtggctttctgaggagagcaggtgatatggtttggctgtgtccccacccaaatctcatcttgaattgtagcacccataattcccacgtgttgtgggagggacccggtgggagataatggaatcatgggggagattttcccccatactgttctcatggtaataaataggtttcgcgagatctgatggttttatgcggggtttctgctttcgcttggctggctctctctcctgcctgctgccatgattgtgaggccttcccagccatgtgatactgtaagtcaattaaacctctttttataagttacccagtctcgggtgtgtctttattagcaacgtgagagcagactaatacagcaggttactaaaccagtacaaaaaatagcttgagagagctcggaaaagaaacggattctgctgttatggtgattagtacttggggctgggataagggtctcttgcatgcagacaggggcttgcatagttccaacctcccaccggcggtgaaggagggagcgcccaggatttcttatcagcctgcgtggcacgagcagaagagggagagatgaggcttaaaaactcttagcactcaaacattaagaaatggagtcaggctctaatataccagtcaaagcctagcagtatgcactgacttattaaattaaatcagcagcatatgactatgtagagccctgtggaaattgtacattgtctacctctagtttgcccatcattgtcttctgatttgagagctgagtgatagcttcctaatcagaaagtccatgtttcagctccttcttcaaacttcaactttcctctgtttttttcttgcagaaaattataagcatatgcagaaatgaaatagtacagttaaacctccatatgcccttcactcatatttaacagttattaactcctggctaatcttgttgaatctatatcccatactcatttattctcgccctgcattcttttgaataagacagcagctatcatgttcctcaccacctccatttcatctacgggtatttcaggatatatctctacaagattttttttctctggtgtactttttactcctctgattctcactgagtctatctattcacctgttcaggatttgagcattttgagttttcaatcagatttaattcttactttctgattcttccacttcttaagtatctgaacttgaacaaatcggccttttacagcattgttgctctacccataaaatgaagctagtgccatttactcatagggttcagtgtggtctaaacaagataatatgtaataaaattctctacatgtagacagtgctcaacagagggtagcaattattgttattattattgttgttgctattattttttgaggggttatctggaggtggtatacaatgttagttctggggaaagaaggtgaggtcaggaggaatgttgatatttgtgatggacggtttagacttggagaataactcccggttattcctctatcaatgaggaatattgatattcatgtgagggatagtttagatttgggtatctactgtaagtattaaaagagaatattctcataaaatatctatatacatatttgttcacataagaggaacatcactggtttagttttcccatccaataaagaaaaatgatagacttctttatagccttagagccaacaccagctggtgagaacaacctttcagcttctttcttctggcacctgcctccaagtggctctccatcaatgaacctggtacttttagaatactttctcaggtctccctgcagaatcacttcatgatacccagaggttcaaatggtgcttctaaatggcactcaagtcaatgaatcttggtgtctattctaagaagccagccacagccagtcttgattgcatcacgtctcatgctgggataaactccaatatgtaagaacgtttacttccaccttgagaaattagccacccactgagtagggcaaccatctccatttgctttatgaatatgcattatttttaaatggagtctttttcccctccagggcagatcttgaaccttctggatgagctgagattggctaatgataccctcatctacttcacatcggaccagggagcacatgtagaagaagtgtcttccaaaggagaaattcatggcggaagtaatgggatctataaaggtgagaaatgctgggatggagaagctctggcctctcagctcatccgctggtcacttttttcttgattttcgagcttttccatagttcttctgctactttgcaataggtaggacttccttgtgtcatggagacagtcagaaggccaaagtgaccatttctgttctggttcccacagaatttaaaagcccacatcttgtgtcaagacattagaatgagagtatgtatctccaaatgtaaatgcagcctcatataatgtaactgattaaaacaagaattcctctacacctatgtgtagatttcctgtcactactgtaacaaattgacacaaacttatgggcttaaaacaaatttatgaacttacagttctagaagtcagaagttcaagatggatatctcactggtctgaaattgagatgtctgtagggccttctacaagctcttggggggaatctgtttccttggctttttcagcttctggggacttcccactttccttggctcatggccccttcttccatgtggaaagctaacaattcactgtcttcaaacctccgtgtctgtgtccgacctgtgcttccataatctcatctccttcacttactctgacacccctgcctccctcttatgaggacacttgagattacgttcggcccacttggataatcccacatcatcttcccatctcaagatcatgaacttaatctgcaaagtgtcttttgccatggggtgtaacatattcacaggttacagggattaggacgagggcatctttgggagaccgttattctgcctacgtgaacccacaatagtattttgagctaacacttttcaaaaattttttttgcagcattagctgagccactttcatggtggattgggcatcatgctagtcattggagatatttgatgagacccagctactggcttgtatagtgtatgctctgccaatataagatagacatatatattgtctaatatatacatttagacatatcttatgtacttatacatagctaatatttaatgtctatatacattagacatatctaatgtctatcttatatgacagacattacatgacacacaacgtggcccatttcataaagtgatatgatacctaaaagggtgtatttgtgctaagggttaggactccccagccaaatctgcagtggatatgggttgaaggtacaagaagagatgacgccttaaccaaaaggggagggtgaatcacagtttacctgcaaagatatgaaaggatgatatagggaatgcttttatctatcaatttgtttagaaatattgattatcttctgtgtgtcttgcattgggccagacacaacagtaaatatataacatggtgtcttccctgaaggaagtcatgttgaactggtaggtgggtgggtagatgatgacgtgaagcctgggaagacccagtacaatttgacaagggcgctaacacttgcatgcacaagatactaatggcacaaggggaaagagagcctcacttggctgaggggttcccaggaatgtttgcaaaggagacacggctagaaaggaggtcaccagtgggtctgtgcctctgctttctttccccttctgtctctttctgctcttccaaccccttgctctcttttgtcatgctggaaagaaggagaagcagcaaatagcttgttctgcaaactgcaaggagctcagtaaggccagattacaccatacctgaggcaaagagaaatagtcctctgtagtctatccctgcagcataaggctgcaggtagcttatgaagccttatgcttctagttacgtctctgtgtgcacatctggagccctatgaccggctgagcacccatgggcaggaaccgtctcctacaccttttgttacctggcacctagcacaaaaagatgcctgttaggtgcatctggacaaccttcataggctgctcagacctcctcccagccccttcctttaggtctcattgttaccttgctcaatgcaggacacataatcaatatgtaatgtgggtttgattaatgaaccggtgtgtttaatctgaacaggattaaccccagtaggctatcactctttcagcccttctctgtgtgccatgttactttaaaagtagtaaaaagtggaaacatgtattcctaatatatgaagacttggtattaccgggctgaactggggtccactcacccagcgcagtaaggccaaacatccacaccgaggttttgcagtgggagaaaggagggtgtttatttgcagggttccaagcaagtagaatgaggcctctctcacttaagattccacttccccaatggtttgcaagcaaaggtttttaaagcctgggaggcagaggctacaggcaaagtcataagtctatacatggagattatacattggtttgacctaaaaaggcaggacatcccaaagaagggcgcccacaggttataggtggcttcaaagattccctgatttgcgattggtttaggaagtgaagctttgtctgaaaatttggggtcagcaaaaacaaacatgatatctggcctgtgggcgtggcttcctccaggccccttgggaagaaatttggaacaaagaatgtcagtcagagttcagtcctcagttcctctttacctggagcctaggtgccagcagatggcattttccatttggaaggggtccactttctgaaaaacaactatgggacatatgttaaagtgttatctgtagttattacagggaaccaaacattttatggctctaacttccttgtctattattttactctatgattaccttcttgcttatcagttgctcatttacttttcaaagctagctaggtgcctggaattttctttgaaggaactcaagatttttccttatttccctgcctgggggagtccagcaggcccctaagaggggtccctgctccatctcattggtgtttcagtcttattttcacaaggctataacctgtgtggatagagttgtttttatttcattttgtagatgccagtgtccctaaagactggagttccaggctgcattccacgctctagttcatccattcattcattctctctcttagtgcctgttcagttccaaaatagcttagcagctgccgaggaggagacgtgtacatcaatcacaattctagaagtggttggagagtaatagttacttaagaaagttacctatggaaggctatagagccccagggcagggagaggggacccctgactgacaatcccggggaagtttcatgggacagagaaggagctgcatcacgttttgcacagatagttcaccagggttcagagacacgagaggtatagatcagaaagggagcctcaatggtcttgaataatggttgggaaccccagttttatcatacaaccctgcaagcatgtcaggagctactccataaatttcttttttttttaaagaaatgtatttgatgtattagaaatgttttgcttgcatgctggagagaccatgaatgtgtaacatgattaatgtctcagccaccgctctattgcaaagtattatccttttgtcaacttatttgaaatcaagttcacagtgaaacactgttaaaatacaatgccctaaaaggaagatggggtttccttctagttatgggaagtaggcttctgagtgtcaagtgtcaagatatcttgttctctagagctgcaaactcgaacacatacctgtggtttacgcagacacagagaaatcataggatttaacaccctgtttaaaatagcatcctttctaaacaatgatgacttctactgtccatcaaaacccttcaaaggactttgctatttgaacttttttttttccttttgagagaatctcgctctgccacccaggctacagtgcagcggagccatctcggtatttgaacttaatgattctactgtattcccaagtcaaatctgtttccctggtgaaatctatgggcttcatcaatgacagagtggataaagaaaatgtggtatatatacaccatggaatactgtgaagccataaaaaagaatgagatcatgtcttttgtaacttggatggagctggaggctattatccttcgcaaactaataatgcaggaacagaaaatcaaataccacatgttctcacttataagtgagagctaaatgatgagaacttatgaacacataaaaggaaacaacagagactggggtctatttgagaggggagggtgggaggagggaaaggagcaggaaagatcactattgggtactaggcttaatacctgtgtgattaaataatttgtacaccaaacccccatgacatgagtttacctatgtaacaaaccaaccttcacgtgaatcctcaaacctaaaataagttaaacataaataaataaataaaataaaatataccagacttcttgttaaaaaaaaaatctatgggctaaatttggtagaatggctaggattaaatcatccttccattaaattcaataggttattccttttaataagaggtacattacatgtctgctgcagtctacatttaaaaaacaattatctaatattccaggggtgagggagtaataataggactgtttcatttctttaaggaaatgactttgcagtatgattattctgtttaggtttggatatgggtaaattttgtctttgtcaaaatgttctagcataaagggaaattgggaaataagggtagggtcaaatgtatactttggatataattctggtcaaagtttagaaatcttggcagtaagtcctttatacagtagttcctaaaatatttccctctgagacccttctaaaataaattttcttctattgtccacatgctttgaatgattgtgtcaacctaataaaaccaattttctaaggaataatttatcttcccatttaataattaagaaatcattatctccattagggcttccacttaatttgactgtgttccataccatgtgattatgattttcatagacagcaagataaataagtaaaccactgaacatcccatagcctgtgaccctttgtagctgttaaatgtaaaattttccatcagggctgttgacatttgaaaatgttcacattgcttctttgggaccttaggagtagaaaccattgcttgaaactaatagaggatttaagatttctatgcaatccttaactctttctaggaaatttagtttatggctctcaatttatgttcctacaccctggacaggtattggatctatttggatcagcctggtgggtgagtcttgagaagacgcttcattctgcacttgtatctgtgtcaaggcagtagaacagaaaggagttcaagctgagagtcctgcaaattgcagttctcttattgaaggagcaagtggccccacccctagcttcacttttctaaatcagggttcaaagcctttgagcctctctttgcatgaggagttgcaaacaaattcatggaagtttcttctcaaccttcactgcagctgcttctcacctgatccacctctcaatgttgaagacctccagggctctgtcctgggcccccttccctttatcttcacacttgccctatctgatgtcatccaaatccaggacgtcatatgacatccaactgcagggcatcccacatacagagccgggaccctgctgtggaggtccacattgctatgttcagctgcccacttgccacatgacctggaagctcagtaggcatgtcatctcggaaagatgcaagctagacatcaaatgcaagctagcccaagcccacacatgcccaaatctgcatgatcttattgaatgctttaccccgtgactgaacctcagtgctacgatatttgctggttgatgggcttgttttattttgcctctctttaacccctatgtatcccatattttggaatcacatcctattcactttattttctaagtttatctgacattggtcatcttttgtcagctgtatcaattttccatcttgtccaggccactgtggtctgccctttggacttctccagtgtgcttcttggtggtctccctaattctttgttctcacactccgttctctacccagacactggagtgagctttcgtaaacatagtgtcaatgtactctattgaatttctgaggactgacataactgttagcaccacaaactgggtgacttaaaaacagcagaaagttgttttctctcagttctgggggccaggagtctgaaagcaagctgctggaagtggtgggctccctacgaaacctctaggggagaatcctttgttgttctgccattaattcttaaccttccttgacttgtagatgtgtcactccaatctctgcctccaccttcacatggcttttttcctttcttcaaacactctaatatcaaccagccatggtggctcacacctgtaatcccagcactttgggaggctgagatgggaggatcacttgagctcaggagtcggagcccagcctgggcaacatagtgagaccttgtctctacaaaaaacatgtaaaaattagctggctgttgtgttgcacacctgtagtccaagctactgaggaggctagggtgggaggatcacttgagcccaggagtttgaatctgcagtgagctatgattgcaccactgcactccaggctggtcaacagagggagaccactgtctctacaaaaaaacagtttaaaaaacaaaattaaccaggggtggtggtacacatctggagtcctagctactcaggaggctgaggtaagaggatcgcttgagcccaggaagtcgaggctgcagtgagctatgattgcaccactacactccagcctgggcaacagagcaagaccctgtctcaaacaaacaaacaaacaaacagaacaaaaaaccactccaatatcttctcatccactgaaaatacaatgtgaagtctgcaccccagctgtacagttttctcctcctctcttcctggcttttcctgggtcccccaaccccttcatcttgttcccacctcagagtctttgtgttagaaactcatccttccatctcatctttggatggattttatctttcactcatatgttgcctttgtaaggtctccctggaccaccaaatcaaaagtccttgtctctcccaccactttattctaattgctcgcatctctgataacttacctgtttattattttatttgctcatagtccttctcccatggaagctggaatctgggctgcctcatttaccactgtgtcctagtgccttgagtaaccatggagtaggcattcaataagaacttactgaatgagtagggatatggtttggctgtgtccccatcaaaatctcatcttgaattgtagctcccataatccccacatgtcatgggaggcacctggtcagaggtaattgaatcatgggggcgggtctttcctgtgctgttctcgtgataatgaataagtctcatgagatctgatggttttataaagggcagttccccttcacacactctcttgcctgatgccatgtaagacatgcctttgcttctccctcacctcccgccatgattttgaggccccctagccatgtggaactgtgagtccattaaaacttgttctttataaattacctagtctcagatatttcttcatagaagtatgaaaatggactaatacaaatagtgaacacttctcagatttctcttccttctgtctccttctctccctatttcttccctttctcctaaaatatcccttagatgggaccagaataacttccttaagattttcttttagttgagtttagagttgtttgccttttcctcatactacaagatttccttattctcagaacagaacagttaaactcatatgtctggcttcatttccatccctctcccaagtcaaggtcaccctgaaggaggctcttcctccctccctttttctctgcctacaggcaagtaataaatgtcaatggaatggataaattaactctatagatggcttctgcagaagtgtgggggtgggggatcatattttccagagtgttcaagaatatatacttttttttcatgtgcagagaaatgcttttaaaattccctgatggctgcatggaaggcactgctcttcaggcattttttccttaccttaaggccaaattccaaacacgtggcttgagtccatgtcacttatgagttgcttcttacagtcactgattttgacatctcttcctgtcattcaataacacagctttctgagagcaattgatacttttattgtgagagaaaaatagtagcaactgactctggtagattattacaaggtagttatgttcaaatgatgttggcaaacattgtcattggcttcccaagagtaggcaaagctgcctcttcatgctagtgtcagtatttagtcctccagcaggtatccacagccttttaacctttgaaagatcacatcagtctcatttatgtgttcatgcatttggtttaattttactggcatgcatttatatattgattctatagaacatgccaggcacagggctagctgatagggtataaaggcaaagaataaagggtctccgactgctactaatttacattctactagaagctagtagcttaaattctactaaaagacagaatgcctctaaattctactagtttttaggatagatatataagagaccacttcagtgtaatgtactggtaagggaactgttaaagaatggtaaaggcagttagcccaacttgggaattcagagaaccttccaggaggagctgacattttgcaggttgacgttttgcattgttggctaggagaggacaggtgggaagtacacagtaggcaggtgtgaaatacttatggggagcgaaaaagcagctcagtatttctagggatgaaaatgtagctgggcgcagtggcttatacctgtaatttcatcactttgggaggccaaggcagaaggatcgcttgagcccaggagttcgagaccagtctgggcagcatagttagaccccatctctaaaaaacagatttaaaaattagtcagatgtgatggcatgtgcttgcagtccagctactccagaggcttgagatgggaggatcagtggagcctgggaggtggaggctgcagtgagacttgattgcaccactgcactccagcctgggtaacaaagtgagatcctgtctcaaaaaaaaagtgtgagcaaggactgacagtgtcaggtgatggagacttggtatcatgtccgggcattgagctctgccttgtgggttatctgagctgggagtagggaccagacagatgggttaacattagtgaacaccctgaaaatggaagggccatttggaatgattgggactgtccactttagcagaaaatgcaactgctggatcaccactgtctcaggcattgccgtaggcagagtgatttgattgcattggcttcagttgacaaaatgtatgaccttaatactacacagttaaatgtggcagagcttgcacctgttgttgaaaaagtcacatggacaggcaggagattgtgatcccgtaatgggaggcttgaatttctcacttttgagatgggcaagattgaagttgtgtggtcaagcgtgctctgcaggagagaaaggttgggattccgggacagcaaagaggtgggaaagtgagaaggatgtggccacggtgggtaactgggctctgtgagggcagggagtgggcatagctcatgcttatgggctcattttctttgatgacatgcagggagagtttctcttttgatagtcaaaggtcaagctgtttagtatatgactggtggagaaaattttaggaatgcaatgtattagggaaatgaaacatttagcaaaatagagaccagaagaggttagacataggaatttgtaatcacattcacctataggcttctgtttttttcccacagtaatacgcttcattgattaattcattatttcatttatttcacaaaatatattgagtaccatctatttggaagggatttcactattactttagttgatttaacagtgcattagacagtttgttctcaaatactgttgatactgttggaatgagacatgcatagaattggttgtcatatgtcccataaacttgaacttgaaaaatactgtggaaattgaaagttgaaaaataatatgtgatcatagaaggcttaatgaaatcggagaggcttgttatctaggcttttaaggagctttgtaaatgatttgggtgtgggggctgtattagtcagggttctctggaggaacaggactaataggatagatgtctatatgaaagggagtttattaggagaattgactcacacaatcacaaggtgaagtcccacaatgggctgtctgcaagctgaggagccagaaagccagtccgagttccaaaacctcaaaagtagggaagctgatgatagtgcagcctttggtctgtggtcgaaggtccgagagcccctggcaaatcactggtgtaagcccaggaatccaaaacctgaagaacttggagtctgatattcaaggacaggaagcatccagcatgggagaaagatgtaggctggaagactcagccagtctagtccttccacgttcttctgcctgctttatcctagctacatgggcagctgatgagatggtgcccacccagattgagggtgggtctgcctctcccagcccactgactcaaatgttaatctcttttggcaacaccttcacagacacagccaggaacaatactttacatccttcaatccaatcaagttgacactcaatattaaccatcccagggtcaaatcctagcagagcaaccatcaagagggagcagcagaactttccggagagcagaggatgagctgttgaccaggacattttcgtgggactcagctcaaccaaggtgtgatgttggaaaggtggaccccagtcaggacatggttagcttcgcattccagagtaagatgtattttttagtttttcattcttgcagacaatattaagtatgagttcaattaagtgacaagaaaaatgttagtagaagttgctgtgacacttccccccgatgctgaaggatttaatattatggagtaaggtccaagttggtgtgctcaccccaccccaaaaaatcaaaatttagtaaattagaacaggactggcctagctgtagcatgtgggcctaatgcaaaccagcccttgattttctaaataaagttttattgaaacccagctgtgctcatttgtggatgtctcattcctggctgcttcttaattacaacagcagagttgagtagttgagaaagccacccaaagagcctgaaatatttactacctggctctttagagaaaaagtttgccaacccttgacttagattccttagcagttggatgtattgcttgatgagtcattcttaatcatttgacctgtgtcaattaattttaaggatattcttcaattcttgacatgttatttaggaactgatatcaccaggttccttatttttgccttcataatagatgggtaatacgttggtggaacctgaaaaatattgttatatttcccatctgcaattcatgggttttagtctttggcatgaataaatcaaggagagtataaaatgtagcatcttgggtgagaaaacatttcccgtgaattatcatcacacacttcaacggggtttgcctcaattcagagaattagtgttatctcagatgggaagatttgaggagaaaaatgaaaaacaatatttcataaaactctgcccagatcaagcataagaatgactagcatatgctcttgccattaaaagtgatttgacctgctgtgtggtagcattcagaaggacaaaaatagaagcctggtttgcaaacagctgtttctaacaagagtctttgagtaaattgtagaagaatcctcgctacgcttgcctagagagattgagtaactcagccatcatccttctgtgatgagaacatcatcacaacatgccatcaagatgttaaaactgtgaattggacaattactctacaaaaagttaaacttagaccatggctttttctctgctcataaattttcagaaaaaatagttcatactccttcacctgtttttttttttctttcccccatatcccattctccaactttcctaagtttatttctccttcaaaacccaagtcaaaatctattggcacagggcaggtttgcccaggtaaaagacatttctttttattttggttggtgtttaatcagagttatctgtgggcatatcttttggtttgtttgtttgtttgtttgtttgtttgtttaaggcagcgtttcactttgtcacccaggctagggtgcagtggcgtgatcacagctcactatggcctcaacctcccaggcttacccaatcctcctgcctcagcctcccatgtagctgggactagaggcatgcaccaccatgcttggcttttttatttcttattttttgtagactgggtctcactgtgttgcccagcctggtctcaaaccccgacctcaagtgatcctcctacctcagtctcccaaagtgttgggattacaggtgtgagccactgtgcctggcctgtggatatatctgagctgtcttttgagacctttaatttctgtagggcaaggtccctcttcactgtgttctctctgggattctgttggcatacaatcagagttctcagtgggtattatctgagctatcttttgaggctgtgagtttctgtagggcgtaatctccattgtatatctttgtgtcccatttggggatgtgaaaatcagtaaagcctagcatttggcaggacaggttctagaactatacctaataccatcaattactggctgtgtaacctttgccaaagttttcttggctgtgaaatgggttacttgccttgcagagtcatggtgagaatcaagagttaataaagtcacgagtttgaatggtttggggaacatgtgaaactccatcattagtcctgatcatagcaagtcattgcttattaaatgtctgctgaatgaatgaagcatcccgtgtccaccctctgagttcctctaaactctgctcgatgataatgtgagtggtgcccgggagagcagatttcggtgctttttcagcctgacagacacatttggcgcatctcgctttccacacaatatcgcaggaggaaggagactcaaagctacaccatctgacaagcaagggcacttgctcatcaacacatgcctgcaaatgtgtgatcatgcttcctccaacatgtttttccataggcagtgtgtgctcggatgtgtttatcatctgttaaaaaaattttaaaacatttttttgccatgactgttgtaaaaactctccctttatagctttagaaaattgcacaagattatgtttatggatacatttctttaggacctgaatatagactcagaactattaatacaagatgggaatctcgtgatgttccacatagtgggttcagagcttccaacagagcgtttctcgggtgtgacaatttgttaacactagctgcagatgaaaccatgcctggtgctaccattcaggtggtcagtaggtggctagatctaggggctacaggcacagctgcccccatagtccagtgcctgcaatagaggtgctctgtgcatcttacctgagcaggggtaagctacttctttgcacccaagcagaagtattgccaccaggtggccatttgtggcttggagctcctttgggaatctggaatctctggcaggctgtgatatttccagggcctctgcaggagatttgttttattttgctttgttttcaaagtggttatacatcaagccatgttctcataagatgtctcttccatcacctggagttctgggatattagcaaattcctcagaggggaatagatcactggcacttgggttgtaaaatacacagacattggatgtgcctgtggatttttgtgaaactatgtgctttgttttctgttttttaagacatgacgtctctctctgtcacccaggctggagtgcagggacacaatcatagctcactgcagcctcaaactcccagtttcaagcagtcctcccccctgagtagctgggactacaggtgtgtgccaccacacctggctatttttttaattattattaatatttttttgtagagatggcatctcaccatggtgccaagactggtcttgaactcctggtctcaagcatctcacctgcctaggcctctcaaagtgctggaattacagacatgagccactgcacccagccactatctgctgtttaagggccatgtttttcagccactctgtcaagtggctctacagccaggtgcatcccttggcttcccctggtgagcccctagtaaaccatcctcagacattgcctttcaccctaaagatgatgtacagatcaactcctgggagggtacgaaattcgctcggtgcctcagtccttaattctactgttcacatgtatctttctgagtttctacatagggtgtagaaactaaatgtggtttacaaatatggtgtgatcctcttctttcaggacatagacaacttggcaccagtgctcttgctgcaaagataaagtgatattggagaactgtttaaattcacaggctttggagtcagtcagacaaacctggatttctatctgtaactctaccgcttactaaataagtgacagtcagcacataactgaagttctctcagcctcagattgtgcaactattttatatatatatatttttatatgtatatttatatatatattttatatatatgtatatatatttatatatatatttttatatatatatttatatatatttatatatatatttatatattatatatatttatatatatattttatatatattttatatatagttatatatattttttgtattttatataagtattattttatatatatttttattatatatttatatattttttattatatatattttattttatatatatataaaatattaaaatgttatgaatgagtttagattgatggagaattacaaaggtagtacagaggtatatttttcacccagctatctgcaatcttaccatcctacacaactatggtgtatttgtcaaaattaaccttcacatgttaccagctttcccattaatgccctttctctgtttcagaatcaatacacaatgccacgttacatctagaagattaacttttagagggtgctttttcctgatttaatagtttggtttttgttcctgtttatttatgctgttttatttaaaacaagggggcaatatgtgtatatctaaaccattaatgaaatcagcccttttttgttgtatagcgatcacttattttgttgttaaatttaaagtgaagatggtgtgagtttgatcgagtagcaggataagcaggtgaaaattttatgagtttgatggaacagaaggaaaactagacagtaattcacacgttgagattcctcccaaagatctgctttcaactgcttgaatgaactacggcaaagtagttaaacttcccatttgttggctgtgatgtctgtgaagcaggaatcacagtatctgtcagagaattaccttcaagtgatgttgaaaggataaaataaggggaagagttttaactttcttaggaggccatcacagaaactacaaagtatgatgtgaacttccataggaatctcccctaagtgactgtgcatatagaatgtctgaatatctgcaaaggtcagagcctgctgaggagactacagtcttcagctgtaagaaatgagcttttaactattcacaatagcaaagacatggagtcaaccaaaatacccatcaacagtggactagataaagaaaatgtggtacatacacaccatggaatactatgcagccataaaaaagaatgagatcctgtcctttgcagcaacatagatggagctggaggccactatcctaaaagaattaatgcacgaacctaaaaccaaattctgcatgttctcacttataagtgggagctaaacattgagtaaacatggacacaatgaagggaacaacagactctggggcctacttgagagtggagggaaagaggaggagggagaggattgaaaaactaaatatcaggtactatgctgattagctgtgtgatgagataatctgcacaccaaactcccaagccatgcagattacctatataacaaacctgcacatgtacccctgaacctaaaataaataaaagtaaatacataaacaaatacatacatagataaataatgtaacatctgaaaaacacactagagcagagtgcaataaaaggaggcattcctgtaaaggttagaaaaacaaagagaaagagatgagcttttaacaatggaaatttgcttcaggacccctgaaacctctgtttctagtaatttacttcctaaatataagtggcatttatttccagttgactcacacatgatattcctgcaaggaatgagcattttttcattggcttcgttctcacttaactgtctatttaatgcttcacaccaattgtttaaaacagcctcttttttgagtagctgaacttcaactccactccctttgtccccagcctaaattcctgacggctacttcagtgccccttagccctatgctgtctttgtcatgaagggtgaggaagcagtgtttattcccccagcgatgggtcacctgcccagctggagtgacctcagccctggcctgtctgagccctatactggagcacttggtctccatccctcaacgggaggtgttggtcatataggggccacaggaaaactgcccctttgccctctgaaggtttgctaaaaatcagctgacaaaggcaactgagaaaaggcacacaaatttattcacgtgcgtggagccttacaaaatagatctcaaagaaatggctggatggttgatgcttttacaccatcttgaggttacagaaagaatggggccttgcctcctggcaacacaggttaggagaggggagaagaggacgcctggctagcagaggtggtcttgttatgcagatgagacctcctgtgtagcagtccacagagagaagagatggtgaatgtttcttgcagacctttaaaggtatgtgtctctcagttcatctttcctggatcggacaacggaggccttcagagaaagcctggctgcctcaatgcagattctctctctctctctctttttcttttctgagacagatgctcactctgttacacaggctagagtgcactggtgagatcttggctcactgcaacctccacctcccgggttcaagcaattctcgtgcctcatcctcccaagtagctgggattataggcgtgcgccaccacgcctggctaatttttgtatttttagtagagacatgatttcaccatgttggccaggttggtcttcaactgctgacctcaggtgatccacccgtcttggcctcctaaagtgctgggattacaggtgtgagccattatgcccagccagattttctctatagattcaaacctcctctacaaaagacagttttgcagggctgcttctgtttgcagaccctgtgaacatccatctcaaaatatgtcaaagaagagtattttggggtgaaatattttggttccttcagtgaccatcttctgagattatctgctgacattctgatccactctgaactcacccttcctgcctctgccggtaccctttcgatgctgtatttaattatattctaattgcttcataggcaccaagcctgtttcctcaactctcctggttaagagccatcctggtaataaaataataccaacgaagataatagccattttttgtgcctctcttgcaggcactgagcttggcagttgggataatcattccatgtaataatcacgtggaaacatagtgggaatatgagatacagaaagctgaagctattttctcaagtgcaaagggctggtgtatctgtttcctatgtccgttgtaatcattgaccacaaatttagtggctcaaaacaacatgttttttttttttaatttttagattcagtgggtacgtgtgctggtgtgttacatgggtatattgcattatgctgaggtttggggttctaatgatcctgtcatccaagtagtgaacatagtacctgatagtttttcactccttgacctcctccctctttcccccctagtagttcccagtgtctactgttgccaactttatgtttatgagtactgaatgtttagctcccacttataagtaagaacatgcagtgtttgattttctgttcctgcattaattcacttaggataatggcctctagctataccatgttgctacaaaggacaatattttgttcttttttatggctgtgtagtattccatgatgtatatgtgccacattttctttatccaatccctgtcgatgggcacctggattaatttcatgtctgctattgtgaatagtgcagcaatgaacatacaggtaaaggtatctttttggtagaataatttattttcctttgggaataaccatgaattaaatgggtcctcaaggtgttggcagggctatgtttcttgctgaaagctctaggggagaatcttattccttgccttatccaacttctagagcctgcctgcattcctgggcttggggtgcccttctctgcctttaaagtcagcagcatagcatcttccagcctctctctgtgattacacccctccacttctctgactccctctttcccttgaaagaaccctgtctacaaaaagagtcagactctgtaaaacgtttgaagagattcattctgagccaagttgacacagccccgggagatcctaagaatatgtacctaagttgttctggctacagcttgatttatacattttagggagacatacagcattagtcaatatatgtaagatgtacattgttcagtctggaaaggtagcatgagtcaaaatcggggggtggggggtgaggaggcttcaggtcataggtggactcaaagaatttctgattggcagttggttgaaagagttgatttaaagacctgcagtcaatagaagggagtgtctgggttaaaataagggggttgtggaggccaaggttcttatgatgcagatgaaacctccacgtagcaggcttcagagagaacagattgtacgtgtttcttatcagactttaaaagataccagactcttggtcagttctctcccggatcagggagaagaccccaaaagagaaggagattgtctacagaatgtagattttctgcacaagagacagctttgtggggctattttgaaatatgtcaaataaatatattttggggtaaactacttcaatttctatcagggcctgctatctgtcgtgttggtatcttatggctacaaacagtctgttttgtcagtcttaaggtctgtgttttaatgctaatgctggtcagttgtacctgaattccaaaagaaggagggtaaaatgaggcatgtccaatcccctgtttccatcatggactgaactagtgtttcaggttaaacctttagaatgccctttgctgagaggaggtgtctattctgttagtcgaggggcttagaattttatttttggtttacaaccctatgattatattagatccactcagacaatgcagggtaatctcctcatctcaaaatccttagtcacatgtttaaagtcccttttgccatataaggcaaaatacccatttccccaggctccaggctccaggaatttggatgcggacacttgggggcaccattattttgcctgccacagctggtgtaaagtagaaatggaacttgaattccctgactccagagtcattgatttgaatctttggtgactcaaatctttgttgcgttgagtccctctgattacaaagtttttgttcaagatgccatacagtgctgaccatgtcacatatggtggtgactgtatcatatatattccttttttcaatacaacatatactatattgctcatggaatactcatagatggaatctatgtaattagagcagttggttcttctacattgagcacgaaagagtccattgaagtgagcattgaaaggattgaaatctccctgttgcctcttacctcttttttgatcttttaggaggaaaagcaaacaactgggaaggaggtatccgggttccaggcatccttcgttggcccagggtgatacaggctggccagaagattgatgagcccactagcaacatggacatatttcctacagtagccaagctggctggagctcccttgcctgaggacaggtactctgatgccagggtggttggtattgttgagctctgatttcacagcccagtatgctctggtttgcctgcataatggtgtggggaccaaggcctttggccccctggagttttcctgaaaatcacaggtttgaggcaggtcaattaataggataaaaggcatatacatttacttaatgtgtacacagcaggcttccaaaggaagacccaaagatacaggggaaattgttcatttttttgctgtggttcagcaaagtatgggcagtgtgtagaagtaggattggagggaaaggtctgacctcatgctaacggactgagtggggaaacccagccaggcctgtctatctagatgcttcttggcctctctgagcagttttccttccttctgggcatggggcagggccctctctggaacgggggtcttatgacctacagtcaaacaaagtaggtcagaggatttatttatgggcagtttttacacagaaaggcagggggaaagttggagtcatatttttaggtttgatgctggctttggggatcaggggttttggttcttacgacctgcattggggaagagggattctagtttctctggcgccttggggtagagtgggactgagagacaggagggcaggagaaagtcagaggaaaactgcactgaggccactgctgaggccctcggtttggagtgtcacgatgcctccagctgtacttgttatctctgtccggtctggggccttactggtgggtttgccaatgtaaaaacccctctgccaatctctttatccagagggaaataaactcagaggcactgaaggtttttagtgaccaggaatgtggacgggtggtgtttaattcagccttggtctttcggcatcgtgctgacgctcttctcgtctgttcaccccaccgtagcttgccattgtgcagcttggccacaacctctttgacctccaactttgggatcccacaccttttcctttgtccacactcagcagccctttgctgtaacagggagaaatgcagccgggtccccagctaaggccccatttcccagcacgtcttcactgagaagttctaaatgaaatgtctttctcttaaatttaaatacgacttcatatgacattgccagtggtttcttcctaagtgttattaccaatctgaagagttttaagtgaagcacactgattaattgttttcattagtttggtgacagaccaggcgaatgtcacgcaggcggctgcaaatcttgtttaaattcagctgtaatgagaaggaagaggaaaggggaaaggaaagacaaaaacagccacgctgccaaagcaagtccagagatgggtttcctcccctcccgctgtattcgaccttgtttccttactggtttcaactctgctttaggtatacacccttcctcaacacacacacagacacacacaccaatgagaaatgcagcgttgacagttcaactattctcaaactttgaggtctcaaaaccccttttcattcttccatgatcgaggaccccagtgatcttttcctgatgtggattgtattgagcgacgcttattatattagtaataaaaaatgaaattttttaaggcaccaaagtactccaagctcacattccattggctaatacatcgatgatgtcatcatttaccctgtggccacaaggaatgtccattgtacactcctaaaaaggtgatagtgagaaagacaaagagtgccttcctattgttataaaaataacattggcctcgcagacctcctgaaagggtcccagagagtctctggatcacgctttgagactagtgggtgctatggctaagagtggagattctagacctttctagacctgcactggttgaattcatattctttttttttttcttttttttttttgagatgggggtttcactctgtcacccaggctggagtgcagtggcgcgatctcagctcactgcaacctgcgactcccaagctcaagcgatcctcccaccccagcctcccgagtagttgggaccacaagcatgcaccaccacgcccagttaattttttgtatttttggtagtgacagggtttcaccatgttgccaaagctggtcttgaagtcttgagctcaagaaatcctcctgcctcgacctcccaaagtgctgggattacaggcttgagccactgagcccagctgagttcatattcttgtcatcactgcagggtaagcgttgaactttcctgggccttcactccttctctggaaaataagttcaataataacactgactttacaggatcaataggaggattaaaaacctccttgcctgtaatgttcagtacaaagaaggcatgaatgtttgccatttcttgttttgcctatcattttgaggtagtagtcagatgtacattattagtacagttctttcctcttccacatttaatattcatccgaggtcataaaatcatagagtatgaggccaaaaggggaattgtaagatctcctactccagtcaaactattcttttttaacactctagtgatggaaaacatggcagcagtgtctcagaaagtttttcctatataaagccaaaaatcccattctctatttcacctcctccttggctgtagttcttacctttggaataaaggttaatacttcctcaagtagctagaacagagtgttcagccaatctcatttattacgtttgtctctcatcacccataatgttaaaaccatcactgctcttcactttcataatatcttggaatggttttctacccagtgggggaaaagcaaggtaaggaaaaagttcagaggcaaagaggaagattcataaagggaaatcttactgcttctaccttctagccactctagtctgaggctgatggaggccaatctgtgtttcttctatgtgctcaatgaagaagataacagcctccctcttagaagacccaaggattttgtgtgtgggtttgtgtcatcagtagaaccaactctcaatattgaagattcccctctgtttctgattcctttcatggacctcagaggtgcttgctgacctcatttttttttttttttttgagcagagtcttgctcatttgcccaggctagagtgcagtggtgcaatctcggctcactgcaacctctgcctccacctcccaggctcaagcgattctcctgccttagcctcctgagtagctgggactacaggcgtgcaccaccatgcttggctaattttttgcattgttaatagagacggggtttcactatgttggccaggctggtctcaaactcctgacctcagctgatccgcctgcctcagcctctcaaagtgctgggaatacaggtgcgcaccatcacgcccagctaatttttgtatttttagtagagatggggtttcaccatgttggccaggctggtcttgaactcctgacctcaggtgatccacccacctcggcctcccagagtgttgggattacaggcatgagccacgacgcccggccagttgacctggttttaaaccacagatgttgcttctgtgttgaggtcctagctcctggtactagtccagctgtaaaatgcctttgtcatcctagagacagcacaggttagaaaacagaaatgtgcttccaagtgccttatgggaatagaattatcacacagtaccttatttaaagcatattgccaaccaggtacagtaatattcttatgtatttgtccagaagactttgaatatctaaagtagtgttttcccccaggggtcacttatcaatgcctggagacattttttattgtcttggctcagggtgctactaaacatcctgcaacacacagcacagagccctactgcaatgattatcttacccattatgtcagcggtgctgacgtcgagaaatcctaccctgaaatttattattgctcttttatggaaaatgttgttataatggaaaatcccatcaaaacttttcaataaaagcatctagacaataccctcacatctatatccatctataaatgtgatacacagatgtctgccctttagaaaatagtcttaactccttcctgctcagagtggtgcaaataagctttctcagctccctgctagagagatattaaatttgcatttctcaggagaagaaactcattcagacggttggacccaagctgtttgatgagcacttaacaaagtgcctttgcttctttctgcgttttgtttgaagaagataacttctgttcagcagacctccattcttcacgcactgtcctgtaattctcaggaagcattttggatctagtgggagtccttcatggccaatcaaagcatggtgggagatcagaagcccgtggatccaaggtttctacttaagccaaaagaaaggtagtccggaggaacacaggaaagattgttgttgttgttgttgttgttctgtttttgttttgcagcatcttaacactgcagtgagaataattctctaattcaaccctatgatgtgcttacgtgagatttctctctggcagtgaatttttccttcatatgcacgttagtgattcattttcattcagtggcatgacttatcagaagaaatttcagtgtccatcaccctgggcatattcagaaaaattatttccctccaggtctccaaataagctgattttggaaataaatggaggacaaccttttgtgttacaaaaggcagcaacaaggacttacaaaaaagaagaatcgaatatctaaatgtattaattcattaacatgaaaattctttctgtgggtctcatctttgcaagcagatacaatattgccatagtatgagtatgaccatgccccttcctaacaaggtattaacatcagtaatagagaatggcaacaagccatagttggttacaccttttggaaaacatcaacattttaaccatagacccttcagctgggatgcaaggaaacagagtgctggcaacctcaagaatcaaattttagaggtgaaatatttagagcttgtggtccataattaaaacaaaatttgacttcattttttaaagttacaaaaacaaattaatgctttaatgcttaacacacttttgtctaatggagacaaggaatggatttagctgacttctcccagtaacttttgctgacttacagttgagccactagagaagaccttttcaatagagtgatacagatgaaaaagtcagtgagctgtatctgctttacattagttttgcagaactaaaggtgactctcttcatgggaacaatcccaagtttgtgtgtgtaaccacttatactgatcttgctttctgttcaactatggcagagggtttaatgtttacaaatggaaacatatttttctgaattgtgataataactttctgaatacttaagattccctttaatttattacagatatatgtactttctcctaaagatgtttccttaactatgactgtctacattgaaatcattgccatttgtatatcaaataagctgctcaccaacattgtgccccaaataagcttctctgttagtctccaagaccttaccttctgtatcaccccaaaccttttctttctcttatgatccttcagtccttggcctggcaatttggccaggcaaagggcgcgtgggaaggacatcccacgtggagggacgaggatgttgaaagcctcagagctgagagagagcacagcacattcttggaggaatgacgtcaatagggttcagggaaggtttccagaacatgccctttttaattatgtaaaaattgtctgtatggtatttaacttgacctgaaattttgacacaagggtaccttgcaaacaacctgttaatagcgctaccatcattgtcagtcaggaacccaaggagaataatttcaccttccaaattaaaaacactcccaaacactcccttttccaccaagagccatgagggcactagggcagaaaacacattcagttttttttagcattggctgttatgcaaacatgctacaaaaacttgaattagtttgcaagaaaaatcccgttagactgtttccagagaaaacagcaatgctttgagtcactttgaaagtggattggcccatctcccccagaacacgacattctaaaagcatttttgtactagcagcgttaatggaaatgtgctgttctctgggttattgccatagttaactgcgaatcccacaagtggtttaagacaatcccaaatatttcgatagcttagacaccacttaaaagtttagctcaacagggtcactttccatttttcatggcagaaatgaggcttcctttgacagaccatatttctgcagcactgttaaatggtggctttccatagcagcgtgatttatggcctgcctctaggaaggaccacgttaggtgtgggatattaaaaaaaaaaaaaaaaaaaagtctatctccactttggaagaaaaatagaaaaataagtttgcagaataaactttgtgcccctcctttaaaaaaacctcaaatatttcatttttaagtaagaaaaaataattataagacttggagtcttattttgttttagttaaatccccctttcctataatcatgatcaatttcagttatcaaatactgatcttggccaaggccggaggagagcttgaagccagaagttcaaggccagtctgggcaaatcgctccaaaaaaaaaaaatgaaaaatagctgggcatggtggcatgtacctgtagtcccatgtacttgggaggatgaggcaggaggatcgcttgagcccaggaggtcaaggctgcagtgagctatggtcgcgccaccacactccagcctggatgtcagagcaagaccttgtctctaaaaaaaaaaaaaaatcgaaaaatactgatcttaagacagcaattccatctctcatgttcttatatcacaatatcacatgatgaattttgttggcagatggaaaaaaaaaaaaaagccagattcaaaaagtaaaattctagcttgtgtcccagaaaatggggatttcatcttgcttttggggagtcattgaaagacattctccctgcttggggaaggatagaaatcctctgtccctcgtctctccccttcaggtcacttttcaccactgggggcttttcctggtctaattctcatgcctgcccacttcctctcttacttcttccttcctttcagctttatttgggatctcataaaggcctgagtctttcttgaaaggaatttgaaaagaaccacgcacaatgactgccatttcgggatggaaacagtatttcagggcacacgctgtgtctcaatagaactctctctacggtgtttctttttcttcccctcgtggttcacaggaaccttggtttgagaagtgagccaagccagtcttttgttcttatttttacttatgataatagaatattttcagtctgcagacttctgcagagtgcatgattaataacaagggttgagaccggagaagtgctaacaacaaggctataattacattataggtttttagtgacaacaaaataaaccatgggagaaagctcaagggacataggacctcttaagcacacttaccaaaattgtacagccacgccaaacttccagtttctaaacgccttgtaacaagagatggcagggatgtagtgtttttaatcagagaaagaaaatcctcaagttaaacactcaccctttcaaaataattatctgcctctcattttgatggcaatggcctaatggtatcatggcttcaatttctcatgtagctgttaatttatgtttaatgcaaaacacaattttataccttattcctttcttcaaactataagtaatcttattttgctcatcaccaactgcatatgtcttattttcttggcctagttagatacccagtagtagaggagatatattttcatttgggaataatccgttccctggttatttaatggtatcattattattatatatacattaattcattctaaggagaaatttgcattcattgcagtctacgaatccaagttgcctcatgcaatatagtatctttttattttaatcccaaattgtcaggtgcccatcttttcagcaggcctgtatgtcatgaataaagctttccctttgatcaggcaatagacagaaaattgtgttttggagaagcaagaggaagaataagggtatgaatgccagatcagctggatttcaatcccatcagttcttactcgtcccatgaccttgggcaaattacttaacctttctgtgcctctgttttctcatctgtgcagtggggatgacagtagttccagctcatggtgctctttgcagatgtaatgagataatgcacggacagagctgggatcagtgtgttgcacagggcacccaggtggggtcagtcttctttgtattaattacgactggagctccctcatgctcttattggttcagaaggacatttgagaacacaggactgattcacgtcttgatgcctggctgtttatcccacaggatcattgatggacgtgatctgatgcccctgcttgaaggaaaaagccaacgctccgatcatgagtttctcttccattactgcaacgcctacttaaatgctgtgcgctggcaccctcagaacagtgagtaaacagacctttccacgctcctcatgctccgtgcaacctatgccatgggaatagataaaactaaagggtaaaaaggtggctctgctcaatggaggccaacaggtgcctcaatgtgcgcccatgctttgctttgtcctcttttccctcctcctcctctcttttcgttctggtcacatagttgtccaggtaggaggacatcagaaggccatgtcattcacccacctgaacaccacccacagcttctctatcccagcagagaaagctccctgttctcaacagggcgctgtggccggttgctttattgcatgcacagctgcccagcttcacttcctagcactcctctcacactgaagaaagcagcccctgtgctctgtgcattgctgtgcttacacttgcaggctcttctcctggaaggatgtcttgcctcatccttcttggagggtactcctcaatgccccccaggccctgctgaaatgccacctcctctgcatgtcctcaaaacattcccctcactcttctagcaagccactaaaggctagagaaggaatgaagagcatttaaatgtttatctgacttactttcccagcctaaagatgatggatcgtgactcactgcatctgtattttgtgcgtcatgcatatttgctacatttagatatttaaagcaaagttaaaatgttcttcagttctatctcattttctgaactgggggttcttttaattgtgcaattgaacaggatatcttgtgggttttctaatacttgttttatagtggcatttccaattagcatacaggaacaaatggtttataatcttaggtgtggttgttgatttttatggctgcatagtattccatggtgtatatgtgccacattttcttaatccagtctatcattgttggacaattgggttggttccaagtctttgctagtgtgaatagtgccacaataaacatacttgtgcatgtgtctttatagcagcatggtttatattcctttgggtatatacccagtaatggtatggctggatcaaatggtatttctagttctagatccctgaggaatcgccacactgtcttccacaatggttgaactagtttacactcccaccaacagtgtaaaagtgttcctatttctccacatcctctccagcacctgttgtttcctgactttttaatgattgccattctaactgatgtgagatggtatctcattgtggttttgatttgcatttctctgatggccagtgataatgaacatttttttatgtgtctgttggctgcataaatgtcttcttttgagaagtgtctgttcatgtcctttgcccactttttgatggggttgtttgtttttttcttgtaaatgtgtttgagttctttgtagattctggatattagccctttgtcagatgagtagattgcaaaaattttctcccattctgtaggttgcctgttcactctgatggtagtttcttttgttgtgcagaagctctttagtttaattagatcccatttgtcaattttgtcttttgttgccattgcttttggtgttttagacgtgaagtccctgcccatgcctgtgtcctgaatggtattgcctaggttttcttctagggtttttatggttttaggtctaccatttaagtctttaatccatcttgaattgatttttgtataaggtgtaaggaagggatccagtttcagctttctccatatggctagccagttttcccagcaccatttgttaaatagggaatcctttccccatttcttgtttttgtcagatttgtcaaagatgagatagttatagttgtgtggtcttatttctgaggactctgttctgttccattggtctatgtctctgttttggtaccagtaccatgctgttttggttactgtagccttgtagtatagtttgaagtcaggtagcgtgaaacttagaattacagtaatattcctatcactaagatacctggcagtcaatggtaagtggtgagcaatttacacaattattgtatgttctagaggtacctgttgaggctggactttcagttccttctttggaggtaaaatgaaattccccttttctctaaggggctttggagctctgcttctagaacctaggactgccccccccacccgccccaaaggaggggtgtgtaataacctcctaggtgctaacttcttcttaaacttagggtgattccattccattttccaacaaatctttgtctcttccccactcacctagccaatttacccaagacttatcatttaaagaaaagcctctcttttatttttacaacttttccataaaattacaacctttctattagccacagaaatcacaccaggtttatgcttcagagtttctcctttaagtctggcagttttctcatgatatgttctagaagacaaaaaaacaacagaaacatgggcttgcgattttacttctggaagcattttattcacatatctcatccatgtggccacaattcctagtttccataagaatactccttcttttttagatcagtttatagcatcaacttctgagctttgtaataaatgagagctcaaggactcttaatttcttttcatatggagccggcaagaaatgtgaagaacaaagtttctgtgactactgcatgttcgaataagtctgtatcatgtcctgaaccttgcaaaattgtattttaatagagccaaatccccagttagagaagcgggaaggaacatattggatcagaggctggaggaacacattatgtggaggagtaaagagaaaggggacaggaagagacagaaaataggagtgagaaaaacaagacccagtttctgataggcaactggccccgggataaaatttgcttcttagactctgaatgcaattccttcaactcttctgccttgaactggtaacaaaaaaaggagaaatcacagtatctgaaggctagaatcatttatcgagataaaggacctcaggaaaacaagacgtttatgaatcatttatgatttatttttcagatgctatctgaaactcagcaaccatatttgctgtcttggcttttgtgtatggcttcatgtttagtcattttgtattttatgtgttcatttttcctagaaatatgtattgagcacctactgtgtggaacatatcgtcttagcgctggcatctgtcagtgagcaaaacagacaaagttccctgctgaagagtagcttacattttagagcatgaggcactgctagctgtacaatgtgctgggaatacagggatgcgtaaggaaaacgtgactctcatccatatggagctttctgtcacctggggaagacagatcttaaactagtaatagttgagtgtgactgcataggtcatctcagatagactttggtaggagcttgccaataatcactagactgtggaacatattccatgaatcttagggataagagggttgtcgcctgacctcagaatactttattagaaaatagaaaaaaagaaatgtagtattagggtttagtagcaggcagtggtatgctggaatcagctcctgatcgttcagaaatcttgccagcttgttattaaaccattgtctgttttcatttggctgtgttgtgggtgtttacaccacggcaattggcaaacacaacaaatacaggttgcctttctccctcagagccctagattaacaacagtttgttggtatcagtagaactgactgcagatgtttttaagatgcagtttaccatttgtcttgattacttagaggattaaatgttataattccaaactcatgaaatactgattttcaaaaaacttaatgctaggatttcatttccacccttttaaaacatgaatctcttttaaaatttatatataatgtcttcgctataatttagttgtctcagtaaattgaatgacataatttaattatgacctgatatcattattcctattacattttataagaactcatgaaagcatgattataacatggataacttttcttgcactaaaataagaattttgagttaaaatttaacattcaatgggtatgaaaaattttggctttaatgtttgacatatgaattaatgttattaaaaattcaccacaatgacaacttgattttatggatggaattgatcttagagggtaggtggatacttggctccaggatttttaagctgatgactgtagtctgtgagataaatattcacattaatggagagtccccaaaccagctggtcataccaaaatccatgggatagctgtagatatattctagaatgcaatgcaatatagtacatagttaacagcttaaagcgttttgtacagacatatatggaatcttagcatcatgtagacaagaaagtcacatatatttaaaatgtcacactttagtcagaaacgggatctccatgaagctataaaaattacttaggggaacggggcaccaataccattatttccctaggagaaggatgtagacatcctcacattggactagcagagtttcataaatcctggctccatattctattcaagtttgttggaaactttttcccaacaacaaaaaataaataaataaagctttattttaaaaatgacaatactaggaacatttgaatgattctcttctagctattgtgaaatatacaatcaattaatgttaactggtgatggatatcccaatttccctgatttggttatatgagtgtttcaaatgatcacaggtaccctgaaaatacatacattgaatatgcatcaataaaaagtaaataattaaataaaattacagcaaacagccatagggtaatggaattcattccaaaggaatgtgttcctttccggctttctgaaagataccttcatttcaagctcagtaaatggtttaaaatcaaaaccagcttaccgtggtaacataaagaaaagtgctcgcatggctcactgtctagcattttcatttaattaaaaaattaattttgcctctaaaacacacctaataaaagagaagaaattctcataacagccacttatgagttaacagcatcagaaaggcagcacttggctttcatcatcactagtaattttggtgagtacttgtcagatgcccttcctcatctaatcctcagaattaggatctaaagtgtcagaaatgaaatatcgaaggctgaagctgacctaatgtgagatgcagcatttccaaatttaagctcaccaggatctatcctgtgtttcagctgaccttatgaaaggacatattttcatcctactctgtaactgttgtagcaattaagaaaaagcacatatatgtaaaccatttcaaggataacttttaagtcttaggatttattttctctgtgaacacttcaaatgctgcattgccacaagcttttaatagttcaggcatgcagctattatttcactcatgtgcctgtgaagcccagtacaaggtacaacatttgtacttgtaattgtagcaacacaggatgatggtgtcctgggatgaacagaatttgctttggagatctaggaaaaggagtgatttatgaggttagaaaagatttcatagaacttttaattttttattaaatttattttatatcattatcatctagacacatcagtaacagcttaacttcccctaacagtcatttccaacagtggaaaaaaatcaccacataaatagattttgtgttttccaacatagcctattaaacatatattttcttatggaacttcatattaccttatagacagtatcagacaatatttgagataaacgttcacttttcaaccaaagttgtagtatgtctgatctaagattacactaatactgtggaagaaaaattcctggtcattacttttgataatttgctacaatgcaaacttacttccttatagaaacaaagtaaatcaaaattgaattttctttcttgaatacaaaaaaaaaaaaaaaagcgccaaaaaacttggtgtggctgaatgatcaaatgccctcttccatctaagcttggcacccagcttattctgatctttttgccaggggtcacttctgatcttttccccttgcattctccgtcctaccgtttcattgattttctacagtattttacacatctcttttccctgacttcaacacggggtgtctctcagttctcccgaaatgtctgcttatgtctctaaccccccgccagatttgctttcatatgctctcagacctggtgttttctaaatagacattttagttctaaccagggcatgcaatatttagcaattttttgtgtcttccttactttcgtatcttctgtacaaaaatgttttgtaggtggttatagacgtttccgtttgttaatctcatgttcttgaaatttgtcatctctttttgtgatcattatgtatcttttgaagacgtgcttgatgacagtaaacactgatgtttgttgcatatttactgtctgcccgacagtttgtcaagaacattgtatttgatatctcattagaagagattatgattatattagtttcagatttggctgtaacaaaaaacaataaaaaaaaacagtagtttacattagagagaagtttatatctccatctcatgggtgacatccagaggcgaatggtctacaaaatctctggggtgcagaatctttcaagcggcttttccacctcctgtagaatgtgacagcttcatcttcatggtgaatgatggttgtgtctaccctaaacgcatacaatggcgggacggatgggaaagatgagaagaaaaaagtgcatggctactacttcccaaggaagatagtcagactcttctcagaggccagaagttggtcacctgttcacacctagcttcacaggaggctgcaaaggagagttttgttatgggtgttcatgtacccagaggaacactcaatgactgtgggaggctggcggatcagctagctatctctcctcccagtgttattttttcccaattatagatggggagacagagaggtagaaggtcgcattactggcatacagttgcaaagttgatggccaagttgggatttgcaaccaacaccatttgcttttgagtctgtctcccattaatcgaaatgtcttcccctaagacaatatgttcttttactcacaattataaatcatgattcctccacctaaccgtgtatctggacatctctgtgcccccatgcactgagtccacgattcatccacatcctcttattccccaaatgtggacatccttggcatcatcaggtctcatactccttccactggctccatgcctggtcctcgtcctctcagctgccctcctccctctccatgaatgttctttcctgggggccaaatgacttatgccccctgcacaattcctgatgactgcccatttttgacaccaagcaatcccaaagcaaatgtacttccaagctctctgccttcctcactccgttatctgccatgatcagacagtaatctccagtgcctcacagtagtctgttggtccttcaggctggagatggtgcagagccattgtgtgatttcaggcaggatgctccgggtaggtcccgaggggactgtggagtgtatttggcttcttgtctgctcaccctggatttcataatgacagctggttcctcccctctctttccatcccttcctcctaataaccatcatctctttttttttttaaatttatccaacaatttttttttttgagatggagttttgctcttgttgcccaggctgacatgcaatggcacgatctcggctcactgcaaactccacctccaggttcaagcgattctcctgtgccagcctcccgagtagctgggattacgggcgcccaccaccacgcccagctagtttttatatttttagtagagacggggtttcaccatgttggccaggctggtcttgaactcctgacctcaggtgatccaccccgcctcggcctcccaaagtgctgggattacaggtgagggccactgtgcctggccccaacaatttttattgggcctctattctatctaagatactaggcactacacatttaggagatgtgggagatatagtccctgccttcagagaggaaataatccagccagagaattggagacctcaagtgttgactgagtgatgaaaagtggtgagaggaacagaggaagactggtgacttccagctgggaattcagatgggtgcatggaggagaacacagcagggctttgaaggacagctagaatatcaatatggaggcaaggaagggaaagtgagggaagagtctcatatacatcctacacccactttgttccaggttatatatttctgtcccttaatatgcaaaacccaaggcttggtaaaagggagtattttgtcctcaaatactcaggcatcagttgggaaagcttgtgttgctctcaaattggctggctgtgaaacagatgcacccagccaccagagctgcttcctcatccttctcactgttgttgtatcgtgagctctggtactgccagctgcaggaagcaggcagaacttatctactgtcatcgattatatatcagccaagggctgaatagttagggggtttgtgctatggtaaacagatggcagtgaacctcaggggtcagaaacagagcttggggccaagatgcttttggtgagtgtgcatgtattaagttagaagacacatgatctatggaggctcaggtatggacacactgtaaaatctttgggtgtaagaaaagatttgaggcattagtgtggggtatctggatgagactagggtaatgtatggaacaattttttaggtggatcgcaggagtaggagggcaccatgagatgggttttcagacatcagttcagtggatgacattaacttttctgtaaacttactgagggggcaggcctagggttctttgtgtgggggttcctcacaatggaaaaatggaacagtatgtgaaatggttcttgaagaacttcaagatggcaacagaggtacatgctgccaagactgaaaacccaaaatatctgtgtataccttctatgatatatacatgcagtcttccaagcacccaaaataaatctcgccaaaactaccagttgaacatcattcatcaagggaagtttaaatctgagtgatacattaagagccactgtgttgaaaccatgtagatttattaatagttttccatatactttaagaatccttagcagaaaaaaaaatgtcttacgacatgtattacagtagcaacagattgaagggcagatggaaactgaattgtttcttgcgtaaattggctgcagctttctgttcacagctaactcatgtatagtctctactatagacccagcctccttctgacagcatcacatataggaaccaatttttaatcctcaaagcaatgctaccagggaagaactattattatgaacatttaacagaggagcagactgggacacagagaggtgagagcagctatgcccagcatcacgtatgtaagaaactgcagagctcggggttgaacctaaactattgatgctcagagctatgcccttaatcaagtcagtggcaggaaaaaccttggccgaagcacctgccctctagctagtgcgttctctctctctcttccccgcctaccgccagcaccccccgcccctcccgggactcctctgtctatgcaagtctcacatagcatcaggctaagaaaggcaaatgctcttttctaaagacattgctatcatcctagaacaagagagtcttcgggcccctggcaccaccccttctccatcatatttgtcctggaagagcacagcaactctacctgtctctgctttttctatactgcctatggatctttggtgcctttcctgtcctttagagctgttcattcattcatgcagtttatcaccacgccttgggacttgtgaggattgtctgtctcagtccagcttctggctcattttatcaaaaataaagtttgtcttattttatagcttagctctcagagggttcatgtgtagggagtggcgaatttgtgctatgataactattagccctgacatttcaggggctcagcccagcaaacatttattctcactcttgctgtagaacagagcttgtcaacctgggtactagtactattgacatctggggccagatcattctctgtgctggaggctgccctgtggattctagactgtggagcagcatccgtggcctctccctaccaggtatcagtagcaagtctgccccactgcagctatgaccacaaaatgtgtcttccgacacggccagaggttcaggagataactgtgttcagtgcctgtcatggtgggaaggtgggggtctaggaggagaaggttctgccatccatttgtcagggaccaccctgacagaggccccatcatctcgagtgtcaccagcagaagagacagctcctctgtgctgtggctgggaaaagacataccacatactgctcacgtttggccagaatgggccatgcggcctttctgacttcaaggaagctggaaggtgttctggagcgcttgaattactcagggtttattatccccaaaaaggaggtgtagtcttgtttttgtggcctcagagttccaggttgggggcaccttgctttagccgctgtgggttagaagcaggggccgtaagggcacactcacgttgtgtgatgcctctgagtgtctatcatgcgcgcagtgtctttacttgtgccgaacaggctttccagacctggttttgttttgtctcacgtgatggctctgagacttctgcaagacagcagtttaaacattcagagaggcctggaaatgagtgtcctggggtctggactgtgccgagctgtgttatggactgttgtgactgctctaagtagagaattcagaatgcaagatgtgagaggcttgcgtcactatgagaagccagaagcacttggggcccttgggataaagacagaatgaggccttcgaggacgttgttaaaatttgtaggcgatgtagcatgaccctgttcccggaccaaaccgagggtaggactgctatttctcgcagcccaacaaaaagatgcagatgaactggggagaaagagagtttttatttctgtaaccggttacagggagaaggcctggaaaatattgcccagaccaactcaaaattgcagttttccggagcttatatatcttctaagctattagtctatgtgtaagtgtgcattcatctaaagatataagtgatgaacttcttttaatctataaccaagatctgagtcctgaagaccttcctctggagccccagtaaattggcttaatctaaatgggtccaggtgctggggtgattacccttatcttgtctcctgctaaatcatggaggtttggggagttccttcagatctccagtaaacttgtttgtggaggtctggggagtttcttcagacccccagtaaaacttgtttaatcctaaacgagtcctgttaagaatccttcgttatcatgtcatgcttcaaggcccaggagaggcctgggcaaaactcctgatgggcttttgttccattccagcctttgtatgaggacactggctctttcagcttttaatagtaacttcaccactcggtcagtgccgaaacagatgtcatggaggcctgcgttagtgagacctggcctgccacaacccgactccaagacgttaagagggagcttgtgctagatactaatattgattttaaaaaatattttagtacataacgaaagttctggtttgcgccctctctatttttgttcttggggagcacatatgctcattttcggggcttccttgccagggctcccacttcctgtggctgagtcgctgtaatacgaagtaatagaaatcacaacgtctcttctgttccagggtcagaagcccctgtggtccccaggcaatcccagggaacccagatacctctttatttctctttgttcacagcttagtttatttttaataagatagctgttttaggatcctatgtggaggatgttgaatcagtttctggcttaggcatcaactttttctcacttcaattctatttgcctttttgtcaaatgacaataaactttcttctctcatgagttgagtcacattgtttagtggtgattttatataaaaatatgtttcaccagatgggtgatgatttcctaagcattttgttctagcacagtgacataacagtgctatatcatatgtcattgatatctttgaccatcacttgtgacaattcgttttcttaatttgggggaggatttttaaaatctcagtagaattattgtcctcaccactacttagactacttaaacaagtaaaaaaaaaaaaaaaaaaaaaactgtccactttaatttccctgcattctttataccaaatttaatcattccttttccaggtcattggatctcagttataaatgagtctaagttcccagtttggtcaaaatacttatcgttttcagtggtgagggagaaacagtcttttatcagagcagttgatgataatttttaaaatacagtagtgaataaacattttttaaaaatttaacatttttctagtatatgaggatactcaggatgaagtatgttatcaagataattttggaatacaggactaaatatacctatgaaaaatataagatgatgctgggcatggtggctcacacctgtaatcccagtgctttgggaggccaaggcaggaggattgcttgagcccaggagttcgagaccagcctgggcaacatggagacaccccatttctacaaaaaaatttaaaatatagctgggcctggtggcatacacctgtggtcccagctacttaggaggctgaggcaggaggattgcttgagcccaggagttcaagactatagtgagctatgatcataccactgcactccagcctgagtgataatgcaagaccctgtctctagaaaatacaaatcgaaaatataaattaaacaaaagaagatgactctgccaggtgccttctgttttatctagtgactgagctgtgctatttatctttgaaatgacacctttggagatgtcagttgctgggttcctggtgaataatagaacaagcttccaaagtcggggttgttaccttgtgagccactgtacaataaaaagtgcagttctagttctctcttttcagtaaatctaaagtggtccagagaaacagcacagagactaagcaatctacctttttatgaaaagtttttaaaaatccaaatgaaaggataaaaaggcaagcaaccccagagcatgctaaataattctttagaataattaattcttagttctacacttgtctgaactacccagcaacaccactgccattcccaggccggggtgcctgcatctcttgactgggcctgatgtcaatctgatcttccagctcacacctgaggaggattgtgctctagtagtaatgacaggatcatttgagtggctttcaaaagcaagtggaaaatacaggctctttacatgaatttattccaggagcctgtattctcctggggttttaaacacaaagaggcttgactcgaatgtcaagttcaaaacgccctctagatttgcatcattgggagcatgagcaagagaggcttcctggctcgcttctctgtgtacccactttctctctcggctgaccctgatgaaggattctaagtggctgcaaatggcaggctctgtcagcctgtctccaaaaaggcttctgaaggaaatttctcataccctggaagaaagtgtgggatgagacgagtggatgggaagcatcttaaggttacttgctgcctttttaaaccctgctggagatggtaaccaagtcctggaattcttcctgcagcctggcgtgtctgtgtgtcagcttgaccttatctttctgaagcaggtgcactgagcccatgtaaagtgcacagatgtcatgtcctgctctcgcagaatcagctatgccacagactgcagtcgtctcattatgaatcttctttaatatattaatctaaacgtattcacctcgctttccctgtctttctcagctttaaaaaaaacccacatacacaaagaggctgacttttaccatcactaaccttgtccaaggttaggggcgatttggggacaacacatgccctagtgactgttggtttaaaccgattgcattaatcagttttgcattttgatcagttgatcatgaaatgcctataattacaaaagtcacacatgccattatatgcacaaatgatcgggatgacttacacaggggtggagggcttcctaggaggaatgcctctttggttttatgtaaaagctgtaagggcattcacgttctgcacctgattctagtcggttcatgcattttaattctctgtttttatctgctacattttgcctacccatgaaacatgtttaggcctctcttagaaggtgtttgagagcagtcagctcctcagaaaatgataacattgtccgataagtaggaaatgaatcaattatttcataattattcatttgtttgtgaattagtttttcctagcaatttcaatattttggagtttattgaaatacagaacttacattttaaaaactaaccatcctattctggtgttgatgaattcccctaatttggaattcctagcagcttttaaaggtatacgttgcatgccattatattctaatttaaagatttttagaaaatgtatagagttgagcagtctactttcagaacatctccttcatcgccaaaagatcatttccattccccatttgtaatccctcctcaccatcacttctagcctcatttaattcttttttatttttgtttatttttgtgggtttgttttttgttttgttttgtttttttgagacggggtcttgctctgccacccaggctggagtgcagtggcatgatcatagctcactgcggtttcaactgcctaggttcacacaatcctcctgccttagcctctggagtagctgggactacagacacgtgccaccacacccagcttttttttttttttttttttaatttcttatagagatgggctttaactgtgttgcccaggctggtctcaaacccctacctaggctcaaggctcaagtgattcttccacctcggcctcccaaagtgctgatattacaagcatgagccgctgcactcggccctcatttaattcctttttttttttttttttttttttttttttttttttttgagacagagtctcattctgtcgcccaggctggagtgcagtggcacaatctcagctcactgcaaccaccacctcccaggttcaagtgattcttttgcctcagcttcctgagtagctgggattacagggacctgccacaacacctggctaatttttgtattttttagcagagacggggtttcgccatgttggccaggctggtctcgaactcctgacctcaagtggtctatctgtctcggcctcccaaagttcatttaattcttgattcgacattttttggactttctggaaactgagaaaataaactgttaactatggtcctaccaagtttgacgctgttcctgctggctgtgtgtgtgggcgtctatgtgtggcttcataatctttcctgtacatattaacattgtgtctgcagccttatgatatcttcaccttcttaaagcacatggcagcataatttccgcatcactttttcatttgtggtacatacaaggatgcttcatacctaatgccgtttccatccttttaaaccacaggcacatccatctggaaggcctttttcttcacccccaacttcaaccccgtgggttccaacggatgctttgccacacacgtgtgcttctgtttcgggagttatgtcacccatcacgacccacctttactctttgatatttccaaagatcccagagagagaaacccactaactccagcatccgagccccggttttatgaaatcctcaaagtcatgcaggaagctgcggacagacacacccagaccctgccagaggtgcccgatcagttttcatggaacaactttctttggaagccctggcttcagctgtgctgtccttccaccggcctgtcttgccagtgtgatagagaaaaacaggataagagactgagccgctagcagcgcctggggaccagacagacgcatgtggcaaagctcaccatcttcactacaaacacgcctgagagtggcactggggaaacataactccatctacaccttggatttggactgattctccattttatcacctgaaggcttgggccagagctcaacagctactcaactggaggggtgagggggataaggtctgtagtatacagacaggaagatggtaggtttatgccttctgtggccagagtcttggactcatggaaatagaatgaatagaggggcattcacaaggcacaccagtgcaagcagatgacaaaaaggtgcagaaggcaatcttaaaacagaaaggtgcaggaggtaccttaactcacccctcagcaaatacctatgtcaacagtataagttaccatttactctataatctgcagtgatgcaataaccagcataataaaaaggcaatcacataaaaaagagtttagtcgtctaaacataagtaactttaaggtgaatgaaagatcttctttaggaataatagatgatggtaagttccactttggttattggaaggcaagtcattattactggtattagttaaaacacatatcaaatgcttgctcttcatcatatatatagttatgcatacatacacacacacacatacagtatattctttcctcaaaagggttaagatgtctaaaatagggacctagaagcttaacactatttaagtaaatacagtagaagctcacaaatagatttctttgcacaatgattttttgcaaaattttacagtaataataatcccaaggcaaatctctcctgaactgctttccattccataatttgtagtataattcttggattccactgttttctttggggaatggaagttctgaattaaaagcccactgtggagatgctgtggttcatggaatctcttccagtgtaattcagaatcattggcctagaaagtctctgatatttggaggggaacaaaaatcactcacaagcaatccatgatctatacacataagcataatttcctttagttctagttagtcatcagagaacagtcatgtatgcaagttttgtgactgagaaatttctgtgcttccaatccacaatgagatgcatgattttgttttcatcccatttcccccaagcccctgtaaatcagggaaaatgcgcaactgatcgcctaggagagggcctcgtagtggcacagctggagatagtttcaaagtctaaaccaccagcccatcctgaggaaagcctcctatggaatgtaaagtgcaatcatttcttcagatataagactttccccaacaatgtgattggattcctttatggcaaaatcgagagaagctgccatccacctgcttatgcatttatctcttttgtggacttgtctgaccaccttctatttgcccagagtttgctcaattccaagacagtgcccatgaatgggacacctgtaatgtaacccacacagcggtttgcagagaatgttagccatgacttgggctttctgaaagttggctataatttctctatccctacccacaaccctgggaagttggagcaagaggggcatactattgggctgggaggatttgacagcatttccccagttgccctttaagttcttctatttcaaacgttaattttgcttctctttctaaaaaaaaaaaaaaaaaagaaagagaagaaagaagtgattcctaccccctacctccagagttgttgaaagctgaaaagcatacaagattcttccttttaacttggatttctcgttccagaaattgtgggataatctgtattcttgctttagaaaacattcttagagagggtactagcttactgatgatgtgttaggattgctactgatgctgtcatgtggaaactatttaaaggcactattataaatttatcctataagatgacaatgtttactcaaagtctaacatattcaatgcaagtaagactttctgaaaacacttgatgatgtggaaatgctgcaggattaaataacttgaagagcctttatagattatatgaatgcctatttgtgtctagaaccagttatttaacctgtaaaatgtcaatagcaaatgaaggatgaagtatatctctagatgcaaatacattgagtttaaaagtgcctcaaaataattgagatcacatttcaggacatttggaaatcaggtcgatttgtggtaactgtagtcatcttaaatttcaaaccatttaccatctgaaagttttgatttgaatgtaaaacaggaaattggaattcctttgtccaggagaaacctcacaaaccttctttaaggcatagttttgttgtttgtttgcttgtttgttgcaggctgtaaggcatggctgcttgtttacaaagcatctcattcatattacctgtggagttgcatatccaaaccttagtgagttttgaagctttaagcaaattcttttaaaaaattcttgtatttctagcattactagatattaaaagttaagcaaatagattaatgacgtatacataggcatcatttcacaaggtcagtaatgctgcaggaaaagcaaaattgcaatctacgtatctatggtactaaggaagtcctgtttttcaaaaatggaagcccacttctcagatttttctgaagggcatacaatgaaaagtgaaggggaaacacacacacacaaaaaaacaagtatttggcttgtcacaggaatctgattgcattaagtgaaaggattatttagaatatgttaatgcaaagctaaaataaaattttccttggcaattaaaaatgctgtgcgctaataccctgctttctatcgtgactcaattcaacaatgtggggaatgtttactacatttccaacttgatgtcaagcaatggggaatacaagttccagttctgcaaagattcgtcaactttcttagctcaagagagaggctgagaaatgcagagaagaataagacataaaatagctccgacctccatgatccgagagtgggaaaaggcccgattattacccataaggcacactctctaaggccttttaaggggcctacaaaaatgttttattttataatcagaagaaaaggaaatgaacattggggattgaaaatcatattggtatttgcaccaacatagtcataaaatagtatgttaatatgtttttactttatatatttatatattaaaatatatttaatatgttttgcctttgtggcccatgaaagtcttactgggccctggggaaggtatcctaccctggtgaagcagctgctttgctctacaaatacctggggcagaaatttgatttgaaaagtattattctctcttctctttgtttcaactggattcctttggaaaaccaaactagtatcagaacaaaccccgaaacagtaagaaattggagtgagaagggcatggtattgggactaggatcggctctcattcgatcgagctattctcttaaaatgacaaaaagtgtccataaagaggctgctggagagtgcgtggccatagggagccgacatgcccgggaggaaaggtgttgattacatggatacttctaaaagctaaagccttgttgccttctctttaatgcctagagaatgggatgtgtgatgcaaatgctcaaaacctcttaaatcatagctgtctgacctctacggacctcacatccatctgaggcttcatggacaaagattctccacttggccaaactttagccaagctcctcaaccttctcccaggcccaatctgggcacttccttgtaaaatctagttttggcaagaagtctattaggtcagtttagcaagaacacctaacccccccatatctgttcaacctcagtatctgatcaggctcctcagcctccaccatcccccaggtgatgtctggtcaactggcctgccttcagctagaatcctgttaggtcggtttagatgaatgctccctgatatttcctcttggtaatcttccatccactgcccctgaccctgttccctgtctataaatccccagttttccatggtgtattcagagctgagtccagtctctctcccctactacaagtccccattgctgtggtccccgtacctgtcatgatggtcctaaataaagtcttactgtgctttaataggtagcattgaaaaatttttttctttgacatcattcatgacaacatgaaacctattgggacagcatgactgtgcagggtctttagagctcagctttctgaggccctgagcattcttggttttccgacatcgtgaacctgttctgtgttgcaagatatcactcaagccagtgttgcttaataccatctctttgtgtaatagatctgaataaagtaattgtaatacaccaatattttactttgttgagtattattttaatgggagcctttccaatgaaggaaacatcagctttccttgttagaatgcaagcagcttaaaaactacccatgtctttctggaaaggaaacattgccatgtaactatgtatcagttttctaagaacttcatgggccttccatataggagaccctcaaatctgggggttcatctgagagtggttctactcattaagttcaaatcctctaaaggattttttggtaagtgtatctttttttttttttttttttttttttcacagagtctcactctgtcgcccaggctggagtgcagtggtgcaatcttggctcactgcaaactccaccttctgggttcaagcgattctcccacttcagcctcccaagtcactgggactataggtgtgcaccaccacacctggctaatttttgtattttttagtagaaatggggtttcatcatgttggccaggctggtctcaaactcctgacctcaggtgatccacccaccctggcctcccaaagtgctggaattacaggtgtgagccactgcacctggccatggtaagtttatcttacctggcaaacacatcacatcttcaaagtagcaaattgtataatttcttacatacactttacacaataagcaaacacagtcacttttatattgaggtctgggctataaaatttgcttcactgagtatatgagtatctaaggtttgaaactaaattatacatggggattgtagtgtttttctaaaggtaaaattgttaatgaacatatttttagaaataggtactttgaattgcttgtcaatatttatactaatttaacaatgggtgcaaaaataaatacacaaagtaccatatttacaaagatatgcatattctccagtgcgcagggcccaatggttgctacatttggaatagaaactatctcatggttcaaatatacagattcatctcagtgagtgctgagcaagatgatattttcctgtttcccttatagtaatgttggcaccatatgagccactcgggcctggccataagtttcctgcataatcctctatggtgagagtccccacccccaggccacagaccactaccagtccatggcctgttaggaactgagacacaaagcaggaagtgagcggagggcaagtgagcaaagcttcatctatatttacggcctctctccattactcacgttaccacctgagcaccacctcctgtcagatgagcagccacattagattctcataagagcaagaaccctattgtaaactgcacatgcgagggatctaggttgtgcgctccttatgagaatcttatgcctgatgatctgtctctgtctcctgttacccccagatggaactgtctagttgcaggaaaactagctcagggctctcactgatcctacattatggtgagttgtataattattttattatatattagaatgtaataataataggaataaagtgtacaatgaatgtaatgtatttgaatcatccgaaaccatccgccacccccagtttgtggaaaaattgtcttttagtccctggtgccaaaaagtttgggaactgctgctctatgggtactctgcttgttgtcattgaatacagaaaattgagataagagctcagaggagggcctaagggatgaatggtaatatattagtccgttgtcatgctgctaataaagacatactcaagactgggtaatttataaagaaaagacgtttagttgactcacagttccacagagctggggaggcctcaggaaacttacaatcatgatggaaggggaagcaaaaacgtccttcttcacatggtggcagcaagaagcagtgcagagcaaaggggaggaaaagtcccttataaaaccatcagatctcataagaactcactatcacaagaacagcatggaggtaaccaccccccatgattcagttacctttcactgggtccctcccatgacatgtggtgattatgggaactacaattcaagatgagatttcagtggggacacagccaaaccatatcattctgcctctggcctctcccaaatctcacgtcctcacatttcaaaacacaatcatgctttcccaacagtctaactcattccagcattaactcaaaagtccacgtccaaagtctcatctgagacaaggtgagttccttctgcctatgagcctgtgaaatcaaaagcaagttagttacttcctacatacaatggggatacagacattgggtaaatacacacccattccaaatgggataaattggtcaaaacaaaggggttaccggccccatacaagtccgaaatccaatagggcagtcattaaatcttaaagccccaaaatcatctcctttgactccatgtctcacatccaggttatgctgatgcaagaggtgggctcccatgaccttgggcagctctgcccctgtggctttgcagggtacagcctccctcctggctgctttcatgggctggtgtggagtgtctgcggcttttccaggtgcacagtgcaagctgcaaacattttatgatagttctttggatttcaaaaagatgatagttctttggatttcaaaaagatgctttgatttactggtactgttttaaatagaagtcctgtgcattaattctttaaaggctatcagctgtgtgaaggtggaagtcagataaacttaaagataaaaatatagtggagtctaccatcaattaattgtggcccaggattgattataagtgattctgcaattctagtataaatgagtgaaaatgcagagttgattaatctgagcaacaaacataattattacgactattactaaatattgaggttcttttgaaatattgtattttgtttcactggattctatgaggataatagatttcaaaatatattacacatatggaaagatgatgttgtttttaatggcatttgaaaattttgaattttccaatgaatatgtttttataatatattatttgaattccctataaactttgtcacttttgaaatactttttaaaatagtgcctgtgtagtactctagtagatgcaatattttagttctgttgatcagatcttagtcttagcaaaatatcaaacaatgacataatatttaaagccacgctatttcatcaacctttgaaataataccatgcaactcgtgtttaatatttctaattagttcatgagattcttgcatcttgtgcttttctttcaaagtcaggttgtaaactatgctgttaatgcaaagtgtaggctctgtgttaaaatctgaaggcattctgcagcaaggtttgaaagtacccttgtctagtgcctctcggactgatgtgcatgaaggtgacaagtactataggaaaaggctggggaaagtcagagcttgaaataattcaggaaagggcactggtggcactggtggcattttatcagacaagggaaatgcatcgggtcagtaactactaagagaaagccggatcagacaggccatccattagagcttgtatcagggagagctgttcacattgtcacatcaggggcagagacaaagtgagctctgtagcacatcccattgcactgaagggaagaagagggcagtgtctgggtccacatgcaggtgttacaggcagggatatggatggtggttgatgagtctcatggatcccagacatggttctaagtgcttcagtggattcgtctatttaatcttcactgtacatctgttagatagctgttattattgtcctcttacatatgaggatccaggcacaaaaaaacagtacatacattgctttatgcttagatttatggaatgcttttttggttaataaaaaaagaaatggatagattcatgaccttcatatatgactgtgcatgctgtgtactgcacaactccaggaggcagcattaacataatccgcagtgggaagaacattttctaaatttgtgcagtgcacaacctgtgccaccatatgtagcaatatccattagatagtgatgttgcaaaaatagatggatatgtaagtaatggacacaactgactaccttgatttttctagcaagggacacaggagtacggtttgtaaaacccatggatgaatctatgaactaatgtattgacatgagacattctggagtgaaaagggtaatccaagcgtacagatcattaaaatagagctaaaattcaccaagagttgatgtattgcgttgagggaaaaaacggcacatagttttgtggttatctgttggttcactgttccctgggcatcaccacactgtctgctaaaggttttcagcttactatgctgctcagacaaatggtaggactgcactctggcccttcgtgagccgtgaggagacatgtcacaggctacttcagcgctacagcatctgtcaccagcactttctcaacatcccacacagaggctgctccctccgggtggtctcagagttaagatgacaccaaacagagtccagataacttaggagtaatacacagtgtgaacaagaaagaaagctttgttgctgaagccactgagatttggatatttttcctgcagcctagatacattcatcctgagcaacttatattaccattctgtttctgcaaaggaatgagtattacattttgcaaaatatttcatttcccatttttatccctcagggagtttatagctaaaggatcctgggatattttggaccatggaatatccgaggcttaatcagacttggaaaaataattcagatagttggaggaaaggaaaaatgagaatggctttgggccaggtaaaaacaaaacaaaactaatgttgagactcactgtatcttcagaaatatacacatctactaacttttactgagtgaatcttagggaggtgaatggcacttcatttggtaacatcttatgccacacggaaattgaaggattgtacaacttcagatccctatgtttcaacaactatagcaagccctgcattttaatgtcactttaaatgtgtttaaaatatttaatcctacttaattgtatgttaaattttttgacaatccttttaaaatgaaaataatatctagtaggaacaataatattcgtgtgcatcctacttattagtgctttgaatgcaagtaaatggtcttttgaccctttctcatttaaattgttcgccttttattcatcccagtcatgctgagtgaattctggtgtttaaaaaattatatagtgctattattttccatgacaatgctttaaagggtaacttgtgtgaggaagcatatttaaaattttattgtattatttccatcacaacaaagcaatgttaaaccttttccagggttataatggctccttttgtgtaaagttcattaaattcaacagtgatgacacttagaagagagctaccagccccaaatgagacaaggacttctgtgtcaaaatgggagaagggaatggaaaggcaagagaaagattagtaggagacacgtaggcaaaccttagtcatcccacgtctgtttatgatgcagttatcttaaagataaaatagagggtgagagaaccaacatgctatcagtctcagggtgacaattaccctgtaatagtctatcttcaactatcttagataatgcataagaaagtgcttgatgaatgattccatcctaaccactatttaagctccagggcagagaaaagaaccagaatttcagatccttacccctcactgtcttgtgtgtctaaaatgtgcagagatctaatatcagctcatcacttaccatggcataaaaataaatatttctctgcaaaagttcatctcggcacctctctgctccacagaagttttctaaaaataagagaaatcccttttggagatgcagagatttattctagaaaatgacaatgctcttggattatctttcagtgagatttggcaatgagcagtgtccctaacagctagatgacttgatgccctttctggaatataatggcaatgacaaatctatttttgcttcagcccaggcagctatgttaatgtgcactctgtgagtgctgaagacacttagtactgcccatccattttgaaacctttaataagaagcctggagttagatctgtcctctttccttctgttgtatatcaagagactaacctctgtggctaagcttccaatgtcgcccttttacactataaccacagaagtgtgcatacaatggagggaaaaggattagactttgcaaattcacattgccctatgtcaccaattttgaggattaagtttcaacacaaaataattcagttccataacaaaagtcactctagtgtctgagaagggtagatggtgaagacagaggtggctgaattttaaggcattattgtgattaaatgcaattatcttacataacacattttaattatgccaataagagaggattacccaattacaaaatgttttcagcaggaccatattaacactcatgtgatgtatctttcctcctgtttaactgtagtgtgtaaggataaatacaaattgaaatagtactctaggctatttcctgcttggtcaattaatatttttctgaaccataaaatatggatttgccaatttagggagttaataacattgccctagattttcttttatcttggcagaagaacagagttcttttcagcatggaactcagttctctgattactttgtggtccattttagttgccaataccttagatgttacaaaagcaagacagcttcatcaaatatgctaaagctatttgcaagacagctaaaatatgacatgaaccgctacaggagactctttgcattttgcatttttatattaaatttgataatagtgtagatcatttatttataatttgcatggaattgcattgtgctcatgctgaaaggaaaatgctttcaatctgcccattgaagcctcagtaatttggaatgaaaacttagaataaaataatctaaggcatgttttttgagagagactcacatgaaaatttaaattttaaaacctaaactcatctatgtgctttcaaatagagtacaagatagaaagtgcattgtaattgctgggcatatttttaagaaaaatattttattgtggaaaatttcaaacaaacacaaaagtagaaagaatgtaatattgaatccccacaactttattcccaagcgtcaataattgtcaccattttatctatcttcaaacacaatcatggtcatgatattttaaaattttggattgtcatccatgaacagaaaataaggattttaatgtttcatgatatactgcataaattgctatgacaatgtgtttcttcaaagtatatatattttcataaaggtaaatagtaaaggagttaaatttaataaagacataaactatattggtatcttctgtgtgtcaaaccatctcaaaacttagtggtctaatgctatacccacatatttaactgctggtcttgtgggttgacattttggttcagctgagtggtttttcttagatgactttggctgggcctgcttcaatatctgacattggttgatgaacaactgggctacctggtttatgacggcctcatctggaaaggcaggaacgcctggggcctctctgcatgtggttctctcattctccagcaggctagcccagccagtcctcaaggctataattctagtggttacaagatcagcaagagaggaccagcccagtgtgcagataccttgcaaatctatgcttgtgtctgcttgctctagagcccaaacaagtcacctggctaagcccagctgcaagggtagatataaagagaactcttaaagggagtagctgcaaaggcacattacaaaacaaaacaaaacaaaagaaaaaacaaaaaagaacatgcatacaaaggagggaagattctgtggccagttttacaatctacttcataaagttaaagtcttatcaaaaggagatgaagttgacatagcaaattaggacttccgaaaactctcttctctgtgaaatcaataataaagctagagaaagttgtcagaaataacttttacagaactctggaaattagcgaaagacttattacatcccctgggaacaacggtgggatctcagtaagaagagtgtgctcgttggcatttgagcttaccttgagcttaccctagtgcaagcctgtattctccaactgaatggtggctggaaaaacagcagcccgtgggttctctagcagggagcagagggagcggagtgtggctggagctccaggaaatcttcattcctaatgctggtgtatttatctgtgtttgacctgatatggagttgcctagtacaaagaaatattttctctgagggagtgaagccctgatacgtataatacatggataaatgtggaaaataatgctcagtaaaagagcctgatacaaggaaacacaacatctaggacccatttatatgaaatgtccagaacaggcaaacccatagaaacagaaaggagagatagcctttgccagaagctggagggaggagggataaggagcaacctctcatgggtagagggtttctttttccagggatgataatattctgaaattaggtgttggtgctggttgcacaattttatgatagaaaaaccactgaattgtccaggttaagatgctaagtattatgggatgtgaattgtatctgattttttaaaaaatgaaatccaccatttcaattaaaaaagatacagtaggctgggcatggtggctcatacctgtaatcccaaaactttggggggctgaggcaggcagatggcttgagcccaggagttcgagaccagcctgggcaacatggtgaaaccccatatctactaaaagtacaaaaatgtggcaggcacctctaatcccagctgcttgggagatggaggttgcagtgagctgagattgcaccactgcactccagcctgggtgacagagcaagactacatctcaaaaaaagaaaaaaaaaaaaaaagaaagaaaaattagcctggtgtgcttatgtgtacctgtagttccagctattcaggaggctgaggcaggaggatcacttgagtccaggaggttgaggttgcagtgagctgagattgtgccactgcactccagcctgggcaacaaattaagaccctgtctctaaaaaaattaattaattaattttaaaaagtaaatttcttttgccatcagttattcaaaatggactctctagagtgtcatcattgcaaaattgtccaacttctatgccatctttaggatggattcctggagtgttgatggcactttctttagttcgccttgttggacaaattcccatgtctgtattccagctactcttcctgctttgaatgctcccttctctatgcaccttagttacagtcccaaaattatgaaccacagtttatcttagaggtctcagctccatcgtctcctctgtataaaactcacttccaccttggaacccattagtgctgctgttatatcttttgtaacagatgatttcaactaggtgtgttttaaactgccaactcattcagaaagggaccaatttctattcatgtttgtatccaaagtgcacagcatggtgccagacaccttagcaggaatctttcatcttctctgggcacagtgaaggttatgtccccctcaatctctgtaacatttagtccagaccagcacccactgtcatttttcctcctctgcccaaggttgtaaaggcaacttaaaaacggagttgtcccaaaggagttgaagacttatttccatgcaaaaacctggccacggatttttatagcaaccttattcacaattgtgaattggaagcaatgaagatgtccttcagtaaatgagtggatgagtagatgcgtggtacatccagacaactattattcagcacctaaaagaaatgaattgtcaggctacaagaaggcatggaggaaacttaaatgcatatcactaagtgaaagaagccagtctcaaaaggctcatactgtatgatttcaactatgggacattctggaaaagggaaaactatgagaacagtaaaaaacaaatcagtggttgccagggggaagaaggaggggtgaataggtggagcacagaagatttttagggtagaacacagtgaacctaccctgtgtaacattatataatggtggatccatgtcattatacatttgtccaaacccatagaatgtacaacacccagagtgaaccctaatgtagatggtggtgatgatgatgtgttgatgtaggttcatcagttgtaacaaatgcactgctctggtgaatgaagttgatgatgggggaggctgtgcatgagttggggaagggatatagaggaaatgtctatacctttcacacagttttgctatgaatgtacaattgctctaaaagtagtattaactcttacatacataaaaaataaggttttaactcataataagcatacacaccgagtggtgacacttgaactgtaagctggccacctaggtggactcattcagcttttcctcggttctaagatatagagtgtactcttctatccagaatgtgcattttgtatctgacttgaacctgaaccccaacagaatgccaccccaagtccaatgagcctatttcactttgcccatgtgaacaatactccactatggggcccaccgtttaatgcaatatgaacagtgctccctggacttgtgtactatagccatctgctcctccaaatccttcctttgctcggaatctctggccaactctattctatccagctcatagctgtgtccccacccaaatctcatcttgaattgtaactcccacaattcccacgtgtcctgggagaaacctggtgggaggtaattgaatcacggggacaggtatttcccatgctgttctcatgatagtgaataagtctcatgagatctgatggttttaaaaatgggagtttccctgtacaagctctctctctctttgcttgccaccatccatgtaagatgtaacttgctccttcttgcctttcatcttccaacatgattgtgaggcctttccagccacatggaactgtaagtccaataaacgtcttccttttgtaaattgcccagtctcgggtatgtctttatcagcagcatgaaaacaaactaatacaataaattggtaccagtagagtggggtgctgctaaaaagaaatccaaaaatgtggaagcaactttggaactgggtaacaggcagaggttgcaacagtttagaggggttggaagaagacaggaaaatatgggagagtgtggaactccctagagacttgttgaatgactttgaccaaaatgctgataatgacatagacaatgaaatccaggctgagatggtctcagatggagaagaggaactcgttgggaactggagcaaaggtgactcttgtgatgttttagcaaagagactggtggcatttttcccctgccctggagatttgtggaactttgaatttgagagagatgatttaggatatctggcagaagaaatttctaagcagcaaagcattcaagatgtgacttgggtgctgttaaaggcattccattttataagggaagcagagtgtaaatgttcagaaaatttgcagcctgacaatgtgatagaaaagaaaatcccattttctgaggagaaattcaagccagctgcagaaatttgcataagtaatgaggatccgattgttaatccccaagacaatgggaaaaatatctccagggcatgtcagaggtcttcacggcaacccctcccatcccaggcctgaaggcctaggaggaaatagtggtttcatgggccaagcccagggttcccatgtggtatgcagcctagggacttggtgccctgtgtcccagctgctccagccatggctgaaaaggcctaacctagagctctggccatggcttcagagggtggaagccccaagccttggtagcttccacatggtattgagcctgcgagtgcacagaagtcaagaattgaggtttgggaacatctgcctaaatatcagaagatgtatggaaactcatggatgcccaggcagaagtttgctgtagaagtggtgccctcatggagaacctcttctagggcagtgtggaaggcaaacatggggtcagagcccccacacagagtccctactgaaacactgcctggcggagctatgaaaagagggccactgtcctccagaccccagaatggtagatccactgacagcttgcaccatgcacctggaaaagccgcagacaatgccagcctgtgaaagcagctgggagagaggctgtaccctgcaaagccacaggtgcagagcttcctaagactatgggaacctaccacttgcatcagcatgacctggatgtgaaacacagagtcaaaggagatcattttggagctttaggatttgactgccccactggattttggacttgcatggagcctatagcccctttgttttggtcaatttctcccatttggaatggctgtatttacccaatacctataccccattgtatctagaaagtaactaacttgcttttgattttacaggctcataggtggaagggacttgccttgtctcagtgagactttggactgtggacttttgaggtaatgctgaaatgagtagagactttgggggactgttgggaggtcatgattggattcgaaatgtaaggacatgagatttggaggggccagaggtggaattatatgggttggctgtgtccccacccaaatctcatcttgcattgtaactcccacaattcccatgtgtcatgggaggaaactggtgggagataattgaatcatggaggtgggtttttcccatgctgttttcgtgatagtggataagtctcatgagatctgatgtttttaaaaacgggagtttctctgtgcaaactctctctttttgcctgccaccatccatgtaagatgtgacttgctcctccttgccttctgccatgattgtgaggcctccccagccatgtggaactataagtccattaaacctctttctttccagtctcagggtatgtctttatcagcagcatgaaaacagactaatacaccagcttatcccagctctaactgacagcctcaagtgcacagatttctggccactcttttttgggggctctttctcaacctggctctgaataattaaccttattctcaaactttcaatccaaactttacttgtctcctccagtatggctttatagtttaaacttggctgagaatttgccccactattcatagttaaacttgtccctttgaatggaaattaatcccctgtattcattctcattctcactagctcctgtaactctcttgtccccatttctacatgggcatttatctgaaactctttatgtctcttacctaagatgcaatgacttttgcaaagcaatctagataaaattatttaaaaattgagtagctaacataacctttcaaagaagcatgtatttttggactctctcttatctgaggtgcaaatcactctagacaccattactgagctcagctgccattcagtggagtctgaattgcctgcataaaaatgactaccttacaagaaattattccataagaatcatcatggtctaaatgtatatatccaatacatttgtgtaatttttcattgacctaaaaatctcactttataagtgactgttttgatgtcatcaacatttgtatccacttcttttttataggacgatgtcttatctttctttaggctaccctgaaataaacaaaatagctgatggaatttcctgtgttcgcagattccaggctttccacaggttctagacctcaagtgatacattggtatatttggaaagatagatttttaacaataaaaaaatgaaaatgcagacatagctagttctaggaataaatatactggagccacaaggcaaaatctgatttttttttttttttttgcagatagtacaggcttaaaataactttaacccatctatgaggataatcacaggaatagggccttggcctaattaaaattacatattccaaaagatatataacatagctttcagttatccaagacatcagatacttggtggtttgtcagtgataaataaactttagctttataagtaaagccttaaaaaggacaaaataatttgtgtgtgtttgctcttatgcgtcattcaaattgattggttaattattcccttattgtctgagctgtttggcattttgcaaacagttttcacaaggcttgatgttctgaagaaggtgtaaattttccaaggtgaattagaatgaatgtgagctaacttattgatgctggcatcatgaattaaataactggttgttattgacttactgaaccaccagacatgtgacagaggaactcaactctatatagattcttaaatgaaagaacttgatcattttggtgactcaaaatgcagtcaaatttcttagtcatatgtcatgtgattaatttatgtaagcatttacacacattagtatttagttttaaaagtatttctgaatatatggagttcgatggatgtgtttcagaactaacctttacttgcatgggtttattttcattctgttgtcgtttcttgatttggaggcagttattggtggtctttggtcttaacctctttgatgctagtgctttcttctgttgaatactgtggacaggaggaccacgggcatagaccttcaaaggagtatatcaactctggctgaggtcccgcaggctttggcttgaacatgtccatgtgtcagtcagctatttccacaataatgctacataataaggtagcctctaactcaatgcataaaaatacatatttcttctcatactcatttttttctgggagtcatctattgtggctttactccatgtgttacattcagggccaagcttggaggcagaggacagagcacccagagggcaagaagaaacacaagctccttttcagatttaagcctgtaagtgtcatttctgtctacatttatttggtcagaccatgtgtcagtgaagtatactctcatggagcttgagggagactgtactacttagatttttattgctgtgtaatgaattgccacaaacttagcagtctaaaacaatacccatttattatctcagttccgtaagccagaaatgcagaggagcttaactgggatctctgctccagttcttaccagaatgaaatttatgtatcatctaggacttctggtctcacctggagctgaaggttctctgccaagatcaatgattattggcagaattattttacttctcacactgtccacatgggttcctccatcttaatttttttattttttttgggacaggatctcactctgtcacccaggctggagtccagtggtgtgaccacggctcactgcagccttgtcctccccaggctcaggtgatcctcccacctcagcctcccgagtagctgggactacaggtgttcaccaccacaccaggctgatttttttttcttttgcattttttgtagaaatggggtttctccatgttgcccaggctggtctcaaactcttgggctcaagcaatcctcagcctcccaaagtgctgggattacaagcattagccaccacacccaaccaggttattccatctttaaaacagcaatggaaggtcaagtccttctcacacttcaaatctctctgatagtatcctctgtctttttcttacttctaagagctcatgttattacactgaatccaccaggtaatccaggataatctccaattgagtaggaagcttattaagtgagcttgagtaatcttattcagtcagaagataagttcaactaattcagcttaagttattcaacttaagttattataacttggaagatacattcaactgattagtaaccttaattacatctgcaaaatcccttttgctatgtaacctacttaaaccacaggagcagcaccaggaagtgaaagtcatgatggtgaaaattctgcctaccccagaaacagaggcaaatatttgctgaacaatgtactacctcaccctagccctattctgacctaaaacatcaccatgacctccccagtgttcttgctccatgtgaccaattctcttctgctctttcagggaagtcctaattgggaaatgagatgatttcaactttttaaaacatctaattggttaccagcatgggcaacagagtaagactctgtccctacgaaaatattcaaaagttagccaggttggtggcacgtgtccatggtcctagctactcaggagcctgaggtgggaggatcacttgagcataggagtttgaggcttcagtgacctataatcacaccactgcactgagtgttaggcaacagagcaaaactctgtttctaaaaaataaaataagatatacaaaataaaatatctcattggctaaaatgtagtcacacgaccaagccacagaggaggctgggaaatgtagtctttagcagactagctgcatgcgcaaataaaaaagttctataattgtgaaagaaatgcagaatagatgttggcttaacactgcaggtagtaaaggctgccagtgttaagccaatatctattgtaatggcttatttacattctagtatgtcatcagtcttgcttacattacatcattttattcttatactatatccatgagggagtgacagttttctcaattaacaactgagaaaaacctatgatacttgagggtattagtgtttagtgggtgggtaatgtagggaagaaattctaggcagaaggtggtaggggagatgaggaagacagggtgaaatattattctacagtttagcaattgcagtttctttaatgttcttgtgtctatgtgtgtgtgtctgaatttgtgtgtgtttatgtgtctgtgtatgtgagtatgcctttgtatgtgttaattatgagggctgaaaatgagagctgtggttcaagagactagcattgtaaggttttaagaagggggctaaaatatttctcagaaattaaacattggagctgtttctttgttgcacctctggtgtctacagaacccatatggatcagctgggtgaaaggtgacatacataaaaggcatggtggctcacccctgtaatcccagcacttttggaggccaaggtggaaggatcgcttgagcccaggagtttgagaccagcaacacagcaagaccttgtctctgcaaaaaataaaacaaattatatagctggtcttggtggtgcatacctgtaattccaactacttgggaggctgaggaagaaggatcagttgagcctaggagtttcaggctgcagtaagccatgatggtgccactgcactccagcttgggcaacagagtgagaccctgtctcaaaaaaaaaaaaaaaaaagtaaggtgttttgtaattaaaatgagtcactcaagatatcactgcccagacaagggatacccaaaactattttactcgaagggaaaaaatatgtaacttcatacgatgttccataaaactgcagaaatgcttccttatgtttccccaatttatgctcctgtaattcaaacagggaaagtaatgaatatgtgtggagtttcccttccagaattgaaagcatcctttttgcaaagggatcatgtctcttcctgggtgaataaggatgataggacccttctccagaggggctcatccctgtttctcccctattcctgcctccttcctttgcacagactgtctttgaagtgcctccagcatcatgtcacaaggcaaatgtaagtcgcattaggactataaatgaattggaggagtagcaaatgcaataaactggttgctgtcttgagatatgacatctaaaccaaccaatatatctcagaggaaagacggcttttcctccttcctccttatttactctgaggcactgtataaaatgctctaccatcaaagaaatgatggcagaacagaaagtggaggtgctataaatttcatgcttggcagcttgcactagatgtatttcaaggtaatgactctacctagaacttttctagaatgacccctgtcaaagcccctattcagaagctacattcacttctgaatgaggtgacgagaagcttggaataggattagataatggatacatgtacaggctgctaagatgtttatggcctgtgggatttgctgtgaatgcaggagctgggccagtccaatttcttgccagcagtttgaaattgggaacttcagaaatggagtcagtcacatgtctgggagagtgaaaaccgaaacattgtgattctgcaaagatacggcttcatttctagttccttgggtgctaggttgtttctggtttcctttctctggatttcctgacgtttccatgatgtctcataaaaacgtgcacttcttgcccaacttgggtttcctcaagagagtatctgatttcacaagaaaaacaacaacagtctcactttacacaaaaattagctaatatgcactgactgtttactaggtacccgaccatattctaaaaactttatggatattgactctgttatttatcaaagggcattattaggtattttagctacattttaaaatgtggaaaatgaggctaggaaaggcacattcttcagtgtgactcagatgccacaccctcagcctctatattgtgtgacacatcagagattcacgtggaagagttaagttatatgttttactgaaggaaatgtgaattctgtaccggatgtattttatgtgttagttggtttatttataatataaggttctcagctgtcctgcaacagccattggactgacagtacattaaaatgtaagtggatcccaatccaggatttcagttaattcaattgatgactgctattggatattcctgaagagagggtggatctagagggaaaaaaaagagaaagctgtgcatatgagggaacaataatgatgacaacaattacaacaataatgtaaggaacagtattaagtgaccaaggaaaattgctcaatagactgtaactggaccaggagtaggtctgaatgagttgagtgaaagaagaagagtaaaaggtcagagcagaactcactcctgtgagtaccaggggccaaagcctcactcacattcttaccctcatacttctccaagtcttccttccctgggcaagatctcccccaccctctggtctcacagtgaggcagagaacatagtccttgaagcttgacaaacctacatttaaaactccaagtctgggctggatgcagtggcacatacctgtaatctagcactttgggaggccaaggtgggaggattacttgaggccaggagttcaagcctgcagtgagctaggattgcaccgctgcactacagcctgggtgacaaagcaagaccctgtttctaaaaatatacatgaaaaaagttaaaaattccatggctgccagttttgcgattttttgcgcagtttctcttctgtaatatggacatatggacacttgtcactttggagggtcatactgtaatataatgaatacacacacatatgtaaaagtgtttgcagtatctgtaatgtatgcctaacactcatttttcaacattcattggtcatccacctattcaagtgtcatggaatccttggagtgttgcttcaccagccagaaacctctctggccagtgacgccttctgcctgggtatttcttgcacctgctgggctcatttcacccacttggcctggcaggttgtgcttggcttgcactaccagcccagatctcatactcgccaagtgcaagtcaggtgcggagtggcaaggggtgtgtaggtgagcgagcatggggtccagccactgcatgcagctaggcatgctggctgttgcagtgggtcaggcagctccaggtgccaacacaggtgccagctccatgccaggctgtggctggacaagatgtactgcacacagcttctgctgtgggcactcccatctggacaagggaaacgtggtggtgtcctgaagcttggagatgccaggaactgcagaatcccaaagagggtgtcacagccctggctctgagagcccctgggtctgggctcccaaaagggaagcagctcttctcttcttctcgtcatctgcaccgttgtgagcggaggtgcatgtttcagccctgtttgtgttacagctcttttagtgctgttattcagtgggtctcaagtttttgtctcgtctccaggaagaatgaggtacacagacaactggagggtgagcaaggcagagaggagcttcattgagtggcagaacagttctcaggagacccaaaatgggtagctcctttccacaggcaggtcatctaaatgtctatgcagccctcagtggagaggagacctgcagtgggtagctcccctccacagacaggtcaccccaatgtctgtgcagccctcagtggagaagagacctggagtgggtagcccctatccacaggcaagtcatcctgacatctgtgcagccctcagtggagaggaaacccagaatgggtagctcctatccacaggcaggtcatgccttcatctgcccgaatctggctgagtccggggtttttatgggcttcagaggggaggaagtgcctgctgattggtccgtgggcggccatggccaggccaaggaaaagcaacattagttctcactgtggtctgtggaactgacagcctggcctcaggtcatccctggcttgaaggtaaggcctcaccagtgacccacccctttccacccagaagcctgtctgcctcctgctgtcatcgacctgtcatccatagtgcccatggcacccagactgtttacgccaaggggaacctgcaggcccacacagagctgccctcagccccactccttggcctccctcctgtggtcatcagtgcctaaagcccagagggggctgaggcagcaggaggctggtgtgtcagtgctgcctcaagcacacacacacccaggtgaatcgtgacagcatctgggcttgacctcaactttgctgcaaaatcagactggatactgggagtggggagaggccaggcagttggagaaggcacttctgagcctgtggagggaggggagcttcccagctgatatggtttgcctgtgtcgccacccaaatcttatcttgaatggtaactcccacaattcccacatgtcatgggaggaacactgtgggaagtaattgaattatggggacaggtcttccctgcactgttctcttgatagtgaatgagtctcacaagatctgatggttttaaaaatggaagtttccctgaacaagctctctttgcctgctaccattcatgtaagatgtgacttgctcctccttgccttctgctataattgtgaggcctcctcaaccacgtggaaccataagtccattaaaccctttttcctgtataaattacccagtctcaggtatgtctttatcagcagcatgaaaacggactagtacaccagtccccaagagcacagggatgcccaggtctgcagccatggctgggtggctgcatctgtgcctgtgagggtggggctccacccctctaactcagaagggggtggggctcccgcctgttcccagctcccactggctccatggagtgaacagctctggccacgtctcccccaccacagccggcatcatggcagtggccactccagacaggtctctgttgccatcacaagcatccttagcccatcctcagatggtcttttcatccataatgcatgtcgtattctattccacatggcagctgttcataccgtgttcactgtttttgagtttctagtgctttacaccatccctctctctggactcttacttgattaagaacatggaattcccttggctaacccattttcaggttttctacctgtcaactcaaatattatccatgtcattatgttttattttatttctttgttgttttgtttgtttgtttgtttgtttgtttttgagacaaggtctcactctgtcacccaggctggagtgcaatggtgcagtcatagctcactgcagcctcaacctcctgtgctcaagtaatgctcccacttcagtagcccaagtagccgggactacaggcatgcaccactacacccagctaatttttccgactttcagtagagacaaggtttcactatgttgcccagactggtcttgaacccctgagctcaagtaattctcccaccttggccttccagagtgttaggattacaggtatgagtcactgcccctggccatttatttctgtctcagcagactttttttgcaagtctcacctgttgtgctgggctctcaaactcttgaactcatccactgtcctctctctaggaactttttccatctggaattttcttttgtaacatcagccctttcctctccaccatcccctcccaccctgtgtccgtcttcttaggaagattttctttgaccctccttccctgatacactaatgcttcatcacattcttggttgcattcaagcctttgccacatcataacacagtagtgcatgccattgattttacttctacctatccagctcgcccttcaaccatggaacatcccctctcatacagttgtccatttagagctcttctttccaagtagttgcctactcgagtgacctcttttcacgttcattctaatggaatgctcagtgctatttgacactgctaaccaatgcttctttcttccatgtccccccttttaagaagttttttagatttaggtggtacatatgaagatttgttacatggggttattttgtggtgctggggtttagacttctattgaacccatcacccaaatagtgaacatagtaaccaatagatcattttcagcccttgtcccccttttggggtccccagtgtcagttgttgccatttttatgtccatatgtacccatggtttagctcccactgctaactgagaacaagtgatatttgactttctgtttctgcattaattcacttagaataatgacctccatctgcattcatgttgctgcaaagaatatgattcattcttttttatggctgcatagtattccctgatgtatatgtaccatgttttctttaatcaagccaccactgatggacccttaggttgattccatgactttgctagtgtcaatagtgttgcaataaacatgtgtgcacaggtgtcttttttataaaatgatttgttttcctttgggcagatacccagtagtggatcagtcttccttgttgggtctaagacactatacattccaagttctcttcttatctcattagatcattcattttcctttgatgaattatctgtttccccactatttctccattatcctattcttgctgcctttatattaagtgtagggatttctcctttgacctgtgtctcccctgagtttatacttactcctggttgtaaatattttcataaaaatgacttccagttccttcccctccactagtttccacctttacctagaatttccctcagtattataaattccttgctagacacttaaactcaacacattccaaacaaaatgaatcaacttcccctttccctgagggaggaaaaacagatacagttgtaccctttcttttggttcattgtattaccatctttcaattcatttggccccaaaatgtggaagtcaccttttgtttctttctcaacgtttcattcaatttgtatcgagttatgttgattccactttaggaatatctcttgaacttgtaaacttttattgattccaaatggcagtctcttagttcagggtcttatcatatctgatctatattatttctgactgatcattcttcctgcagcttcctgctcatgctaatctgttctacagacaaatgcaagaactatctttcacgacactcattcttcgaccttatcttttctgtctccattggctcttctctctgtgtttcttaagcgctggctgtatcagataacttgccatttcctctttttgtttgtggccatctatcttggctcatgttagcagatcctgctgtctggtatgacctttcttccttcccctctactgaagtctgtattagttttctgtgggtgccataacaaaataccacaaatgtagcagcttaaaacatcacacctttattatctcacagttatataggtcaggagttgaggtgagcttggcttgtttctctgctggaatctctcagatggctggaatcaaggtggtcagtggcctgacctcttatagggagactctgaggagagcccactttccagcttactcaggtagttggaagattcagctgtcgaactgaggtccccctttcctgattggctgtcagccaggagccattctcagctcctcctggctacctgcgttccttatcatggtgcctcctgcatttccaaaccagcaacagtgcattgagtctttcccatgcttggaatctctctctgacaattccttctaccacgtcttcctctccgactggagaaatttcctcactttttagggtgcatgtgactagattaggttcactgggataattcaggattatgtccatctcttaaactctgtaaacttaaatccatctgcaaatgtaattgttatacaacttcacatatttgtaagttccaggtattagagtgtggacattattgaggtggagagtggggagggcattttgcctaccacaaaagtgcagtaatttctcagaatataaactctatctctgtaaagtgattttcacttagttgcgtccttcggggtattaccctaaccttgtacttgttaatgtcctctgacaattgtgcagtattttattataggaacttatttacaaatatgtctcctattatcaataataaattacatgaactcagaaaacataccctaatcaccttgacattcctatgcagaatctcacagtgccttatgtgtttttgtcaagtaaactgagtatgttccgtaataatttgctgaatgtttattaagcttttgctatgtctgaagcattgttatctttagatgagaagcaatttgaagacatcaggtagagttaaacatgataggtgaactttcgtttgtgttacatcaaggcacactgatgtatatagaggaataaatacccccacatactcaactgtattaattgcatattgacacataacaaaatgccacaaacttaggggattaaaatagcacatatttattactttacagttactatatgttaggaatctaggggtggcttgattggatcttctgtttcaaggtcttccacaaagctacagacaaggtgtaagccagggctggggtcctacctgaaagtttgggtgaggaaggagttgcctctaagctaatgtggttgttggcagatccagttccttctcagctatttggagaagtctcccttagtttgttatcacatggtcagctccagcatagcagattgtatccaccgagtgtgaaagttgagatggcaagaagatctgaaagcaaggcaggagttagatgttgtgtaacctaatgatgaaatagatacaccatcacgtttgtagtattctattagttagaagcaggttactaagcgagccacacagaagggaagggattacacagggtgtgggttatcaggaggcagaaccattggaggccatgtgagcatcagcttgtcatatgcacccatgcagagacacagatacataagcagattaaatcattcagtagatggaaaaacatgtgcattaggaggagagaatgaaagcagctgatcatagagtttgttgggattgtgaccaagaaattagatggaggggctgatattttgaggaaagtgatttaggagatgagagaagatgaatggaatcctttatttataaaagctcctcctcaaggctaaagttagtagtcttgacataaatgatcaagtaatgccccaatggttaacaaccctgtctgcccacttctgaacatataaaagcataacatattcctgtgtgcagaaatgaatacgtttctagaatggtggttcttaaatggtttggtcttaggacttcttttccatcttaaaaattattgaggaccagcttcatccatgtccctataaaggacatgaacacttggacacaggaaggggaacatcacaccccggggactgttgtggggtggggggcggggggagggatagcattaggagatatacctaatgtaaatgacgagttaattggtgcagcacaccaacatggcacatgtgtacatatgtaacaaacctgcacgttgtgcacatgtaccctaaaacttaaagtataataataaaaaaaaattattgaggacctcacagagattttacttaggtgggttatgtctattgatgtttaccaaattagatgttaaaactgagaaatttaacaatgtttatgaatttatttaaaaggcataataatcttatttcaggttaacataaaaacaggtttattaaaaataactatatttcccaaagcaaaaaaaaattgtgagatacagaatattctatgtttttgaaaatcttttcaatgtctgatttcagtaatagaaagctggatccccatatcagccgatgtactcaatatcttgcaatatattgttttaatttgtgtgtatgaagaaaatctgtcctctcgcagagatatagtttgaaaaagataattagataattgtggatattcttctttaatactataccaaaactcaacacggatagtttcttaaaggttcattaaaaagtgtaattggaacccatatcaaaaacctttctgtcctttgtaacgttaaaacccattgttttatcttacatttagcatgcatatttgacccatgcaagattttggaaaaatattggtttactaagttatgcatgacttgcaaatattcatacatttcattatacaagataaaaaaattcacatttattgatagcaccactcatttgattagggaagaatttaagtgttgggaggtcatcaagctcctggcatcagatgtaagatttctatttttttattttttcttgaaatcttgaatcatatcctcaacagcaaatactgtcagttgttttccatgaagtgaaaggctcactttgttcgtgcttcaaaaaatgtctgccaaatagccaagtctgaatttccatagattgactgttagtctttgaaatataagtggtagctactatttcacatcaccactgaaatagtggaacgtgttcttttcctggagacaacatctagcttcattgtatagcaggagagctttctgtgtacttcccatctcatcatgcagaatattaaaaagacatgtattctggaggtggttaagaaaatcaaaattttttatgtgaaactagcatcccttgactgcaaccgcatggtggtgatgaataagtagtagtaccatgtgggatcactgcctcgatcaggtctaacatgccagccgtctttcctgttgcttgtgcaccaccagtgcaattgttagcaaggtaaaaagaagccagtgacatctcagtattatgatgaaaatagatgtgttctccagtatcccttaaaatatctccccaactcccaggggtctgatgtacaacgttgccattcactgcactgcactatagcaagcagcatgttcaagtgaccctccaagaggagattacaaacatcaagatctacttaactcacaactccactgtactccctatcctcagctacaatttagctaaacattgtcttcctctccaatcacttctctagataccagaatgaagcaaaacttctcaacttaggaggaaacttaatactggctacttctatatgagccaaaattagatcctcagagcttcctgttttgttatttgtttttggttttgattggttgacttgaatttattcttttgattgtagtttggtgaatgtctgtctgttcaatgagacccaatacctctttgaggattttgtgcctttcctaattagttatgccaccctttgaaatattcaacactttaaagatctttgttaaataaaaataaagaaatatgtgtcatgtaatcaaacgatggagaaaataaaggtacagtttagtgtataaaccccatagagaatgcagctgtctttgtttctgtaatagcaaaatagcgaattgaaaataaaagcaaattgacacaatctttcaattctgttctactaaaacacaccttgaaaagctcattgaaacatataacagaggcaacattagcaattataaattaaagcagttcgagatagagagagagagaaatagtggttaaaatgaaaagtgattaaataacaacctaactcttaaaagcaagtgttctataattgctcttaatcaatccagtttgcataggggaaatagcttaacgtgtagaggtgattctcagtgctcatggcccagcagcatttccatcttaaagcttgtttggcacaatgtgggttagaaatttgtataaatgctttgattatggacaattttctatcccaggtgttatcactttacatctgcccaagacctgatttcccagattgtaccagcgtggctttccatgatgaagcaccaacttgtatgtcttcacagcctgacagagatgggagagctttaggttctactaacaaggatgtggcaatgataatgggggattccttcactttcctctgagcctcggttcacttttctgtgaactgggaataaaaacatctcaaaattgttgtaaaagttgaaaatcatatatatggaacactttgcacacagcagataataagcataactattgtttttattttattttattttatttattcatttattttgagacagggtctctctttattgcctaggctggagcacagtggtgtgatcacagctcactgcagcctcaacctctcagactcaagcgattctcccacctcagcctgccaagtggctaggaccacaagtgtgcaccaccaggcctggctaattttttaattttttttttttgtagagatggggtcctactgtgttgcccaggctggtctcaaactcctgagctcaagcgatccctctgccttggcctcccaaagtgctgggattacaggcagaagccaccatgcccggccaactgttgttttcataagggctattctgtgttatcacatagccattttcccatttcactgatgtctgagaaaactatttaaaaataatgcaattatcctcataatttacctcctacaaaacacattctccaaggcatttcatttaccactaacaaaccagcttttaccctcactttgtttgctcaccatgtcatggtaaaagatgaataagtagttgtacagtgtgaggtcactgccttgatcaagtctaacatgccagcagtcttgcctgttgcttgtgcaccatcagtgcaattgttagcaaggtaaaaaaggccagtgacatctcagtatgatgataaaaatagatatgttctccagaatcccttgaaacatctccccgactctcaggggtcttaagcctgagcttcaggtttgtgatgatcaccttttcttgataaactctttctggataaaggtgctccatgtctggtttccttgttgatggttcttcatagcctacatgtctggaaccctcagagaaagtgaggtttgctaacatgactatcataattctttcatttgcaacactagcaacagatctcaggttccaggataaatgtgctatgacgtggtgatcctccagagagtctaccttgaatattcactaccaagacctgcttcaaaatcattggcccgttcttgcctttcctttgtgtgcagcattctgagaggagttgaaagagaggaagacaagaatgccttagttactttctgtggctcttgtgcattattaattttcttaacaaaaaaaaaagccatatgcatgtcaagattgattagaatccttaatgacatacttaattttaggagtgccataccatgacttccagcaaacagaagtgactgttgagaaggaatgattcaccacctactagctatactaatagttacacatgaatatcgtgtctaatgatctcagtcaagctgcctcgtaactttatgtctgcgcatccatttacacttgtttttcctaattgaaattaattggaataaatatgtgtcaaatagttaaactcagtaatctaattttaagaaaatgattgcactctttttcctgttaatgagcctggctttttttttcttcttatcaatctgtcctttgataggtcttttcatgacaatggatttttcatatcccaggctctcaagtccctcagaagtgtagtaagtcaggtgagattcaggatctgcctgctaatggggaaatagttggtcagttcagtcacgttgccaaagtagttaaggcagagagaaagcaaatccttcatactaattggcagcatgtagctgttccacgtagtaattatttcatagatgctgaataaatatgtctgaaatgaagagaactgttagaattttttgaccttgtcattctgtactgaaataaacacaaccacggacaactaaatagtctcagaatgttttgagagcttattgcacgtaagtgacttattcataggcaaggctgtattgctgtgtcatcacaaaacctacaattggcaatgaccttggaattagtaggtatgattactacatgtaaggtgcttagagcaatgtcctgtattttctaaggactacatattatgagtatcatttgggataacctctgtggtcatccagaaattctacatgcagagtttggaatgcatcacatgacaggatcggattcttcttctacactgttgtgtgctcatgtaaatcaaaatacttcatagtgcccaaagttccaatggtttattgccaaggagaaacaagttgcgtgtcaaggggaccatcttgaaaccaacatattcttcccacattagcacttatgcagattaatttaaaaatataatctgcatgttggtaattctatctgaatgtcaattattattaatattattactgagtcagtcatgtagatttacacatggtaattaacacttttcacatattatatggatagatgcatggccgatgacatggaaaggctgtagctttcacaaatcttcctagtggcgatggacataccagcataggctgtccctatgtgccaacttcaaaaacccagcttggtctcttgggaaaactggaatctaattggatactttaagtgtttttgcatggagctgtcagcatatacatcttgttgcagctgtgaaccatcaaacatgtgtacaactagacttaaaaaaatgactgctacacatttgtgtaaagttggtagatgcatttacatgaaaatcaactggtgggaaattcatggaaataatccaagcagaatagaaaactagggtaggtttgtcagtcatctgagtaagtgtcatgattctgtgattctctttggctcaggattcagtctgttgaatgaatttacaaaacaaaaaacaaatacccaaaagcaaaaagaaagctcgttgcaatagccacagacttccaggccaaaaaataaacatatgacaaagtatttcacactgcattataggtgcatgaagaaacaatgaacttgcattattgtttgtgttgcttcatattattgtcaaaacctctatttcctctgctgatgggggcaggcagaaaagctcaagcttcaacttgccagtcaggataacagtctcttccgatcttatattttgggtaaatattcagtcaattcagaattcaatcttcatcaggttagagtcctcctccactccatctcaaacgctgcttcccatcctcatcataaaatagtgtctgggttcaggagaagcctttcaatgtttgtgcatgtgagagtgtgacctgtgtagcgaggtgccttttttctctgtctttctctttgccctgctgaagcacctgcagctggcatagctcagggacagttctctgaatgaaagggatccccatcttggcttcgctggtcctgttgctcatagatttcgactcttctttccattggtctcttgttttgggcaccccagtttgcagtcctccaatatggagtaatttcactccccatctgaaagaaaggcatgccaaacactgtctccagctgtcttctagggaggaactactggctctcacatcaagtgagtgtagagtttacgggagagtcagaggggtagctgtttgggagatttccctaaaagtatttctcaggagatgtttctttgcctaggcaagggatgccactaatactctctacttggattcctctgcctagacttcaggagtttctctccttctctttgaggttctcagcttaaagaacttaacccacccttcatgtcaactgcctggcttttcctctccctcttctcatctttagttcatccttccaatatcaaataacttatttcacctttatgtctcttgaggactttctttatatgttaacttctgtgcttctttaattgcttacagcaaaatgccaggattgtacttccaggttttactttggtttatcaagaaaaatgttatggacttagaaagccttttcttttgctgtcaataccttgcgtgcaaaacgagaccatctctgaagattgagacacatccactttgcaaacccaaaatgcagcaatgagatctttattctaggcatgtgtgcctccttctgaaggaatcagctctcctggttcaatgggttcagtgggcagagtttcatgaactagggagaagaaaacatattttggtttactgtttcagatctattgtcagctttatatatgaatatgtgtgtattttttattgaatcaccaatttcccatctactactagttattaaaataagccagttttatatgtttataattaggaaaagtagcagttataaactgtaataccctaaagggtggcatgatttgagagtgtgaataaactctaaagaacagaagttgcaggccgagtgcggttgctcaagcctgtaatcccagcatttgggaggccgaggtggggggatcacttgagctcaggagttcaagaccagcctgggcaacatggtgagacctcatctctacacacacacacacaaaataaataaataaaaattagccaggcatggtggcgcacacctgctgtctcagctactggggatgctgaggcaggagaatagtttgagcccaggagccggagtttgcagtgagccatgatcacaccactgcagtccagtccagcgtgggagacagagcaagactctgtcaaataaataaataaataaataaataaataaataaataaataaatatcagaaattgccaatctcatccttgaagacaatgggcagaatctctttatagcttatggtgtgctcaagtcctcaccccaaattccagtctttatctaggcccttccagccctttgttcttgggatcatgttgttattcagccactccagggtttgtcaacctaggagaggaatgaaatataccccaccaactatcgcccatcaagttctggaaggaaagagaagagcagtgtgggtctgctagctctggagatcctagtttgtttctacattgggcctcattcctcactctgctctgatcctggtgttgccttgatcctcactttgcctcctagttcctgccttcctgctgggctagaatattcccactccagttctctgctcttttagcagggtaggtactaggaaggtaggttatcagtagttgtgggaggaagatagagggtgtaacaccatgcactcatatacacacctccctccagcactaccattgtaccccaagacatgtgtccactgacttacccacattggcttaggaagggctcctgaaccctaaaaatgcttaagagagcaaaagtggcataaaagagactgagctttggaatctttggttcagattcctagttggtcatacactagctgtgtgaccctgggaaaattactccatctgttaaaatttcaccttcctcacctacaaaatctgaataattttcacctgcctacatgacagaattcataggagagtaaatatggcatgacaaagtgcctagggcatggtacactctcagtaaatgctgatttttcctttccttctggaggcttacctgtaacaacctattctcagctgccccatgacccctgacctcagctgcatgtctaggctcaaagtgtcttatacagtacaggtgctgaaatccagaggtttacatgcaaattggactgcataatttctgtgttttttttttcagtgtttatttcaacattagtctccctaatattcatggttttcaaggtcagtggaaaatcatgttgattcgtatgactctggatgattagagtgaagggcttttgacttcatcacttgtagctgcttaatggctgaagaattaacaaaggagaaaatagtgtgaacatgccaaaggaatggtgattagagttgcatgattgaaaagtttgacatgtgtggggaaaaatccatctactgccctgtcctttaatgctgtggcagttttgctcatatgcatgagtaaaatgcaatttctaccagtagaattcacttttgctcagaggggaaaaaatgcatgtgtcatagtaggatctgggagttggaattcaaaaggtataatctaatgagtgggtaaagagaaagacccaaagagaaatgtttgagagtgaatggagaggagaaaggagcaggaggagacagagagagagagatacagagagaaatagcttacagaggtatttttatctggtattgtttactgggaaccaaattgattcaactactgtatacccagccctaaacttttgcctcaacccagtccactgagacataatcactggttagctttgaaacacattttctaatttcatttcttcattgttttgcacacttcaaggcatcctagcttcaaccagaaaccaaagaacatctgcaatcacagccggacacattttgttgcaaaagtcaacattgctgaattccagtcctcttgatattctgagcctctcagatgtcaggggatatcttgtttttcaacatactctattgaaatgttatacacggctcatgaaaaatatgccatttgatagacttcataaatccatctgctataacagccactatgataaaggtcaactgtggagtgtgagggcatttcctaatcctctccattttcattctctttaaccctgtcagtccatgaagttgctactaaagcttgatgctgtagctatgcatgctgcctgtaccttgtttttagattcttatcagcgtaaatgtgcatgggatccttatggctactctgtaaactcctaaatttcccgtccttatctgaggaagtgctaggtactgctaaagtagaaaagtcagagccagaggagatttttaatataaaataaggcccaggagaagagcaatcttagtcatgctagatatttctgaagcataacttcttagtgggagataggaagtaaggaagctacttgcagtctctcagctgggggcctcttctccatggatagcaattcagagatggaaaactatagttctattctgcaactaagaattatttcttatgggaccctgcatttctttttcctactccctatataatcccctccaacttcagataatctcaagcctgttcatcaatttaaaaaaaaaaagtactaaaaaaagagatttctactttatttttggctcactctttaagttatgcacataggaatctacattttctagcctccaaagtgacgtggatggtagggacagtaatggaatgaaaaagtacatctggttgagctaatcaatttcaagcacttgactgtttttgctttttgttttcccatagggggaatccagaagcctttctaaaataatatgagaaggcatgctattgagaaaattcctcaaacatgagtgtgagggtgttgacaaagcctaggaagagagaaattactcgttatgaataggggttctatcttttgctgataaaaaatcaggaggaaagaagaaaagcaagaagttaggggaaagacaatgccataggaggtgaagaatagatcaagacattctttttcctgtattttatatttctcatgtataatttcattgcatttaatccttctattatcttgagcgtacagagagtctgtaacatctattggaattacgcatgtaaagtctgtgttctaatggaagtaaaatttgttttctcagttaaaaatagagacaatttttttccaggccctctcacaagagtctggaataaatcaacatgtttacaaatacaataaatgtgctacaagccaattggggatttgtttgttcacattttcccaatggctttggacaggcggttcaaaaataagcacaattctccatggaatttccactgagtaagagcttgacaaatgaaataaatccaagtgctgataagagaaaacatgtttcttataatggggaaggtgtatatacacatacatatatgtgtatttgtgtgtgtacatatatatttgtgtgtacatatatatattccacaatttttactaaggtagtatattgacattgctttgctgtcattccagagtattgcaaaacgaaatggattccccacatggcatgtagcttacatattgttggtgaaacaaacaggcatgactctaacaaatttttcctctaacctgttcttatgacaataatgacatctaacattccttaagcacttgtgttgagctacgtatttataaattaacacagactatataatcttttcctagtggtagaagcagttttctcatttttcagattaggatattcataggactaattcccttcaaataataaactgttctagagagagggctccaaattaagccaagaagactttatgctgacaacttatttctattagaatactagagaattaattcacttattcattcactaatgcatccacttctttgggcacctagaacagcgtctagcacaagatgttcactcaataaatatttgttgagtgagtgaatgaatgaatgattgaatgagcaactctcatgtataatcagctaggctcagagggctgggaatgaaaagttgacgccaatagggctgatatcctcaagtctgataataaaaatctgccttgcaactaaatggcagcaattagagacagttgttataacatgttaaaagggaattcttggagaaaaatataacttaaggtatgaccagaaaaggttagtggaagagagatttgaccctcagtatggggctcaagaagccaggaatcatgaaagggaaagagaagaatagaagaaaaaaatagttggaaattcacaaagggaagaattgcaaatagaaggccaggccatggcaagaggaaattcactgtattattcaagtgaagaaagtgtcctctcaaaatcttagatgaaaactttggaaattcccattaagccaagtgtggtgggcagaataattcttctacccaccctgaagatgtccatgttttaatacctagaatctttgaatatattcctttacatgaccaaagggactgtaactctgcagatgtgatgaagtcaaggaacttgagatgtaaagaggatgtcgaattattcaggtgggcttaatatagtcacaaggtccctataattgaaagagaaagttttagctctttgaaacccatttcagacttatgactgccagaacagtaagcagtacgtgtgtgttgtttcaagcccatgtttttgataatttgttacagcagcaagaggaaactgatacagtgagctaatctagaggggcacacattgtcttctcaaattctttttttttttcttttcttttctgagtgtcttcacttggcataataaacacccttggtagctcaagagcattaaaagctgtatactgattcacatttcttacctgagaaacttagcagagtggtgtttaaggtatttaaaatgttgaagatagcctcaccctttgaattgaaccttcacttgaccttgtgcctctcattggtacagtgcccaggtaaaatgattcatattgcttttcccaccctaagggcaaaatcatcagctcacatattacaaggaagatccaccacctgtcatcttcattctggggaaatacagatgtgcacattatttttttcacagaagtatggatatcagaaaagcctctcaatgagttttcaaaatatataggaggaaacagtctataacacatcagttctttacattgagtctgttaacctttgccttgccaacctttcccttcctcttttcccagagaaaccgatcagttctttccacagaaacataaaagacattagctcacaagacagcatgtgttttctttttttgtaagctatgtttgaccacagcatgtattttcttatctttctgcaatgtccgtgatgaaaaatgactgtattagatcatcaataattatgacattttctgagttggataaaaacccactatcaaacggataaccttcaaggattcaccagaaaacatggattatatactgcaggttttttcttttactttttttttcctttttaaaagtgatacatacacagttcgcttttggtgggcgggtggggcagtggttgactgtgaaaacatcacaggttctttagatttctatgaaatgaggagatccaactgtgttccaattttaatgtaaagttgtcgggatttctttccccttaacttcaaccctgcatgaacctgcatatacaaaaaggtgtattagagtcgattcttgatttgaaactagggcttctgatagaaaagaaatagtagacacacaatgactgaggttcagccttcttgatcatggggcataaatcaaaccctaaaatccagacagtcttatctttaattcactttacagccctaaagagatgagtgagttttgatctaacagaattcctattttccaagcccacaaaaaaattttgttcaggcctgagtttgaataagtgctaacatttgtattatttcactgtttgtaattgtccacaaagacaattaaggtaggaaacgagtgactgttttaaaaacatcagcaggtagccacatgatgaaatgagttcagctggttttcatttgctcacatgttctatcaatatgatttagagttaaagacttaaagacctcaaacctgaactttctttttttctttttgagacaaggttccactctgtcactcaggctggagtgcagtggcatgatcacagctcacggcggcctcaaattcctgggctcacgcaatcctcccacctcagcctcctaattagctggacgtacaggtgcacagcaccacgcacagctaattttttaaattttttgtagagatggggtttcaccgtgttgcccaggctggtctcgaacttttgggtcaagcagtcctcccacctggcctcccaaagtactgagtttacaggtgtgagctcctgcacctggcctcaaacctgaactttccgagataacagtactaaaaatgtcatgtattctttgattgaataatgacaagagaaggactaattaggacaacatagaataatatcaagtgcaactcagagatccaacatgaaaagaaaggcaataggaagagatgttcttcaaggtgtattaagtgcctataagggccctagattgttagtaggagtttcatggagacagcaaagtagaagtcagaattggggtgagggtatttatgttggataatatcctagtatgagtgctaagaacttatgggcaagaaagtgtccaggaaataaatgtgataaaatattccgttctagaaaagcccagtggaaaataaagtgttgggttgatgtattttactgtagtaggatgaagtttgagctgatctgttagtaagggagagttagaaaggcaaagctgttttgagcaaagcagttcagaggacaagagtcagtagagtttaacaaatcacaatgacattttgtgatgagagaacaacagtggaatatggtttttaatcttgcatccaaccatctttgaatatatgctgtgattggtcttgctttttatttttattatccagtcctatgatgtgcagtctttctgtcaatgttgtagttttcgaatttaagagggaagtatctccatgagaaataagaagtatccgatggatgtgctaacatctcagaggatttttgtttggctgcagaggacaaggctcccagagttggaaaaccagggtgaaaatggagaataaatgtatttagtgctggaggaggcagcgtgtcctctttgggcagggtctgtgagatacagtggtagggtgcctcatgaatgcaccaggcttcgtcttgccagaagctgtgtgtctagcagtagagaggaaactttaacaccctatgttgcttgctctaatactctcaccataggaggagagagacccatctggaggctgcatgcagcggcctctccccttcacttttctactagcaaagttgagcaatggctatgatcatgagctagaaaagagcttagattaatcttcttcatatatatagttctcctgctggtctttcactatgcatcctgaactgccccctacccccaccacactcccagtgatgtgaatgcctacttactattccaagtaacaatacatgttttggttttggactcaggccgtctaaacttccatatgagatctttcctttgctgtccttgcaatgttggaaggttctttaactgttctctaggattctttgttctcatctctgaaacagggcagatggaatgatacctctctcattgacttgttgtgaggatcagaatgagatggttcatgaggaatgatttgcacggtgcctggtggtagtgataggcactacccagtggtggtcatgatgattatgatacatccatgaattctaatactgtgagctccgttgatggtgaggaataatctggcagctccaggagggagtatacattgccatgccattgttctctaatgcaggtgtagaggtctccttatgatccctaatcattctcttgcttctctagagcttccattgaccttcctccttcttcttcttgctttgtgccctgggaggatgaccaatgtgggctatgtcagtggatcccatgtctcctgtggtgtgggcaatgataagccctgttgttataggaacaataggtttatatacccattacacagtaacataccaaaacaccaaagcagcagggtttgcaacaaggaaagagtttaataatcacagggtgctaagtgaagagatgggaggggaccttcaaatccatctccccaaagagatcttggctgaagcttttaaggggattgtggagggcaaggggctagaacattggggtcattgttcagcgtaagggggttgaaatcatcaggatgtggcaactgcattctttgggaagtcaactccttgcagggtcctttagaccagctggcatcagtcatttttttggtatgcaggtcctgaaagaatatcttaaaggaaaacttaacttttcacgatgcttaagttgttatctatagagcagttatggggagctataatctagactcggacaatagatgccaaaccactatgaggaaacaggtcagagagtgagctaacctagagattaatgctgaatatgctgcaagcttgctttatttttgtttctaccccccccccgtttttctttgattatttttgtaaagtttatggggatggtatcactgatgggaaatccaaggaagggtggagaataaagataggtgcctcttcccccagcgtgctccctgtgaggacatctagggctgggatgacctcaacagagaagacacctggtgtcttcttgaggtggctgctagaggcaaactgctttccttccagatgtcaggagcctgaccctcaccaagacttcctgcatggtttatgacctccctacacacatttctacttaataaattaaaacaacacaatccttttacggataatcctaatttgaacatgccctttgtttctctttaggacttttttttcctagtatgccctataggcagacacactttcgaggtgatgaattcctgaacgattcacagaatgtgggtttgtgaatgccagcctttcaggataaaatgtgctacttgaaacagctttgtgcagataagtgtatgatatctgttgcacagtagggtgactatagttaataataaagtgttatatatttcaaaattgctaagagagtaaatgtcagatggtctcaccacaaaaaaataagtatttgaggtgatggataggttaatgcacttgatttaattattccgtattataaacatatatcaaaacatcacattatactccataaatatatacaattataacttatcaaacaaaactttaagaattaaataatttagttaattgaataaaaggctttgtaatatgaaagcaccagtaaatgttgaggtctggccacagaatcattttactgagctgtgttttaaggttacgcatcaggttcatgctctgtaagtatggttttgtttttgtttttgttttttgaatctcactctttcacccaggctggagtgcaatggcgtgatctctgctcactgcagcctccacctcctaggttcaaacaattctcctgtctcagcctcctgagtagctgggattacaggcacccaccaccacgctcggctaattttttgtatttttagtagagacggggtttcaccatgttggccaggctggtcacaaactcctgacctcaagtccacccacctcggcctcccaaagcactgggattacaggtatgagccatcgcacccagccaagtatggttttgaacatgaacatagtcagcaactcctcactctattatttattattttttattttttaagagacatggtctctctctgtcccccactggagtacggtggtgtaatcatggcccactgcagcctccaactcctgggctcaagtgatcctcctacatctgcctcccaagtagctgggaccacaggtatgcaccaccacacctggataattttttctatcttctgtagagatggggtctcactatgttgctcaggctggttttgaactcctggcctgaagaaatcctcctgccttggcctcccaaagtgctgggattacaggtgtcagccaccacatctaacctagcatcactcactttaaatgaacacatatcaaatgcatagtaacagtcttgataccgtatgtatagtaataagtcttttaactataaatgttttttatttgcgtagatggttcacactaaaaatttaccattaattccaatttatgatactaagttgtatgtctggccatataagtatagcaaacatactacttctgtatttaggtttgctatttagttcagaacatttcactttaaaattttacacaaatgaaatagaagaaattattcaatttctcccagcaactgcagggaaatcccagcacattatttccctggttttcaaacaccaccatgaccaccactgtattgctgttcatcatagaggattatcattgattgtggcccttctgctggagataaaagttctcttctgatcatttcataatagcccatgatattagatatcagtttgggtgctggaatgactgcagaaaggtcactcataatagcgtgggggacaagagagtagcagtgctgccttctgggtctgaactgaagctcaattcagggatctcctttgaaatactttgggtttgttctgttggcccatggaagaacctgcaaaaatgtgtctttaccgagaactcaaatatgtagccctagttcattgacaggagactatctctggtgcagtgagtctcccagggcagtttcagaacacaatagttcactctgaatttattcctcccttaatcctctacccatttctggaaatatctgcctttccctcgaagtcaggtatattaaaaaacctagcaatagcactggagaaaacctcttgaaatgcagaaaatagagtgtcaaatgcaatcaggcatcaatagaaccagccatccatccccaaattgatgcatccaagagcactgtacatagtttttgtgtgtatttaataatattttgtccaatagtttttgaggctccaccaatggtgagaaatgccttagagactgcagctttgatattctccagttgtctttaagcataagacagaatataaagataaagcatagactccatattaaaagctcaccttaagttctataagagattttatctgaaggagtaaaatgcagaaaatattagatgaggaagtttctgtgggaatgagaggcttggttagcccttcatgttgtatgtgaaagaattccacctatattcgtgctattgaatggattttcctttccatcaacagacatattgtaaatgtagccttaataatcaaggcactcaaaactgtacgactctccttttcttggttgagaagcctaataaatgctctgaattaatatttagaagaagaggtgggatttacacattttctcgtcattagcatagcaaagataaatgtttccattctttatgaacctatgtatcagcccagttttagctactgaacttgactataagttaaggtctttgaatatgtagcatgccagagtagatattgaagcctctgattccttaggaaagagtgtttgtgaaggagtagtggggatgggtggtgtattattatctcttgttgcgcaacagataaccacaaacttagcggcttaaatcaacacccatttttctcaccatttccatgggtcaggaatctgggtgcaacttacctgggtcatatgctcagaatatctcagggcttcaatcaaggtgtcattaagctgtgctctcatctgaagacttggctggggaagtatctgctttcaagctccattgagttgttggcagaaaccattttctggtggctacaaaattcaaggcaacttgcgccttcaaatccagaaactgagaagagagtcagagagaaagagagaaaggaggagggagagtcaaagagaagattctgctgcttggagattctgacttcagggtagttctaggtccttattttactgtatttatttttcagacaggttctcactctgttgacaaggctggagtgcagtgacacaaccacagctcactgcagccttgacttcctgggctcaagtgatcctcctgcctcagcctcctgagtaactgggactgcaggtgtgcaccaccaaacctggctaatttttgtattttttgtagagatggagtttcgccatgttgcccaggctggtcggaaactcctaggctcaagcaatccacccacctgcctctacctcccaaagtgctgggattaaagatgtgatccaccatgcctggccaggtcttcctttaaaggtacatctaggtcaggtttggtggctcacgcctgtaatcccagcactttgggaggctgaggtgtatcacctaaggtcaggagtttgagaccagcctggccgacatggtgaaaccctgtctctactaaaaatacaaaaattagctgggcgtggtggcacgcacctgtaatcccagcatcttggaagactgaggcaggagaatagcttgaaccctggaggtgggggttgctgtgagccaaaatgcacgcaactgcactccagcctgggcagcaaagtgagactctgtttcaaaaaaaaaaaaaaaaagaaagaaagaaaaagaaagaaaagaaaaaaaggaaaagaaaaaaaaaggtgtacctgattacatcaggcttatccaagataatatcccttttgattatgagaacctcaattatttctgcaaaaccactttacttttgccatgaaacataaccatgggagtaatatcccattctctttgccatattctataggttagaaggtcataggtccttcccacattccaaggagaaaaccacacaaaggcatggatactagagggtgaaaatcctgggggccaccctagaggttcccaccacagacggaaaatcaaccactgctcctgtccactttgagctgaacctggttatccagtcagcagtttacatttgcaatacatttagattcatttcgatgaatactgtcctaagacctttctccatagacacttaggagaatcctccaaaatctccggtgggaaaagaagatgggtagtggatctttccattaatatcacgtgaagttgtgtcctgattaaagataaatccaacgtagatgacaattctagcattttacttctcaccatcattctctctgagcaatgtcaacaaaataacagattctattctaaacagccctggcctgctttgaactgtatgtgaacctttgggacatttactgtccatccaattgcccgatcataaagatttcacttttctagatatttccaatacagcaaccaccagacttaaaaaaacaaagtctggttttcaatccagtgatttagtggcttttagtaacagggcacacaaagccatttcctgtttttggttcttcagcctgtaatctagaatgattaaactgatacttgcttctattctcttcatcttctgagacgtgattttggctgcacttgaaggcattaagtccacaatttttcagagtctcctatttatgcaccagccactgggttagggactttcacatgcaaagagaagcagtttggtgatttctcaaagaacttaaaacagaactttcattcaacccagcaatcctgttactgagtatatatccaaaggaatataaatagttctgtcataaagatacatgcatgcctatgctcatcacagcactattcacagtagcaaagacatgaattcagtgtaaatgcccacgaagagcagattggataaagaaaatgtggtacatatacaccatggaatactatgcagccaataagaagaatgagaccttgtcctttgcaacaacatggatggagctggaggctattttcctaagcaaactaatacaggaacagaaaaccaaatcctgcatgttctcacgtgtaaatgggagctcaacattgagtacacatggacacaaagatggaaacaatagacactggggactacacgatgggggagattgggaggagagtgaggatcgaaaactacttattgggtactatgcctatcagctgggtgatgaaataatctgtacaccaaacccccatgacatgcaatttatgtatatgataaacctgcacatgtacccctgaacctaaaataaaataaaataaattttttaaaaagacatcccttagtgatctttggaaatcattaatttttattcttactttacaggtagggaagtggtggtcacaagtgtcttgactgcctcaaggtcattcagttaataaggtatcttaaacccaggtaggtttgacctaagcaccgtgatctctgatgaacctgtattatcaaactggggttgttaagcccttggaagcctattaattaagccatgaagccagaaagcctcattctggaaactattccacattataacaaattcttccctgttagtttgcactacatcagtggttctcaaccagtggcagtttggccccacctctctaccactggccaggagacatttggaaagtctgaagacatttctggttgtcatacctggggggcagggctgctgctgtccactaatgggtagagaccagagatgctactaaatatcccacaatgcacatcacccctccaaaccccctcagcaaggaattatctggccccaaatgccagcagagccaatgttagtaaaggctgagaaactccacactacattttgacttaataaactgtttctcaaacattatttttagaaaaagcaaaaaaaaaaaaaaaatccctttgctattctgctgtagttctacatatataaatactgcattcagcactgatggccatagcatttaatccagttcatttttatgattcttgtctcctttgccttttcaactctttgtctatgtttttttcctgtgggtaagtgttttgctgctacaaatttgtttattgttgcttgttatttctctgtggtttgctatttattctgcagctctgggatacttattaggggtgctatataaaataaataacaataatgacaatgtttacagtacttatccctaacaattttccgggcatcatgaaagaagacacagagaaacaaatgacaaaggagttagtttgcatttttgcgtttttcctataaataagtacagaccagcttccctctgtcgtgaaatatttatagattactttttcagggtaagtttgcgataagtgcttgaatgtgtttcacccttggatacattcaatttgtcttcattttacagtttattctgttaattagaaaaggttataagattaataactagtcattgctaatgcattcaatggactgaacattgagtgtgatgaggggttttctccccctaaagggacataaatgatcagtttatatggatcccatcaaacctctgatgaagtgcactgcacacaaaatgtgctcaagattacaatggccttttggtgattttcaaaaccatccaaacatcaaaaatgcaattatattctgtgtgcataataaattaactatcatgggaggggctggttgctattaattgagatggagcaaatcatgtgagtgggactctagctgaagatgtgtaacaattacaaatgtattcaaaataccaaaactttatacttgtgtagggttttactattgccaaaggattttcacatagatgcattttgattttcacaatcaggtcttgctttaaaaaaaaaaattttttttttttttttttttgagatggagtttcactcttgttgcccaggctggagtgcaatggcaccatctcagctcactgcaacctccgcctcccaggttcaagcagttctcctgcctcagcctcctgagtagctggggttacaggcatgcaccaccacgcctggctagttttgtatttttagtagagacggggtttctccatgttggccaatctggtcttgaactcccgacctcaggagatcctcccacctcggcctcccaaagtgctgggattacaggtatgagccaccacacccggccttaaaaaaaaaagtctatagcaattaaaaaagtgattcaacctcatgaagtgggtagaaaactggaactaaacccatttctagtgactttgagtccattcctctttatattagaaaccacatctgttttgggggaaaacagaatattaacaaaattatatagcttgggcataccatacaagtcatttagtaaagaaaaaattatttgtggattcagaggtttgacaaaaaaaaaacctctgctgaaatgatgatactctcatccattcagctgagctcctgcctggtctgcagatgcctttgaggacttcaggcagaaatgcagaagaagctgtgggtaattgatgtccagtagcttgaccatagctttaaaagcaccctggggcaagcaagcaatggaaggtacttcaccaagaaaccacagagagcttgctttgtctgtaaccatcttctgagggattttgtctggtcattttttctcctaatacaacctcacatcaacagaaaaggtgcaagactagtaaaacaaaacaaaacaaaacaaaaaactcctgtcctgtgaaaaatttaattagatttaccagtcataacattttgaccaagcttttttgactatctcccctccgcgtgtgtgtgtgtgtgtgtgtgtgtgtgtatttacacactttttttctgaaccatttgggaccaagttgtagacattatgccccattagctgtaaatacttctagtatatttcctaagaactagaccctttctttcctaaccacagtgcaaatatcaaaatcaggacattcaacattcctagaatgtcattatctaatccacaatttacattcaaattttgtcagttgtctccatcatgtcttttaaatcttctccaatcccttctccattccagcacccaaaccttgttcatgcattgtatctagttgccatggcttcttagtcttctttaatgtagacaagcttctccgactccctttctcttttatgactttgacattttgatactttgaattgtagctatgtccctctcagtgtgctgcatcaggagacatgtgatgtcgatttgtccccttactggtgatgtaaaactggatcccttggctaaggcatcatctgacagatttctccagtgtaaaggaatgaattttcattttgtaatgaataagtaatttgtcctaaggtgctttaagatatagctcctgagaaatgtctcattcactatgggaacagaaaatgcacaagatgattttcaacaccttgccattccagaatgtaacaagtacccaaataacgacagggaaataacaaaggacacaggagccggtgtgaaggcactcctatcagccaatcctgcatgagttgagcaccaaaataagtaatgacaggaagggattataactcattgactaaaataagagcccatgagtctaggctgataagcttagatatgtgaataaataaagagggggaaggaaattattttctgaaaatcaagaaaaaaatgtagaaggaatgatggaattaagaaaatcaccattttatgatccataattgtttaaaatagaatgaaaggcaaagggagggagggagagaaaaagagagagagggagggatggagggaggaagggagaggcagacagagacaaagaaggagggagggagaaaaagagagagagaaggagagaggaaaggacagaaagagagagagaaagaaagagagagagagcaagcaacagagcatggcagatgaccccaaaactagaatttctggagaatcctaacctgtgacccaaggcatttcacttcagtgtggtgctaggccatgcagcttctgagatctttccaaatttctaacctcatgtaaaccatggttacctgaaattgtctttctccagcaagaaggaccatccctggcaaaaaacaaaaacagaaaacaaggtagaaaaatggatttatcaagttttacaatgcttgtcatatgaccagaaacacatttttaaaatatatatatatttactaaatctttggttatccagaaatttaagctatctagaatatgccatgctgtgctcatttctagaagaaaaaggtttcactgtcaagttactctgggaagtagagatgataggcgtccagtaagtgaacttgagctctgtcttaaggtctgagaagtctacctttcctgtctctcccacaataccacctcaccatgccctccaaactcagctgttgttataatatgatattagaaatcacaagtttttaagctattttgtccaaagaaaaaacaaaatgaacaaatgaaagtgtttttcataatcctgacacatccagttctttactcaaaatctgtctggtccatgaaaatatatttcccctaccatgaaatgtctcttatactatattaacctattaataaaatttgttgcccccaatgacttctgtttcaaataaaggaaaataaagattcaactagtttaccatcaatatattgtattaaatatcaacaccttactcctctacttatgtagcaaagctaatatggttttgtcaacataatctaagtataaatgtaaaaaatctgcaaccctgctctatcagttcattctcacattgctataaagacatacctgagactggataatttataataaaaagaggtttaactggctcatggttctgcgggctgtacaggcttctgcttctggggaggcctcaggaaacttacaatcatggcagaaggtgaaggggaagcaagcatgtcttgcatggtgggagcaagaggaaaagagagtgaggaaggaggtgccacacactttcaaacaaccagatctcatgagaactctatcacgagacagcattagggggatggtgctaaaccattagaaaccacccccatcatccaatcacctaccactacaatgttggccccacctccaacattggggattacaatttaacatgagatttgagtggggacacagagccaaaccctatcacctggcatctgactttaactgttcgtgacaacttgagacccatagaaactctagaggatgctgcaatccatgttgtatccacagcaatgttgctgaggtcagcagcaggtggagatgtgactaggtcaggaatattcatcagtaattggcgtggagcagacattttgctaggtattgaagatacagataaacagcatatggtcccctaccttgataatctgaaaattcagtaggtgagctctccagaaatgtagatcttactcgtggggacatcatccactatctccgctccatcagatcctcatgtccattaagtttgtccacgactctttgagattctcctgggagcccccgactcatctctgaacttcacaccaccaataccctatgtgcctcttgattttctgcttcctctagaacccatgctcaatcatctcaacccctctgtgaatatcatcattgccacggctttgaatgtttctgtccatatgcccagtcaccaagtgggagaccttggactcattgttgatgtctccttcctttcttctaactccctccttcttcctctcctgccgtggctgcattgcatgtcatcaaacccatgaaattgattcttttcttgctatttccttggtgtagaatgcatggccttgtgttgtagtgaattgttcatacatctgtttctctttggagactgtaagcttgttgtgtgggtcttcaataagtcttgaaataacaaatgcatattatttaccagtaatcctttgaacaaggcttccagaagcaatagttcatgttttcttgggagtgatttgttaaaaaatgtttctgcttattattaataatttggaggtgactacattatggtacataatttcagaaaacagatgcaacacgtgctaaatattcatggtttgatttcaggattattttgcgtcattatgttcaagggtctgatttgctttgcagggtatttgtatttgtgtaatcctcagtcatgttatattaaatgtttccaacatacttatacctcatgcttaccaggtaattaaaaacttttaaagcacgataaatttaaattgaaaaggggccaggcatggtggctcacacctgtaatcccagcactttggaaggctgaggtgggaggattgcttgaagtcaggaggtggagaccagcctgggcaacatagcaagacctcagtctctacaaaaaataaaaagactagctgggcatgctgacctgcacctctagacctagctacttgggtggctgaagtgggaggattgcttgagcctaagtttgaggctgcagtgagctgtgatcacaccactgcactccagcctgagcaacagagcaagatgctttctctaattaattaattacgttaattaactgaaaaggtacaacatttttaaaagtgggaaagtgactgctagtaatgttctgcttattagtaaaatacagtactatctttttaaaggaaatatcacactgattttggaaatatatatttttaatattctgacagtaaaaaatatttaaagtttttacataataagtaatagtaccgccttaattgaatgttattttttctgtctattttatactttacatatcagagtaatatttagaaatgttctttatggtaaccagaaattgctcttattttctttatcccattgttgatgtaatatttagaaatgttctttatggtaaccagaaattgctcttattttctttatcccattgttgatgtgcagttgggttagcataactaaaggaaaaaatgtgatagtttctcatggcctgcatatggtggaaaagaactggaatttgtggtaaggtcaccttaaatttctagaaaatactacttagccactgattgtttttcccctgcatcgagttcatactcaatacagactcatgatagttttgatatctcagaagaaaaatttccaccataattgttcatcttttcaaaactatttctctattctcacatatttttaatagataagattcttttttaattttcgtgggtacatagtagggatatatatttatggagtacataatatgttttgatataggcatgcgatgtgtaaaaatcacatcatggaaattggggtatccatcccctcaagcatttatcctttgtgctacaaaatccagttatacccttttagttatttaaaaatgtacaattaaattattttgactatagtcacccttttgtgttatcaaataccagatactaataatcacatcatggagaatggggtatctgtcacctcaaacacttaccctttgtattacaaactatatgtactctttcagttatttttaaatgtacaattaagttattattgactgtagtcaccctgttgtgctatcttattcattctttctatatttgtatacccattaatgatccccacttcccctcccaccactacccttcccggccactggtaaccatccatctactctctgtctccatgagttaaattattttgatttttaaatcccacaaataaatgagaacatgccatgcttgtctttctgtgcctggcttctttcatttaacataacaatctccatttctatccatgttgttgcaaatgacaggatctcatttagataagaattttagaatcagcctgtacaccttcataaaaaatccttttggaattccaattgtgattgcactgactatatagattaagtctggaaacatattatgcttctccgtatcagtcttcttttaaaaacgtcgataaagctttataggtttgactgcctctccacagttaattccttctatttgttgcctcttggagtaactttgaatcactccaacaccataggtgtgttctcttccttgtaggtgtgtttgctttctatctttctgggatccgttgaaattcctggtctgttgatgatattctttcttatctttcatgctatgctggtttctggaaggaaggagtgttttgctttttgaatatagtttctggcattctattggatttgttgcaagagggaacacggccacatgtgctcccatctgcttcttgatcccatttcttagctttgcgtggcgtatgtgtgagacagacagacagtttgcaaatagtgaaaccaacacatcaaggacacagacaactagggagcaagctgaaaacttagatcagacgtcatgtttctagagaagaggtgaaagactgttttaattaatagagtatcttagcctcctctcaaacaacatgggtgatatggtttggctgtgtccccacccaaatctcatcatgaactgtagtttccgtaattcccatgtgtcatgggagggaccaggtggggcggttaccctcatgctgttctcataataacaagtgagttttcatgagagctgatggttttataaggggcttccccctctgctcagcactcacttctctcacctgctgccatgtgatgtgcctgtttcaccttccgcaatgattgtaagtttcctgaggcctcccttgccatgaggaactgagagtcaattaaacctcttttatttataaattactcagtctcaggtatgtcttcatagcagagtgaaagagggctaatacaatgggtattcttcagtcttggttaagaacatcaatgtttcaccaaagggaaagaaatcaagaaggaaaagtttgagagcacagcatttttggagctagtgattttaattgaagaaaacggcagaataatatagagcatagtagttacgcgtgaaagcatgccatgaagactgagtgatatccaatatactggatttgaaagggggatttttggatggagccctacaattagacattggaatgcaagtgaccactctacagtcatgtgactttggaaattttttatgactttcattattgtttacatcgtactgaaaatgataatacccagcaactaccatgaagtattagtagagtatcacattaaattttttaaattaaaaaaacctctatgagaagtagaaacaacataaaccaacaaaaataagcaacaaatgattataaagtaacagtcaagcagattccaattttgcaaggcattttctcatctagaaggaaaagtgagggcaaattacttcagttgttagatcttcgtagaatatttggtaatgacttggcatgttatgaattttgccttctgaattatcactattggataatacatgctgggcttgtatagttacagattttgtgacttcaggtggattttataattttctagaaaggaatttaaaaaacttttatttttgcccccatacttaaagcatgtctataagtttgggaatagaaggactttcatcaaaattatgttgcaggctctatacgtgtattacccataataaatactgaaaaatatggtacattatttaggttgttgatgcagcagattatgttatcttgccttagatatataaacccttttctgagatcatgttattatttctacttttatttccaggttgaaagatccgttgaaaaaaaataagacttagtaggtaactatcagtgtactggatatggcagtctagatttttttaattaaaaaattagtggcttaaagaaacacacatttattatctcacagtttctgtggatcaggagcccagtcatggcttaactggaccctccagctcagcatctctcagaaggctgcaatcaaggtgttggctagggctgcattctcatctcaagacttgactggggatggatcttctttcaagctcactcagttgatcttattggtaggattcagcttcttgcaagctctttgactgaaggactcagttcgttgtgcactcttgactggaggtcaccctcagttctgtcacatgtagcactccaatatgtaagttgggtgtctgcaacatggcctctgtatcatcaaagccaccaagaaagtctactagcaaaatagaagccacagtgttttgtaacctcatgatgaagcaacatccattactttcacaatattctttttttaaaagacttttaagttcaggggtacatgtacagggtatgcaggtttgttacataggtaaacatgtgtcatgggggtttgttgtacagattatttcatcacctaggtattaagcctaatacctatttgctatttttccttatcatctccctcgttcctccctcctccaataggccccagtgtgtgttgttcccctctatgtatccaagtgttctcttcatttagctcccatttataagtgagaacataagatattttgctttctttttctgcattagtttgctaaggataatggccttcagctccatccatgtccctgcaaaggacataatctcattctttttttatggctgcttccatggtgtatatgtagcacattttctttatccagtctatctttgatgggcatttgggttgattccatgtctttcctatactttcacaatattcttatagaagtgaatcattaggtcccagcccatacctgaggggagggtatcacaagagattatgaatatcaggaggtggggatcactggaagccatcttagaaggctgacttccatagatgcctactctgattcattaactgtcaaaattaggaccagcaaattaagtgaattgattgaggttttacagcaagataggaaaagtgcaaagaatggaagtcttcacctttgcaatttgcccaaaatccatctactgccttccaccttttggcatacgtaggtccaaccactgtgggaggatgctaactacttagcacacacttatctatgcatgtaatgccttctgacttccaactttagaatcacagcctgtagaaaaacttaagtaggttgcccacactcctgttacatctgctgtcagtgaatagaccctacatgcattcctgaccttcaaaacacaatggcagcaaagagatgaaaaaaaatttttttaatatgcttccatgtcaattttacaaaacacagactgtcactgcctggagcgataaccttgaaatctgagccacagatctgcaaacctattcagccgcatggtttctgggcagtctgaaattacaatgcttttattttttttttccaacattcaaaaacccttttatgattgctttaaagtcaaacacactgccctgttttctgaggatgtgccttactttttcttctagagtcatgtaatcgtccttctttaaagaggactgtgttcgggaaatgacaagttcctagttgtgttgtagactaaccttagagttggccatgtccaaagcccttttatagtgttgatgcaaaatttccttctatttccttaggtaagaattccataacacaggagatttagctccattttgtggaaaactaggcagttaagcttcctgttcactggataatggtgcttcactctctgagtccaatggcggagaatgccaagtggaagaacagggttaaatcatttgggaatttcacacaattttattttctactatatgcctcttgaaaggagctgtaaaaatgatgcctttaagtaatattttgtcaatcacaacatttattcctgttcttcttcctatcacgactgctgacttactcctgccattagcacattctcataattactgtgactattatgaatgcatactaagtaccatgtctgggataaagtgtgggaatactaaaccaaattagatattctctttccttcagggagaagagactctttgtttctataacagagagagtctgatatggaaattgccaaataaaatgcaatgggagaagttgtaggaaatatgagcttgttgcaatgtgggggtgagttgttgcaatgggggggtgagctgttgcagttagctagacaaagaagagaaacattctggcaaagaaaactaaattattttttgaatattgttatggagcatttaaagaagtagtgttgtttctatataactggcaaaagcagtacatactaattaaagagcatgcagagaccaggtcatgccaggctctgtgtgcaaaggcaagaagattgaattttatcctggaaatgactgagggacagataacctcagaaataattccatacaagactaatatttaaggggaaattataaaatggagcacacattaagaagataaagaatggatggacaagggagtttggagataacccctaagacatgatggcacaatgttcagagagaggcaggcagaatggagcagacgctatttctttgaagacattcatggaatcatgagaacttgagctttggggaggatcgtcttaaggggcacaggagcagatattagggttaagcccaggctcactagggtctgatggaagacctggctccataaagtttgggtcctcaagcattccacactccaggtaggagcaaaatggtaatagaataaatctttccccattctcaacccctagaagactgcaagtttttttgatgcaaagtagagagagcttaaattacatttcatattttcccagaatctgtgatgcagtgttggtcaattcagcacagttaatctcaatagacaaataacaaaaatactcaaccaagaatgttatcagagaaatatattaacctttacaatgcttgtataaatgaaacatggaaaattttttaaaaatatttttttctttaaaaatgatttttaaaagattttaaaacaaattctttaaaaatttttgttaaagatgacataaatatcatgcaataattaactgaattaattcaaacatgatctactttcaacctcattttccaaacaatatttcctaacaaacagtatattttatttcacacgattttgattcaaggaatccaataaagttattaatttcatatgaaaatggaaatgcatacaatgaaaacttagttgataagtaaaggttttcagaatgatactaatatgtcaaatcagcacttacgtccctaagcaaaagtcacttaggatgtattatcattgttttaatacactgctggaggtatttgctaaaattttctttatactttttgaatttgttgagaaagagtggctcataagtgttccttctcatcctgccttatcagatactagaatggagattatgttagtctcataaaatgatttattgaatgttccgttctctgttctccctaatgctttgtagatctcattgatgaaaccatgtggatcaagcattttctttcttgaaatatttggactgggaatgcaattttcttaatgaatacatcacttgaggctttccatgtagccccttagtttttaagttgcatctttctagggatttattggcttcatgtttttactattgtctttttaatgtggtacgattctatggtgctctgtttttcattgctaatgttggttatttctaccttctctccttccctacctattgatcagacttgccaatttgttaatatcattggactttttgaagaatcaacttttggttttgtcagttctccctatagaatatatattttttctatttaattaaattattctcttatcttacatttccttccttctaccatcttcttgattttttttgttttataactttctaagatgtgatgagtttactaattttgttttttgttttctttgttaatacacactgttatcctaggccctgatctagatacacctaaaatgtttgatatgtatttttcagatcatttgtttaaaaaatattttccaacttccattttactttattcatttacttgtggataatggagaatttttaaaaatttccaaacatatggggatttcaaagtcagagatctgcattgtgttttcagtcttttgacatatctgaagacttgtgttttggtgcagtatatcatcaatttaagtgaatgttttaggcatggctgcacagaatacgtacttttccatttgtagtgcaataattgatatatgtccattaagtcaaaggtgctaattgaatcattctaatctcctctattgttactaaaatttttgtcttggttttcttaatggctggaaaagatatattaaattcttccttgataattacaaatttgtctataactccttttaattctgtcagtttttactttacatcttttggggctttgatatatttttctcactatatatttcatttattcaacaataattcgtttataaaatatattttgcctgatagcacaaaatatttttaatttggtttttatttatttggtatagatgaggtttcttttctttcatctatttgtttccatcttttttttagattctttgtctctatactagttattgcatattagttgttattattatatattctatgttactatttctcataattagtatttaaaagtcagtagtacttctaactctactccactaagtaaaatttgcttctctggctctttaaaaataattttattaaggtatgatttgtgtaaattaagctgcatccattgaaagtataaaatgagttgtgtacacccataaaaccactatcacaaacaagacagtgaatattccccaaacccccaaaagtttctttgttaatgacagcatctgccccagctcatgaagacaacaacctgctttcagacactaaatatttgcttcaactttttttttacacttttatataagtggaattgtattgtacatcccctcttgagtctggcttcttttactcaataagaaatttgtgatttagtcgtatgtggatcatttgactagtcactgagtagtattttgctgaatgaaaatctttcattactgagtagtactccgttgaatgaaaataccacaatgtgtctgcctagtcacctgttggtggacatttgtattgtttcccatttttggctcttgtgaatccagtggctgtgaaggttcatgtgcaagtctaagtgtggacatatacttttattctcatgaataaacatccactagtaggatagctaggtatattcttactcatataagaaacacaacatctagagaacactgttctctagagggactagttactgttgatctgtgtattctggtcatagaagacaaatgttttgatttccggcacctccaagtcattttacaaccagggaaatgaagaagccaagtcactgaaagatgtacatctcattcctgatgtagaaacactggagcagagtaaccataggagacagtttgtctctgtggtcatgagctgcagggactcaggttgaaccatctccacagcgcacctgcagcacatcttactaactggatgatgctttgaggctcagctaatccccagacgtctctcagatgagaagccaatatctaatggtcacccagcagtcactgaatcccagggtttataatatcccatccatctgtgaccacttctgataaaggaggactattcagattcttccttgggattgggtatgattgacatgacaggagaatacacattccagaattactgttcacctttagtttattattcatatgtttgaattttattaaatacagtatgtatttttcatttagcagactcttttttaaacaacagctttatatttatggaaaaattgagcacatagcatcaagaattctcatatgctgtcttttagccttcctcagtttcccctcttattaatctcttgcattagtgtggtacagtttttcatgctcaatgaactgataatgatacattattatcaactataaagtccttggtttacattatgctttcttctttgtgttgtatagttctgtgggttttgaaaagtacataataacatttatccagcattacagaatacaaatatttttcaatgtcatttcacaaaagagacttgaaaaaagctgactgtaaactaaggcaagctcagaaattacactgtaaagggaatatagatggaaaggaaatgctatcatcacaaaatcctatttttcttttcagtgtactataatcatatcagattcaaagagaaaggtgtaacttttgttacctatgacaaagattataggtataaaacatgtttatctttaagaaagttacagaaagtggaggaacttgtgatctagggacggacttaccatgtttgaaaaatggatttcatggtagaataaataggattagctctctcatgccttcaagtttaggagagcaagctctatgaacttgaaggtgacccactactaaagtaagtcctgttcattgagaactggaagaaacttgaggaataatttttatttttgcattgcagaataagcaagaatactttttatttaatttgcatttcccttttcatataattttgagactcgtcaccaatattttcattacctgtttcttccaaacctgtttttctcctaaaactaatacctcttctgattttttaatattttctgaaaagtttaatatattctgaatttgaatatttatattttaacatgatcttgcacaccttaaatattctttggcatacaaaagttttttttcatgattcgtgagtgagttgtatatatttattactttataagaatgattgtcaatcatccctgccccctgccaaggggacatttggcaattcctggagacattcttgtttgtcacaactggaagggggatgttacttgtatctagtgagttcccacctgtcatgaagggatggacaccacagatgctgataaacatcctataatgcctaggacacccccataacagagtcttgcatccccaaatgtgagtattactgatgttgagaaatcctactttagaattttctctgtctaactctccctttacccccatttgacagctggggcaagtcagacaaacagttttcaggctgggtagtctctatcaattggcatccacacttactagtaatctgaggagacgggttaaggtattaaagagaaggcatagaacttactcaccaagaatcctactatgtataacaacacaacatgttctaacatgaaagaggcaggagacagtatggaggaaggataattaagcaagcattttattggagaaataatatctagtttggaaaactgaagacatgagtgattctgattaaaaaaataaattagattatattacaattctgtttaaagcccttcaaagactccactttcaatgacttctcattttccaaagtctttctttcatgcccaaatctcagtgagttccctcctgtcattctcagagtcctatttgttttccttgcagcactcaattggaagttatatttcttttttaaagtattggatacctctctcctccagtaggctggaggacaatggtagtatctattttacctggcacacagcactttcatcctccccagtaacttggaagggtcctcagaggagggagattttctgatgttatcaaggagaaaacaacaatgtgggcaaacacatgcaggtggaccctagagtgcgcccacatggaaaggtaagcagaaataggctcaacttcatggcagagaatgctgttgtggggtcttattattataatgtcttgactgctaggtggaagaatttagacctaatgagtaggtgatcgggactgaagctcttcagcagcggtaacacaccatggaagctgtttctgaaacctgaaataatcccccatggagattttatcactgagacctaaactcaatatatagaatctttgcacatttttgttatgcatatcacatccctccttcaaaaccatattttttcatgccttttagaaggtgcatagtgtatatgaggaatgtcaacaatgatattcaaccccaaccaagcaccttccttctggcttagtttgtagtcacaatattctcacagccagttgttttctgtggattgcaatgtgttttggttttccagagcctttcactgaaacctgaacaggacaaacatcagtatcattagtagttacttgggtatatttactatatgagtcattacttcaatacctttattatagtgattgtttgggtacctttactatagtggttacttgggtacctttactatagtagttgtttcttcagtacctgtactatagtggttatttgggttcctctattatagtggctacttgggtacctgtaccatagtagtagttgcttgggtacctgtaccatagtagtagttgcttgggtacctttaccatagtaattgttgcttgggtacatttactatagccattatctgggtacctttaccatagtagtagttgcttgggcacctttgccataacaatggttacttgggcgcctttcccatagcaatagttgcttgggtacctttcccatagcaatagttgcttgggtacctttacgatagtaattgttatctgaagtacctttaccatagtagtagttgcttgggtacctattctatagcaacagttgcttgggtacctttgccatagtaatagttgcctgggtatatttaccatagttgtagttgcttgggtacctttattatagtagtggttacctgggtacttttaccatagtattagttgcccgggtacctttacgatagtaatagttacctgggttcctttgctatagcaatagttgcttggatacctttcccatagtgatagttacctgggtatctttaccatagttgtagttgcttgggcacctttactatagtaatagttacctgggtacttttaccatagtattcgttgcttaggtgtcttacccatagcaatagttacttgggcacctttcccacagaaatagttgcttgggtacctgtaccatagtaacagttacctgggctcctttaccatagtaatagttaccttggcacctttaccatagtaatagtcacttgggtatctttgctgtagtggttacctggatacctttgccatagcaacagttgcttggatacatttactacagtagttaccacctctgttctgctgcttttcctaagacactttttctgcctttttttttctcttgctaattcctcctcattctcaaagactcagcccagtcttttggggagccttccttaatccttcagttctgctcttcctggggctctcttctcattgccgctgcacaatcttgaggctaccattcccattacacacttgaccttatattgcatctctgttcctgtggtatctactgggccctgtgactcagtcatgcaaaaataatatattcaactctgaatcttcatggctagggatagcaactggtgcatgctattgagttaaatagagagagtgggagagtgagagtgtgtttatgagaatgctctcttggactctcttcaatgtctttgtagcctgtgactctaatcaccctggatttatttcattccagcatcaatcctttctacttgaaaaccagtaaatatcctctttgtctagataccaactgacagaatgtagaaggattaagaagctgtcttctaccaagcaatgcaaggaaaccaaccactgaacttctaaaatagtaatagagatgccccttccaggtgccatagaaaatactattctttacctactaatatacgtctccaatatggaagattatttacaagctgtcacattaataataaataatatattttcattattttcatccaaatccttgagtttcaaattaacaacatttgaaggagacccgtttgcacagatgaaatttgaattgtagataaagtgacactctggaagggttaggtcacgttgttgcttttcaacactaccaagatttaatttatgtagtgtcattgtgaagagagaaccctaatggctttttaattattctcaacttcaaagagtaaatgagagagaaatcagttcccagacaaaggaagaaaatattggaagctgagtagagataattatgcaggaatgccctagtaaaagtatcttaggacgtaggggtgtagaattcttttctgcacatcaaacctacacagtggaacagaactgtattgtttgttcagttccctattatcaccccacagtcttttttaaagaaaattaattttaatttttattttaagttccggggtacatatgcaggtttgttacataggtaaacgtgtgccatggtggctcgctgcacgtatcaacccatcacctaggtattgagcccagcatgcattagcttttttcctaaagctctccctccctccaccctaccccctgacatgccccagggtgtgttgttcccctccccatgtccatgtgttcccattcttcaggttccacttctaagtgagaacatgtagtgtttggttttctgttgctgcgttactttgctgagattaatggcttccggctccatccgtgtccctgcaaaggacatcatctcattcccttttaatggatgcaaagtattccgtggtatatatgtaccacattttctttatccagtctatcattgatgggtatttgggttgattccatgtctttgctattgtgaatattgctgcaatgaacatacatatgcatgtatctttataatagaatgatttatattcctttgggtatatacccagtaatgggattgctgggtcaaatggtatttctggttctagatctttgaggaatcgccacataatcttccatgatggttgaactaatttacaagactgttatgatttcagttcttttgcatttactgatgagggatttacttccaaatatgtgatcaattttacagtaaatgccatgtggcaccaagacgagtgtatattctgttgttttggggtggagaattctgtagatatcgatcaggtccatttgatccagagctgagttcaaatcctgaatgtctttgttaattttctgtctctatgatttatccctcagtgttaagagttggtgatcatagcaagttatggaaaatttggaaagttatagttacatttttaggcaagcttattgggctgtgaattacgatgaaatagtagaagtaatttgctatgtcagtttataggagccagagatagagtgactttcacacaatggctttggaaaaatccacaagtccaaaataagatgctctaaacaccatctgataatagaaaaacgttttaaacttatgtctgtttgggctcattgtggggaaaaaaaacttggccatttattgctatgtaagactgattgcccatataatttgacctttaactctaaaagtggatgttggggaaaatgtgagtttcagaactagctgctcttaatacatgattatttttagttataaagtataaagcttgtttgagagcccattttcttggagaacatgtaagctgtctgatcacaaacaaaatcataatatttcctaataacaatagttgccatttgagtctttgtagtatgccagggactggatatttgcttctaaaggggataatcccctgagatatgagggatccagtttcccccaagcccctgccccaggaaagtaagaataaagaattaatgaaaagctaaagagataggttatagaagcaataaatgaataggtacaatggaaatgttggtatcattcaggtgaacacaggacacaggaaaaatagcctctcccggacaatcctcacttccaggaaaaactttttaaggagagtcttgggaaaaagcaggcatgtgcatgtttttgttaagtaaactggcataaaccaaaacatagtgtgtcagcctaaaaagagagaaagcaagtgtgaccacccgcagtgtgataaagctattgttttttaaagtaaaatatttcttgtagttccatattgctattcaagtgtaaaagttctcaataccagcctagaatgaagttatctgcaggtctgtagaccccttttacgaattgtatggaagtacttgttctcagactagaagtactcaattctattccctgcaaatgtcaatttagtatcagtcatgtggggaacagtttacagtgtcacagttttcacagcctatttcaggctccagggaacagttatgccatgtaaggaaataactcattcttggtaaaggaaaaattgtaaagtatttagttagaatttttctgcagctgggcatggtggctcttgtctgtaatcccagcactttgggaggctgaggcaggaagctcgcttgagctcaggagttcaagaccagcctgggcaacatggtgggacctcatctctactaaaaaagaacaaaaattagccgggcctgctggcacgtgcctgtagtcccagccactcgggaggctgaggtgggaggattgcttgagcctaggaggcagaggttgcagtaagcagagattgcgtcactgctcaccagccagggcaagagagggagaccttccctcaaaaaaaaaaaaaaaaaattttttttttcaatatccagtaattattttatctccttccaactccttccaatacttgtgatgtatgtgtgtatatgtgtttgtgtgctcatactttctgtctcaagttgtgaacaagaatttcatgtagttcaatcttttatcaaaagcctaatgttacttttttttaagccattaggcgggagtcgtgggtttcaaatacagtaaataaaactgctagtactggaaactgtccacatcaatgtgcccttcaggttgcacataaaaccaccttgaaaagcagagctcttaaacgctgtgtacagaaagctcgtgttgttatgtgttcaatgcttcctaacagatttcgttactaggcacgataagaatattgaaaccatatttgtgaaatacagttaattagcttgagtgaacctttctataatgtatacatagatcaaaacatcacattgtaccccataagtatacacaattattatttcttaattaaaaatacattaaaggccaggcgcggtggctcacgcctgtaatcccagcactttgggaggccaaggcaggtggatcatgaggtcaggagattgagaccatcctggctaacatggtgaaacccgtctctactaaaaatacaaaaaattagccaggtgtggtggcgggcacctgtagtctcagctactcgggaggctgaggcaggagaatggcatgaacctgggaggtggagcttgcagtgagccaagatcacgccactgcactccaacctgggcaacagagcaagactccgtctcaaaaataaataaataaataaataaataaattaaaaaggaaaatatttatctgttctgtggtttttctttcattttcctttagcatctttctagttagacatctttacatttctttttgtttggtaacagtttccattttctgtcataattccttgaatgtcctgtcaagcaacacatgcctgctgaacagtaactgtgtaagaggctgtgttaggctggtgagtggcacaaaattgagaaagacctcactaagcttggtctctactgaaagaggcagaaatgtacaaaaatgaacaactctaccattattaggcagatgttaggaaaggcatatgaaaaggccaagaagtatcagatcctctggctataaaaatcactcagtagctgggtgtggtcgtgcatgcccatagtcccagctactcaggaggctgaggctggaggactgtttgagcccaggagttcaaggctgcagtgagctatggttgtgccactgcactccacgctgggcaaccaagtgagaccctatttttttttaaatcgctcagaaggccgtgaaaccaataatctgtaaacccaatgggaagaaaatgacagcatttcatactgctaatcaacacaaccatggccctttacacatctctctaaatcatgtgatagtccacctacctagggactggaaaatggacaaatgatattagtttttgaaaagatgtaaaatgcaaaagatagtcaaggtggtagatttacatgccagtgtggatgttggggaaagctctcagggatccaagagaatgttttcctcttgcagtaaaacgtcaacatagagagctagtatcatttgttctccaccaaacttctgctctcattgaaaactcagaacatgaattttccacatttctcccctagaatttctacatcctaaataatgaatgcagccaagaggagcatattcaatggcaattaatgagtatctttccattaaactttattccattattaaatgttccagttttatgtcagtggattacatattatgcatggcttatttgccattgctttatgagcattttataggcaaaagggaatggctgttataaagtaggtgggtttaagacaggtctttccctgttctgcccaccctcccatcacatccctcccattttggttctctggaattaaaatcaatctttaggtgctactcacataatgagaactttgatgtatatggctttcctctacaaagcgacatatgttcccattactgagatttcttcctcagttccccgtctacctcccccatttattcaaattctattcattctttaaggcaccgggggcctttctttgtcagtcctgtctgctgtgagtgctctcttgagtgctaagagagtacttgctctttgaaacttattctgctctgtaacttttcatgtgtcaatgtgacaattatactgtaagattttaaggtgggttctacatcctatttattttttttttgtattctcatagtttccaataaaatatatattgttgattgaattatagtcttccccagttatgggaaacatagctgaacgagaggcccagaataaaaatgaaatctgtacatttacttatttattattttttgtctttttatagttgctttctttttttatatttaattaaatttaattgtttatttcaatagatttttggggaacaggtggtgtttggttacatgagtaagttctttagtgatgatttctgagattctggtgctttctatatttagagatgatatggcaattatacactttaacaataggattaaaatacaagtttcttatgttaaccaatgacatttaattaatcactataaggacatgcatcatttatgcaatttcagatttgaaataatactagtttgtatacttacctggcaaggaagataccatgattatgaaataataatagtttctaaaaccagaataagattactaatcagctaaaaatcaataatgtaaaggacattgatagaaaacaatttctatcataatttcagccatttgcaattaaatctcattttataaatatacaaggaaaatggaacacaaagaatggtgactgttgaatgatatgcaattcatccccataaactatttaagtctaaggttcacattcctatacagatataacccactggaagatatattactgagattaaaattcgttctctcccttgccttatgaaaataaagaaggaatcaaactcaattgtaccttgagcatttaatgacaaatatcaataacaatatttgttgtaaccaggcagtaatccatcgagaaataatgaatatgaaaactgataaagaacaacatgaggttgtgtgcagtggctcatgcccataatcccagcactttgggaggacaaggtgggaggatcacttgagcccaggagtttgagaccagcctggacagcatagtgagacttcgtctctacaaaaaaaaaaaaaaaatagctgggcatgctggcttgtacccgtagttccaacaacttgggaggctgaggcaggaggattggttaagcctggagtttgaggctgcattgagccatgatagcaccactgcactccagcctgggtaacagtgagacattgtctctggaaaaaaaaaatgtgaattacagaaacaaaataaaatgagagcatgcctgaggaattgaaggaattcatcacagatctgtgattatccaccaagattaagtatgttatcaatggccttcaaagaaccttcaggaagcatcaactttagatagtgtttgacgatggagagaaaatcagagtgtgagattttggaaaagggttaagagtgtcaaggatggcaggaatgcacacgtgtatctaaagagatgagagataggatgtgcagacccagaaaagaaagagaagaaatcagaatagttggttacatttttggcaggaaaacttctttgcaacaccctgaaggtgaggaaggaaattccagacctcaggcataggacctctttctgtatctcttgcttacatatcagctggggattatgttggatttagattcagtaaacaagggtgggcctgagactgcctatgctgatgctcctgatccgtggaccacagtttgaggagcaagtcatcaggacactctcctacagtgagaggtgatgctgtgatattgatccgtgcagccatgaggatggctgatcagctcccctcttcctggccaggagcagccatatttatggacaccagtgaggtacacaatgtgattattttctatatgaacaggggcaagaaaagggttggtattcatactctcacaccatgttaaggatactgagaaatttacaagttgaggaagagacaagaaggggcaaaaacaaacaaacaaacaaacaaacaaaacccaaacaaacaaacaaaaaaaacgaagaatggagatgccgttacaactatttagaaaattgaaagacatataattttgaaagggaaggctgtttgtctactacaaactctctcatatgtcctaagagggtagctgctccttgaaacttattctgcttaataaattgaccacattttaccatgtgttgatcacgttttccttaacttccaagctgtcatcttgttgagtttgaggtacagactggaagttcaggcaaagatattgaaggcggtatggttggcagaattttggcccccatgagttttggcccttggtgttcctcccatggttatgtgatggcccaagggagtctacagatgtcattgaggttatcatcagctgaccttaaaagagggaggttctcctggcttatcaggatgggaccaatgtaatcaggagtccttagtagcagagaattttgctggctgaggagaaagagatgtggcaccagagacgtcctactgagaccttggtcttagaactgtaaggaacaaacacagttctgcacccacctcaatgaacctggaagcggattctccctcagagcctggagataagaacccaggctgcttatcaccttaattttagccttgtgagactgcccatgagcagaggaacctgctgagcccacccagatttctgacctatacaagtatgagatgataaatttgtgttgttctcagctgcccatttcatggcggtttgttacagcagcagtagaacatgaatacggtcagcaccagaaggtatagaacttgcaatagagatgtaggcgttacctgcacagctggacaacatattgaagtaggagagggaacatgtgatttcagtggagcgagtaaaagaggagaagaaagaaaaggagccttgagaggaaaggaaggaagccaggtttccagctggcgttgacctcacggaaggagaaaaggataaagaaggtggaggggagcaaaagaaagagagagagctgcagagggccagtagatgtgtggatttgcaggtcgcctgtgagctgtgagagcctggtttggcaggtagcgctaagacaaagaacgttcgagcgcgagctattcataggcagtgagatatgaagataggcaggcatggcaggtccactctccttccctttcgaatggtgtgagagttccactagagatctggaatggcacatctgaggaagccagggaaagaggtctttttttttttgagaatgagagaagcttccatctgaatgtagaccgtgggaaaacatctgcaaagtgggctttgaagatgcaagagagtggagtgaatgggtagagaaagacagtggaggaaacctgggaggtgatcaaggcattctgctgttatctcgtctagtctcattcattctgttttagtccatggctaaatagactatggactgacccaccatctgctttataagctgatatcaagctaatctttctttctttccttttttgtttttttttgttttgttttgttttgttttgttttgtttgagtcagagtctcgctctgtcatcaggctagagtgcagtggcatgatcctggctcactgcaacctctgcctccagggttcaagcgattcccctgcctcagcctctcgagtagctgggactacaggtgtgtgccaccatgtccagctaatttttttttattttaattttttgtattttagtagagacggggtttcgccatgttggccagaatggtcttgatcttctgacctcatgatctgcccaccttcacttctcaaagtgttgggattacaggcgtgagccattgcgcccggcccgatcgagcctaatctttttaatcttttttttttttttttttttgagacaaggtctcgctctgttgcccaggctggagtgcagtagtgcgatcttggctcactgcagcctctacctcctgagctcaagcaatcctcccacctcagcctcccgagtagttggtactacaggcaagcaccaccatgcccagcaatttttaaattctttttgtagagttgaggtctcactatattgcccaagctggtcttgaactcctgggctgaagcgatcctccagcctcagcctctcaatgagataacaggcataagctaccatgcccaacccttttagttgtaaataattgtcctcaagcatgttttaccatgtattgaccacacttcctttgcttgcaagcctctgtgtcaagactctcagtccttctttctaagattccttcttggttgctattactcttcatttctgtttgtgttctgcccaaacaacccctccacatctccttctttcccatgcttggtcttcaaatatgccaacagcatctggagactttgtgcttaccactttctctgtgtaggtggaaagacacattgctcggtctttattttcttcaattctcttctcaaacatccccttattagagaggctttccttaaatactctgtataaaatggcaatcccaaattccagctaagaccttattattcattctctaatctctctatcatctatctactatctatgtatcctctgtcactatcttattatctatcatctatctacctatctacgtacctgttatctagctattcatcctatctgttctatctatctacctatatctatctatccatcctatctgtcctatctatctatctatctacctacctatctacctacctacctacctacctattacctagctatccatcgtatctgatgtatctatctatctatctatctatctatctatcatctctctatcttatgtatgtatgtatgtatgtatctacctatcatctgtctatctgtcctatctgtctatctatctatctacctgcctaacatctatctgttcatcctatctgttccatctatctatctatccatcctatctatctatcatctatctctatcatctatcctattatctacctatcttctatttatctatcatctatcttacctatctacctatcttctatttatcaatcatctatcttatccacctatcttctgtttatttatcttctatttatcctctatcttatctatcttctacattaaatatgaatccatgagagcaggactttgttttatgttctcagtggctagaatagtgcctagcacatagtagacattcaaaaatgtttgttgtagagtggatgacttttattggtctgcccagcatggagtcctggaattatcatgaattcagaaagaaaataacataaaactgttaatcctctgtgctccaggtttctatcataatgtatagatcctgctatggtctgaatgtgtgtgtccttccaaaattcctgtgttgaaaccctcatccccagggtgatggtattaggaggtggggctttgggaggtaatgaggtcatgagggaggagcctcatgaatgggattagtgcccttataaaaggactccagagagctccctcaccccttccaccatgtgaggacacagagagaaggagttgtctatgaaccaggaagcgagttctcaccagacagtgaatctgccatgccctgatcatggacttccagcctccagaactgtgaaaaatacatttctgttgtttataagcctcccagtttatggcattttgttatagcagcctgaacaaactagctttttcatacttttcatcttttctcttatagcaaaattgagttcatgcattgttgagaataatatagtatcaagtaccaatcttgtaagacatctcattcttaccaacctgtttttatcattgcttttgaaaccaagcattgataattatcagatgtcaaatagttaatacacttacataatatttgtcatataagtattatagaaataattaatattttctagattttttcctatcaagaaagaagaggaaagttagaaataacatatttttgtccacacaatgactatatagaatcataacatgaaataagtttgcctcttgaaatataccactttgcaaagaaaggcagggtcttatccgttcaccatagtcattgaaaaactgtaagaggaaaataaaagcatcttaaattcttagggcaacaaaattgatcagaactaagaaaagatgattgagttgctttagatttgcatattcaatcagcaagatcatttttaatcttataaaagggtattttacagtaacatcaatcgttgaacatatatactcagaaatgcatacaattaagaaaaaaatcaaacaaacccagacatggcagaaagacataaacatattgactgaagaaaggctgggagtcagagaaacatttccgaagttgccaagtctttgaagtgataatatttcaaggaggcaaaactgaaaagttgtctgttataagtgttttttcttcttgtctaagcatgtacatggcttgtacttttaccaaacaagaaatgctagaaaccgtaaggcaagaatacacatgattttagacagggccactggactgagtcattagagggcattggtctgcaaaaccagatacaatgtagactcagtcattgcctaaattgcattggaaaatatgcatatgggttcctaacattaaatcctttaagtagatatttctttttctttcccttcctggcagataggaatgacacccaaggagttttgacacaggttatcactccttacataaaacgatgatctatatcaataaagcaagaataaacatttacatctatccatctgtaaggtatgaacattggtcttcaaactcaggaaggcggaggctggaagaagcaatccaattactgtccacatttccatgtatctgttgtcattcctgaatatgcacaactaaaataattacagtagcattatttttccttccacatatactttgttattgtttctctttaatatctccaaaagtacctactcagtaaccacagccatatgccctacatacaggagaacaccttggacatgtcacatcaaaagccacaagagaaaatgctgtttttttcaactaaaggattataaatacctggaggattacctggatgatctaattagcattgtctggtcataatctcatgatcaatgcaaactgactgcatttgaatgccaatgttttcatttcaaaatgctaacatttagaatatagtcgaaccaaacgttgcttaacatcctttgctagctgtttcttttgaatttcattttttgcttgtttcagtgacaatgctgaaattagatggtgtaagaaaaagaaacttaattgctattataatttgaacagttttcgaaacgtttggtgctgtatttttgaaagaggattttatctcattgaactagacggtcaagacacaatttattctttggaaacaaatcctgtaatctctgcccagctgggctcaattgtccactggaaggatcttgtcgaaatctgtgtcctgtaagataattggttcagccacagcaatggccagtctccatgaaactgggtaggaaaaacatcctgtgaaatggagttttctgtgggaaacaaagtcaacgccatgtgctctccaagaggcaaaatgcaggcagaggaagaggagatgaatcaaaaataaaaaaggaagattataagaaaaatcataaagccacatgctgctagatcttcttctttttccccctcactttcctggggccatacgatatgcttttcttaagacaagtataaataaatccatggtgctgaaagaaagagcctgaaaacagagatgattactatctattttttttttttacagtgtctcccttctaaacttgctgctgttacaccagagcatggtgtaccctctaccctccctaaacgaggtacatgataagagtcattatttgatagagtcgattttggatatgtttacaccattccatcaacaattttatgctgaatcatatgaaattgccaatattcacccatgacagttttgtatattgttcaacacaatatatctctacaagttagttgcattaattccgaggaataaatgactattcttaaaaaatgaactaggggactcagggcacctgtgtttgcttagcgccatggcttagtcatacttaaggttccttttcccttgtggtatgcatcataaatttcttctgtatctcctctacttctgtacagggaggattataattatacccaagcctttggaagtagtagatgtgttcaggtgactacctcactattcgcaatgaaacatgaatggaagtgatgtgttttgcatgtgctggagtatttaatcacctttactggactctctggccatctcctcccatgatgccttatgttgagacgatgaccttctataagggcagagcaggtctctctgccaaccacattggatgccagcttaagcaagaaataaatctttgttgttttaagccaatgaaatttttgagtggttagatactataatcaacccagtttattctcactaaaaaaagatctctgggggaaaaatatgatgtcaggcaatactcaataatgcttgctgttgatgataagagtagagtcaacatttggcaacttaaaatttagagggcgtgaatggcctttccaaaacctctggccccaggaattcccactcactagaaatcctgtttagaaatatcttttctggggaggttatcaaaactcctgacattatgagttctgaagtagttaaacccttccctgcttaacatttggttaggataaatttcattaagtcaaacccggtagggtagggtgaaagtctttggaatagtgcacagtcttggttttgtcttagcaatagggaagtgtagaaacatcttgagcattaataaaccctcctaatatcactagcaattaataataaatggcactcagaagtgacaatccaaagtcaatatatggaaatggcatctttttggagtgaagctattttgacaggctaaattccaataatattaaacacagctgtcacttcagcatatgtggtgatgactcagttaggtaaaattaggatcatgaccaccgggaaaaattaaaagacagacatgacagaaagaggaaagactggatttcagtagaaaaagaagaaaatgtgcatttatgcagagcatttaatctaatgtttttttttctccccaaggggagaaaaaagtcctttcaagcactgtatttataggtacaattataaatgtagcctaatcctcttttcaattttaagaaacctagtagaccaagtctctgacaacaaacacaatagaaataagcccacgctacacagttttgggtaagataaaacctttttgcacaagacatccagaaatgaacaacataagctttgctcctatttctagctactctttttaagcaagctgtggatttcgcaatcaacttttgctcaagtctctgttttgtgataataaagcccattgacagcatttgttttgcagctctgtgttgtcccaacctaatttgaaattaaaataattgttattaaaatggaacaaaagaaaaaaaatggcatgagatgaattagaattgtttagtatggacaatgaacctggctttcattttcaggaaatatgattttgcacaaagaaaattatttgcttcttgaaagagaaataatagttggaaatgcttgagttattcatatcacgtttacacagaaaaatttcggtcatttaaaatttttgttcatggaaatgaaataattccataacctaggagagagagacagcctatataatactttaaagaaagtcaatgttatgatgcaggcagaatttgtcttctctatcatcccccttcattttgctccccagtggctgtgccttaggttctgtccctaaatagctcaggggttctcaaaagccatgttttcatgccctggaatcttccctttactttgcttcattcacaggtcccactggggccttgtctctactaggatggagattagaaattcctactctaacaaatactcactctgctgatgttagggtactaaggcctctccccagtagagtttgccaggagtcagatttctgaggcttatttattttattttatgtagagattgagtcttgctctgttacccaggctggagttcagtggcacgatcatcgctcactgcagcctccaactcctgagcccaggcaatcatcccacctcagcctcctgagtagctacgactacagatgcatgccaccacatctggctagtttttattttttgtgtagatggggttttgccatgttggctaggctggtcttgagctcctggcctcaagtgattctcctaactcggcctcccaaagtgctgggattacaggcatgagccatcatgctgggcctcagagttttcagagttaatacaaactctaccttgtcataaggaactctagcgccgctgggagagtgatatctctggagagtgatattccacctgacttcttccctgggcttgaaaggggacttttgtgagcaggggagcagtgaaaaaatcctcaagaaaggtgtcttccttgacttaaaggaatttctctgggggcttgggccctgctctgtgtcaccctaaaggtaggagaggaatcaggagataaggaattagaggaagactggggtacaagggccatggccaatagcatattctttggagtgttgcttttgcattccagccagtgtgggtgggtaccacatgaggccagtctaggaggcagagccctgacaccttgcaaacaggtatgcaaaatgcctgcacctttagcgctctgaagctgtcttgtgttgcatgcacgtgatctgctcatgcttagaagtaattattaagtgcttttacttagccaatgtgggcacagcatattaactccaactcacttcaaggcaaagtttattataatcacctacctcctccatcttgcttagtttacttaaaataccacgtgtttgttggtcggcttcacaagacaagctctctttccgaagtcctagcagtcagctctctaaatgtctcatgctcccccttcctccttggtttctataaaggagaatgctgcttctttttatagaagtaatttccctgagaatctgataaaggtctagcatgattctgcaaaatagcgcagtaacaacattattatcacctggtgttttttttttcagatatacattaatcagtacattaagcagttggaatttaaccttaataaagacaaaatataaagtctatttgagatcatagactttgaggtcaaatgtattttgatagctgtgaacatgcttgaaatctgaagtgacttaagttgtggctggtttcaaaagctcttgtaacattagcaaaccctaaccctggaatctgtctttaaactcacacatcagtcctcagggcctgaggtgtgtgtctacatggaataatgccaatatgacttcattccgagggaaatggctgacccaccttttcttgtcagtagtcccttaataggaaggacagaacaaaatcagcctggttacataggaccctgaaattcacatttgtaattatgcaaattcatctattgttgacagaaaatgcaacatattgattgttgctgttgaactttgcatttgaatacttgcaaacgctttcaactaattgatttgcgtatcctataatctgacatcagagagtaactcaagtacaaattgccccacttctcaagaaaagtgcactgctatataattgaagccatttcaggtcttttgcaaacctattatgaagtactgagttttagtctacttttatttattgctgggaccagctgttctctttaagtgcctctctgtgaccccgacatgaaaaaggttgatttgcaagaacaaaatgtatacatacctgcagtgtgtgtgtgtgtgtgtgtgtgtgtgtgtgtgtgtgtgtgtgtgtggtggggatgaacattggctactctctttaatgagaatggaagctaagctttagatgcagttttacgggtccctagaattgatcaaaagcatccatagggagtgaaggggactgaaccagtgacagtgcccttcctatgtgttatgggctgaattgtgtcaccccccaaccctcaccaccgactaatatttatatgttgaagccctaactctcaggacctcagaatgtgaccttatttggagatagggtctttaaagaggtaattgaattaaaatgaggtcattagggcgggccctgatccaataggactggtgtttttataagaggagatgaggacacaaacacacacacaggaacgatcctgtgaggtcacaggaggacacggcatctacaagccaaggagagaggactcagggagaaccagccctgcccacacgttgatctcaaacttccagcttccaggactgtgagagaataaatctctttggtttataagccaccagtctatggtattctgttacagcagcctgaaatggacttagacatctcacaagaagagatgaggacacagacacacacacaagaatgaccctgtgaggacacagggaggagatggcatctacaaggcaaggagagaggcctcagggggaaccagccctgcccacaacttgatgtccaacttccagcctccaggactgtgagagaatacatttctgttgtttaagccgcccagtctgtggtcctttgttataatagcaagagcaaactaatacactataaaaggaccctgtgttgggggcaggggttgacaagggagaagagtgtgtttgggtgtagctgtctttcaaagacaggtcaagagacctaactcacacctgcccttgttggcacaaggacgtggactataggtaattacaaaatgataccctcaggcatggcagtacatagtattatggttgcccagagatttccatgccccagtctccagaacctgtgcagttattacatcccacagccaaagggactttgcaaatgtgattaaatttgcaggctttaaaatagggagatcatcctggtttatctgaatgagcccagtttaatcactcaatccctttaacgtctaagaagagtctgtttgagagatgcagcggaagaaaagaaagaaacgtgtgcatcattgctggttctgagacgtagctggctacttgcgtgcaaggtcttaaaagatgactctaggagcagagggcagtccccactaacagccagaaagactaacagggaccttagtcctactgcaatgaaccagattgtgccaacaaccctaataagcctggaatggatttttcccagagcccccacataagagcccagcccagctgacaccttgatttcaccattgtgagactttcagtagagaacttcatggagccaccaggaattctgacctacagaatggaaaatgaataaatgggtattgttttaacttgctgaactgtgaaattttgttacagcagcaatagaaaactaatacaagtgtattttaccactgttttgggtctctacctgataacctcaaatgattttgaccctgactctacaaagtatggtctgtggaccagcagcctaggcatcacctgggagctggttagaaatgcagatgctcacatcccaccctagacctcttgcatcagaatctgcatttggataagatgcccaggtaattggtgtgcacacccaacaactacctctattcattcagagatccaagcaggatgaggtactatgttttttatttagcaacatcatgagaggtttgcaaaattatttagataaaataaagaagatatacaaatggccaacaaatatgtgaaaaaatgttcaacatcactaatcatcaggggaatgcaaatcatagtcacaatgaggtactagctcactccagttaggacggctattatcaaaaggacaaaaatcagcaaatgctggtgaggatgtgcagaaaaaggaacgtttatacacagagagaatgtaaattagtattgccattatggaaaacagaatggaggttcctcaaaaaaccacaaacagaactattatatgatccaggaatcccactactgggtatttgtccaaatagaaggaaaggaaatcagtatatggaagagacatctacacccctgtgtttattagctgttcacaatagccaacagcagatgaagggataaataaaatgcactatatgcacacaacagagtactattcagccataaaaacaatgaaatcttgtcatgagcacctccatgggtggaattggagcacattatcttaagtgaaataactctgaaacagaaagttaactacttcatgttctcactcatatgtgaaagctaaaaaagataccgatctcatagacttgaaaagtacaacagaggatactagatgccgggaagggaagggggaagggaaggatagggagagatttgttgaatgatacaaaattagagctagataagaggaatagtttctagtgttctctatctgtataggatgactgtagttaacaataatatattgttgtttcaaatagctggaaggaggatgctaaatgttcccaagacaaagaaatgatcaatatttgaaatgatggatgtgctaatcaccctgatctgattagtatacatgtctcaaaacattactatgtactccattaatatgtatgattattatgtatcaattaaaaaattaaaactttttttggataaatctcttagctgtaccacagagtatataatttttcataatctttatccatttgaaacttttaaaatatatgccattttcatgatctgttttgtcgatggtaaagattctgttaatgagatactgacagggaaattcctgggagccaaagtgactttaactggaatcttggcattttccattccaaactcttttctctgttaatactaatccaggcagggcaggccagccactgttctggagaagttagaccaagatcagaagctagggagtattagaaatttataaaactgccttaaaatcctctttcatcctgcaaacctctcctcttctcgaagtctctaacgctataccttctgtcagctgctagcgtctatgatcctctgaatccagccattccttcctctcttattttgccaatgctttaagccttgactgatacacttccctttgacaactgctccagggaatttgtgggccagttaatagctaatcctccatttctctaatctgggttctctcatcctcataaaactctttatgatgcattcccacccagatccttgttttttgtttgtttgtttgtttgttttttgttttttctttttgagacagagtctcgctctgtcaccgaggctggagtgcagtggtgtgatctcggctcactgcaacctcagctacctgggttctagcaattctcctgcctcagcttcctgagtacctgggactacagtacaggtgcatgctactgtgcctggctacttttttatattttagtagagacggggtttcaccctgttgcccaggctggtctcgaactcctgagctcaggcaatccacccacctcagccgcccaaagtgctaggattacaggcgtgagccatcgcgtcccagcctcttagccctatttttatcctacacaaggtaatatcagcatgaatatctccacacttacattttatttttgtttccattcattagcatgctaagtaggcagtttacctatcaactagttgttcaagcaccttgattataaaagattaagcagaaatactgccatggtctggcttctcaagagataacatattcctaattacaagttcctagagtcaaactcagatagatatctgaaaaaaagcagattgactgcagctcaaagagtaagtctggtgactaatccaggtggatttgggagtcactgactgaacaaaaactgcctctaatagcttgaggatattcatttgatatgaaattatcatatgactttagtgcaaactgcctgctgatttttttttttacagtaaacctattgagtgctgcttaaatcttcacatctaaaaaaatagctatcaggagttattaaactcctactatgatgaagacagccatgctgtggtgcagttcgtgttctgtgtatgatgatttaaatacataaacaagtacacaggatgtagtttgttgaaaactacaatggatgcatttaataaagactattactgaaatatgtgcttttcagtggtcacggatggaaggcacagtcactggggaaaggtaaattataccaaaatcaaaaatacaaatatgcgtaacttctgttcatcaatacacaccattaaagaagtgatgcagccaattagagagttggaagaagtgcaacatatgtccaatgaaagactgactgactgaatatatgaagaactcccataagtcaatataaaaattgtagaaaacccaatagaaagatgggatggaataggccctttaaaaagtgactagaaaaccaatgaacatattcaaagcttctcaaacctatcagcaatcagagatatgcaaattgaaacaaccatgtgatgccactacacaaccttcagaatttgctaaaatgaagaaggcaaacatcaaatcttgatgaagatgtggaatgattggaaatttcatacatgttgggtgaaaatacaaattggtcattttggagaactgttgggcagtatttaagtattgtagaatgtattcatattttatgggccaacatttccaatcctaaaaatctgtgcatttgttcaccatcagcatggaaaacagtgtttttggcagcattatttataatcatctcaagtaggactcatgccctaaccaccataaaagttgagccatctctttcagccatagactgaataagaaaacactgaagaagtcttgaattcaaaaaagttctttggactagatattgaagcatgaattgaatttcatccctgatttggtctgagttttgcttctgctcaagttagcatggtgcacatttctttaccttaacatgcctccaagcaccctgcatttacctgtgtttctggccattcattgatgtgtttcgtggtgctcacccagtgcccagcacagaatacatgcctatggaacttcacacgtacttatcagccagcaagaaacaagtacataaaatgatttctcagacagtggaagcatttcctggtattatttttttcctgtggggtttactcaaagagtcgtttcaaaatgtttaaaggagattttattacaagagagagcatctgttatgtgatgtctctaacaacttatgtcggctaactggatttggttactgagaaaagatgaatggattttgagaatgagccttgaagttatttcatctcctattaaaatatgttgctaacttgtggctgggcatggcgtctcacgcctataattctagcactttgggaggctgaggtgggcagatcacttgaggtcaggagtttgagaccagcctggccaacattatgaaactccgtctctactaaaatgacaaaaatagccgggcatgatgacacgtgcctgtagtcccagctactcagaaggctgaggcctgagaattgcttgaacccaggaggcagaggttgcagtgagctgagatcatgccactgcactccagcctgggcaacagaacaggaccttgtcacacacacacacacacacacacacacacacacacacacacacacacattgctaacttgtggtaagagacactccagatagtgaagtccttgtctgttgtctctgacttttatttacttctatgaggaccaggggaggaccctcatctctgaaaacttctgttatgtcccacagtctggtgagaaaaccagccctctgaagaggaggggatgatactgatcattgtttatttaatagtaatgctgtaatattaataatagaaaaccttgaactgtctcctctggagatgtgtaattcataaccctggcataaaattgtcattttaaaaaagaatcttggcatgaaatctttgagtttaattggagggtattatcacaaacaaggggaatgataatatacgccttgtaactgactgagcccttatccttgaacttctaagtctcttcacccatcctcttccgtgatatgataggtagagtccattgtcttccatccttgaaaatgtatttcaagaggtcacatgaaagggaaaactctttgttattctctttttctactctgaatagaaagcacacacaagcttaacctggagcccaggaaggccgagagaagcctgtttctttggtttgtttctgggcttcttgcgttggcatgtgacccagggcatacaaataaatccttgtgattcagttacttcacgtgcataaagaaaaaactgcaataaatattctgaatccattttggatgttttaccgcaaacagcattcaaacccacaactccccttccccttctgtcaccacagccaggtaagtaataagaatgcctggaggttgagggagtgaaactatgcaagccacagcctgtgttcaagaaggctccctgcaacctcacaccttaaccaccatgaaagctgagtcatctcctttctctgtgactgaagccatctttgtactagcttgggagtcttccttgctcttcccagaaagccccactgtgtcataagccttctcatacattctttatgcatgtaatgtcatcagtcttgacctctaaagcaaagtttggatgtgtgcgtgtttggagggaggggtccatcccacctctgtggaatgactacagtgggtattaggtcccagccctgagcaataccataaagagcccaatatcattttgcagaacaagcagaatttactccttggagcaaaataataatgcacttacccatcgatatttgaatgactggctttttaatatactttctaatagcaatatattttatttactgctgtgtccatagatgccttctacatggaattttcttttatctccacagcccaaagtgattctctttgctataaactgccatagcattttgattgtcagtctcttacacaacttattacgttattccttttactgcagttatactacggtactcacaaaatgagtacattgcagagctttggaggcagggttgcctggtcatcatgggacagtgccttatacaatctatgttccctgaatgtataaatgaatccattttgagtgccaatagcaaagacaggagaaaagcacaatgccatttattatgcaccaggtatctatacccacgcatttaagagagtcacagaagctgccctttgctctgccactttccaatagaactggtgtgcaaaacgttgattttggttcactaaccctggacaaatgcgccttgaatatggtttaaccatgtgtcatataaaaatagttacaagacttgcttttatttttacatagtatgtgtagaccagtttgccaagctcattgcatgtaatcattcaaatgcctatgacggtgacactataaggtatatcctattttatccccattgtacagatgtgaaaactaaggatccatgaagctaaggagcccgttgaaggtgaatgttggtaagctgggatgccagatatatgaacccatgtgttatggctttagaatttatggacagttgctgtggctatagtactctgctgtgtagagttgtgacaggcagaccctaattcccttctcttgagcataggcaggacctgagacttgcttctaaccagcggaatatagcagaagagatgtgatgcttcctttgtgattgtgttacataaggttgtaactttcatattgctgggtgcttctctccctcactggcactggagaaatcagctaccatatttcagaggcccacatggcaaggaagggagggccatctttggccaacagccagcaggaaactgaggccttcagtccttcacttcacaaggaattgaattctgccaaaaatgttgcaagcttggaagtggatccttctccggttgagccacagataagaccacagcactggctaacactttgattgctggtggcagtcttgtgagaccctgaagcagaaaatctacacaagccatacccagattcctgatccacagaaaccatgagataataaatgtgggctggtttaaaccactaagttcatggtaatttgttacacacatatagataagtaatgcaggtgggctagtatgattagagagggaagaccagagaacagcttgattctcagagccttttatcactggcagctttattaatcatttttcttctctcttccttctcaactcatcttagagtcatgctccctaaatgaccctgatcataagaataacctggagtgcttgcgaaatgtaccgaattcctacctttacgactcattgacttggtgggggaggagccaaggagtctagaatttcaccgagactttcatgacattcttttgctcaggcaaagttgagaagcactgtcatatagctagggagtgaatcttgaccctggttacattttagactcccatagagtctgaggtgcattgtctgagatgaagcctggggactggtatttttctttctttttttttttttttttttaaaaatactccccatgtgattttaacatgcagccaaatttaagaactgctgatcttcagcaagccctagcaagaagatagcaaatgtcaagtactccatcaagtaagcatgctagttatataatggggaagagggatagaggccattaatgttctaagagatatgtgctttcccacaaaactgacctactccaagcaagactgtcagctcatctttttacgttaaagtgatttattctaaaatgttccaaaaagcacacataattgcaggatgtttgagtataagatgttttttgagtatcaaagtgaataaaagctaccagtgaatagaatggcagaatttggtttataatatctagattattctagaaacttgggtggaggatgtaaagtgtacatattgtaatgaggttgactatctaatttctggggcccagtataaaatgaaaacgtagtgcccctttttcaaaaaaacagcccaaagtgccattaaaggaaaaataagtataaagcatttacctctcttctgcagtctctcacttggcttgtcatggtgttttgtatttgctatttaatgttgttctgagaaaaggaaaattaaaattttaaattattagcatgagtattaccattcgtctttatatgacgtaataccagctttaaatgcaaatagaagagcatttaacttgtggacagaatcaccgaaattacctaatttatgtttcatggtgcatacatgcatatgtattttgttcttaccagaacagtggaaacactacacaaaactaaatcaactgtttttattttgcttctttctatgtgcacattgtacctcactatgattagttactggtaaggaaggacttaatggaaaaggaattacaggcttcccttcttagtcttttattctctgtcatcatttttcatcctaaggagttggctcatgcagggtaacccaggattttttcgttttgcatgtttctcagaacgcctgtgccttctttctgaatttgaaggaagttgtggtttcaagggaaagcatggcctcgcttggctgttagcttactcacttgtaggtgtcccatgcttacattgtcctctttctgaatctcgctgatctcctatgcactgtgggtttaccagaagtctgtgctcatgggccactgcatatgctatccatgaacagggcagtaagtaaaaccacttttgcaaaaatcgttagttattgggacctgagtttggagaataacatgttgggtagcgagaaaggtataaatgatgtgctcatcaaatcataagtgaaatcgtaagttttgattccccctgttcctcctttatcaaataattctgaaatcaattcctaaattgatatccatgtagcatcccaacattatgacatacgaggtatgtttcttacaggctacgttagatgtatctcttttaaggttctctcaaaggcttggagaaggggtagacaaaaatattgctcatctatcctatccccttagcttcagtccatctcaccagaagggacaagttactgagccaaagcgtgggctgatttttagggaaaggacatcaatgtaggttggtagagttaaaagaaatattttcttttcctcttacccaattaaaatttgagaaatagtcttagtacttagcacaagtgaattcactttggaaaacgtgaaggcattttgagcaacagcagtagactgctgcccttgtaagatacatgttgacttaccaggaccaccggacctaagagggcaggcccaaattgcccttacatttttatttggaacatttcctttagaaaacttgtaacttttttcctggtctctttgaaatatatgtaaatcattttgaaagctcaagaagactctttccagcattaggaactagcagtgtcttccttaaggacctgggagccatccctttgaaatgtaaacatcaagggagttatcacctcccgctctcagtctctgtaggaaggtaggagcctaacttcagaagggcctggatcctggttgcaaaaccacctgtgtcataaaagtaagcagactttatttttgctttgtacaaaacaaattaactaacacgatggtcaccccatttatggggtgaactgatggtgaactatgtgtaataaacaatgttgtcaagtcctcttacttgaggactagttattgtttatcttcggaatgtatatgtaagggggttatatttgcttggttctacagagtgagatttctttctatcttcacaatttctaagagattgtggaatatgatatccattacattttgatttaatgcatattcaataatgaaattgttttcttccccttcttcctttgtgaagaggttttctggattgggagaaaattttattttattttttaattaaatttccacaacaacactcatgagcctatcttttctgcttccaaaggagacacctcactacaccttaacgtcatgagatattttggtggctggatctcctaataccttgggtgtcttggtggttggatcgcctaacatcttgggtgttttggtggctggatctccttccctccaccttccaggcatacccagcctggcaccaatgagtaaaacagaactactcactgcccaaatgagacacaaaaacatagcttcctctttgtgttccagtgactgtcacacaagtccaacatcacaagtcaggagatatgagcccttaagggaggtctagccagatatttacgcccaggctcagagagttgaagtttaacatcctcattttttgtagtcctagaatgatcaagtgtgatcttgtgagactgtcttcagtttcagtgagtaaaagggcatctgctgatcctctcccatcttttcatgtattaggttaatatgtggaaacaacaggttgcagcagagaaagaggtttaatcatagagctaccaaatgaggagactagaggaaacctcaaatccctctctccgaggagtttgggtccagggtttataagggttttggagtgggtggaagtgtggaaatcattgacgggtggaagagtgtagggtgaagtcatggatcagggagatgaagaagccatgttctcatgctgatcccatttctctgtgcgtgcgtggggcgggggtgtcttcaaactggttggtgtcagctgttttgctggaatttaagatctgaaaaaagtcttaagcaattcttaaacaaaaacccttctaattttaacatcagagagcctatctataagaacaatggtgattcaaattgattcttaaacaaatccttatgattctagtgtcagaaatcctatctataggaacactgggggtgcaaatggtcagtatctgctatgtaactttcagttacaaggaagggggtcaaagtgcagcctgattaatgcttaattatggctgtatttctatccagaattcttaatcctgtgagggtggtttcaaaacatatcattcttctgtaatgctgtaatgcttcacttagagtttcgtactcaagactgaagatgcacaaagccagtggccagaccacacagggcaatagaactttgccctccagtctttgcaggaatctgcctagaatgatcaagattgggttagcgattgtcagcttcccaaatatttgcccatctttcaacttaggaggaaccagagaaagacaaatatgctcccccacataatcacatgagatgctgtgcttttaagtagcccactggcaggtcccctgatgccaaccacctccacttggggcatacctgaagccttcccttttccactataaagcttttttatttctccacctgccattgagtctgtgccaaacacagttgctagcggtggactcccttgtgaaagcagatttagtcctggactaagaagcctaaatatacccctaagcttttcatttaaatagtgattgcatttctgcaaggcttggattctttatcattcagctttcttgcacaggacaatgaaggtatgttccagatatgaggcaaacaagatcctttttcttggacatggttttaaagaacaagggtgacctactctcagacactttacgaagtatgcatatgtgcatgtctttttgcatgtgtagatttaggtgtttagaagccttaacgatcccagttttaaaagcaaggggatgcctgggaaactagcgcgtatctggcactggataaagaagcaatcagctgtcttaatttgccttctttttttttttttattatattttaagttttagggtacatgtgcacaacatgcaggtttgttatatatgtatacatgtgccatattggtgtgctgcacccattaacttgtcatttaacattaggtattatctcctaatgctatccctcccccctcctcccaccccacaacaggccctggtgtgtgatgttccccttcctgtgtccgtttgttctcattgttcagttcccacctatgagtgagaacatatggtgtttggtttttttgtccttgtgatagtttgctgagaatgatggtttccagcttcatccatttccctacaaagggcatgaactcatcattttttatggctgcatagtattccatggtgtatgtgtgccacattttcttaatccagtctatcattgttggacatttgggttggttccaagtctttgctattgtgaatagtgccacaataaacatacttgtgcatgtgtctttatagcagcgtgatttataatcctttgggtatatacccagtaatgggatggctgggtcaaatggtatttctagttctagatctctgaggaatcagcacactgacttccacaatggttgaactagtttacagtcacaccaacagtgtaaaagtgttcctatttctccatatcctctccagcacctgttgtttcctaactttttaatgattgccattctaagtggtgcgagatggtatctcactgtggttttgatttgcatttctctgatggccagtgatgatgagcattttttcatgtgtctgttggctgcataaatgtcttcttttgagaagtgtctgttgatatcctttgcccactttttgatggggttgtttgtttttttcttgtaaatttgtttgagttcattgtagattctggatcttcaaggagaactacaaaccactgctcaatgaaataaaagaggatacaaacaaatggaagaacatttcatgctcatgggtgggaagaatcaatatcatgaaaatggccatactgcccaaggtaatttatagattcagtgccatccccatcaagctaccaatgactttcttcacagaactggaaaaaactactttaaagttcatatggaaccaaaaaaggagcccgcattgccaagtcaatcctaagccaaaagaacagagctggaggcatcacgctatctgacttcaaactgtactacaaggctacagtaaccaaaacagcatggtactggtaccaaaacagagatatagatcaatggaacaaaacagagccctcagaaataatgccacatatctacaactatctgatctttgacaaacctgacaaaaacaagaaatggggaaaggattccctatttaataaatggtaatgggaaaactggctagccatatgtagaaagctgaaactggatcccttccctacaccttatacaaaaattaattcaagatggattaaagacttacatgttagacctaaaaccataaaaaccctagaagaaaacctaggcagtaccattcaggacataggcatgggcaaggacttcatgtctaaaacaccaaaagcaatggcagcaaaagccaaaattgacaaatgggatctaattaaactaaagagcttctgcacagcgaaagaaactaccatcagagtgaacaggcaacctacagaatgggagaaaatttttgcaatctactcatctgacaaagggctaatatttagtttgccttctaaccttcagaaccctgccaattctgagagtatcattactattatttttttttacagcaatatcccctgtgcacaatgcacccttgcaggatttctgcctgactgtggcccatgcatagtgctcagtggagactgaaatatttctctgctaggctctgttctgcagatgcatttgcagtgagctagaatacgcttgcctgccttgggaagctttgaggcaacaatagcgtgaaaccaatcacagtaattatcacattaactcatgtcattttgttcaaatactttcaacctttaaaatgtgggagctaagctctaagatccaatgctgtctctagcatcctgatgcttgtatagcgtacatttagttaaaaggaaactcattttgaggttataattagcaagaaaaatttacaatctgcaagctcaggttctattcatggacttaactcccttttcttgcctgtctctaaaaatccaggccactgtattccactagcaatcgctattgttattttctgcacctaataattaaatttagttcattaacctggatattctgcagtgtttttttttttttttggtcatcaattttacattcagcagtgcataggaaaaaattgcaaccctgaaaaaccttgtgcaggaccctagatttaatattcttttaaaatttcatttgttccccctgtagagttagaagttgtgcactctgcttttattttatatgcacatttgcgcactctgcttttatcttaataggcacatttagcttaataagtctgaaatgaatcaaggcttgcttttcaaaatagaaataatcaacggctccagctttatttattgaaaagaccatctttccagcattgaaattgcaatgacatttttgccctaagtcatgtgtgagtctctttctggactctccagtctgttttgtttgtctatgcatgtgtcgtgaccacaccatcttaattactatagtgtcacattgagaaagtgaatatcaaatgcaccatgtccagattatatacaaaattagaactctgaccagcctagcagtccaaccacagcctctgcagctactgacgcagaatgatcaggatctggtcaatttctgctagtttccctagtttttgccttttcttccaacatcagatccaaccagggaagatcaaatatgttttgcaagccaaccacctaaagcatgctacttttacttagtctgaccacagttttctcacaccactaacctccagtgttcacacctgaagcctttccttgttttcttttacggtaaagctgcaccattctcctgcctgcatgtaggttctggccacagattggtggctgactcccttcccatagcaagctttgaataaagagttcctgttctcatttgggttaggagtgtctttacttccaccattataagtctcaaaatgtggaacgttaagtcttccaacttctttaataatgtctcggctatgctgggtcctttgaatttctaaaattttagaacaaccttctcaatttccacaaaagtctgcttgtttttttgattgggcttgaattcaatttatacaccagtttgggaacggtagaaatcttagtaatactgagtcttccaatctgtaaaaatggtatatatttccatttatttatgcctttaacaaatttctctcagcgaagttttgtagctttcagtgtagaaattttatacatgttcttgcaaatttatttttaggtattttatgctttttgttgattttatcagtattatttttgttttgttttgttttattttcgttttagtttttgagacagcatctcactctgtcgcccaggctggagtgcagtggtgtgatcgcggctcactgcaacctctgcctcctgggtttaagcaattctcctgcctcagcctcctgagtagctgggattacacgtgcacgccaccacacccagttaatttgtttgtatttttagtaaagacagggtttcaccatgttggccaggctggtctcgaactcccgacctcaggtgatctgcctgcctcagcctaccaaagttctctgattacaggtgtgagtcaccacgcccagcctttgttgctttcataaattgcatttatttttttccttacttttcaaaattaattgattctctaatgatttctcgtgtatgttatgattgtgttggtgtggcggggtggagagagagaaagaacacagtctcatgttctttggaacttgatttgtagaagttctttgaactctgtttaaaatgatttttttggtaaggatttgttcttgcttctaccaggaacctcttggtacttacaaatttggaggcactgtaaagaaattgtaacttagccactctgacggagtagtttctgaccactaactgaccatggtggttgtaattgtttgggaatcttggctttatgcaagaatttcaaactgcacatccatttttcaggccaaaaccttggacttaagtcctcagcacagagacccttaaatgagagacttaatggtagtcaggatttggaagactactttagggcaagaacttgattcttagttaaccatcagatcagatttacttaaaaagtaaaagaatagttacattttacctgttattttagaggttccatcctggaaaaacagttgctgcaacacgaagcttccagactttaaatcatattttcaattagtattccccaaattcacaattaggtaagagagtatcatgcagttactgaattttttccctataatttctactttattctttaacactggtgcataaaatgcaaagaagtagtcgtaccccaaaccaaagaaggatgtttatgaaactgaagaaaaacttactgcctgaatcagctcctctgaagtttacttgaatttgtctactaatgtaggcgacaaaaaaaattctttattcttacctgtgcagttaaagttaagcagaaaagacctcactaaattatttgtgcaaaaagagctatgcatatctcatagattaaaatttatagagccttctgactttaaaatttcattgcaaatacacagagatacacaaaaaagttactcttaatttagtgttttatgaaaattcaacagcatcattctttaaggaaaacaaggatatctttatagcccacagttctctctctgcattccaataatggtgatgattaatccgaagctcagtacattacctcttcaatgagtaatatcagtgttataaatcagattttaatatttttattttccattcactagctcttcaaatatttctgacttacgataagccctttgtctgtatttttcttcaatgtctctattaaatctttgccatgacttatcaacatgaaaattgttggagaagttgattttgggtatgatggcatcattagcaatgtggacatacaaatcttcatgttattctattccttccctcccttcctttctccctccctttctttctccttctcttcctctcttgctccctccctttcttccttccttctttctttctagccttcctttcttgattcaatagaagataagtcccactcactgggtaactctaaatttatagtggttttggtaccctgttaaatagggtgaggctcccatccagccttgtcaagactgctttatttggctttgttccatggtgaaagtctgcatgtaaatcttggttagctacctcaatcttatgtttcttgggctgaaattgctctgggtgttgtatgaatacacaatgggcacaaataaattttttccaatgcacatgccagtgtgacccacagacttcaaggggcatgaacacagagtgtacattctcagcaaatatacacgtggcacatggtagctgctcaaataaatatttgtgcaatggatagatgtgatgtcgaatagccatggatttcaggtcctcacataaataatttttgcctcctaactcgagaaaagagaggacacttctccatggctggtgtgtctttccaatagtgggtgcagtctgtgtagcttctcttgctgttcacttacttcctgacccccatgaggagtggaatgacttacctttgttgtaaggagaaacagggcatgcttcttccctttctactgggagtcagcagctccatagagagcagccattgttctctttcagtattgtgagtctcaagagggcagtcttactagggaagtctgtctcagtcctatgctggctgagactcactggaggggaaggatttcggggtcaggactagattgcctccagacaaaaatgacattcttcaagatctgccatatcaaccatcaaggtgacattttgatgtccataaaccttatgtatttttttcttaattagctcagaactttcatgagccccactggcactcaaacatgacttgatttcatgtattatcttaagcatcctctgctaggtacattcaagcagaacagtggtgtgattttcatccgtaaaacaatatatgtgtacacacacaccacatagttatgtgtttatgtgtgtatgcacataagcaatgggtatttgtgtatttcacctctaattttccaatgcccatattataaagtctagcccacaaaaaaaatgtattgatatggtaccagatataaaactcttatttatgtcttctttacaagagtaagtagttctttgtttcttttttcttcttccaaccaaactataaccttgaggctgctttctttcttttaattttgttacatttattatgcatgaatcacatctttatgattcagtaagccttagagttgagagtaaattatgtaaactttcatgagtgacaaaaatattgtgtatgtcggtcaaaatgtcagttacctaaataaaacatgacactcaaattatgttacatagagggtcgtaggccaatagctcaaaaggaaacataatttatttaatagaattgactgtgattgtgagtaaactttataatctgcagctccatgctatttgggttgaagtatctttctggaaatgtttgaaattaggcaagtgtgggttcaacaataccaaattattgtaattctgggatatttacttcagattaataattctatgattgctgaggttcatagatggtaaatattaaataattttatttttattcttaatatctgagagttagctaaccttcttattaagaattctggaaataatttgcatagaatgtgttacagagcagcaagttaattgctgcttttcttttgaaaatttctcttgtacatatttctcgttatgaatgttcttcaagtttggatttcctttcatagaaacactataagacttcagttacttaaaatgactttgcaaagaaaaagagacagcagaatagcgacccgcttacaatgacagtctccacacctccaatcacatggatgaatattgattcccaaaagtagaattctgtgaaactgctaaccctctgaaacctatactcctgaaaagatgccatgccaacaggaatccagaagacaatggtagctttgcttttattgcgattttatttttaactttagtgtaacaatcaacttcccaaccacaatcctcttaaagtgagataaaattaatttttaatgactaaccacacatctaattgggcggaagtggaacaaaacccagggtcagctcattggctgtgatccagagctccgcttaagacatgcatggtcttagagacccatcatttgccttgagaaaatgaagtggcttaattattttccctaaataaatagtgtctggcatagtgttaggccttttgacttgtctgacaaatattgaatggctctgctcaaggaattacaaataaaaaatgaaaatttacctgtgtctatatattcattctatctatctatcttatctatctatctatctatctatctatctatctatctatctatctgatatggtttggctctgtgtccccacccaaatctcatcttgaattggactcccataattcccacgtgttgtgagagggacctggtgggagataatttgaatcatgggggtggtttctcccatactgttctcatagtagtgaataagtctcacaagatctgatggttgtatcaggggtttctgcttttgcatcttcctcattttctcttgccaccaccatgtaagaagtgccttgcacctcccaccatgattctgaagcctccctagctatgtggaactgtaagtcaattaaacctctttttcttcccagtctcgggtatgtctttatccacaacatgaaaacaggctaatataccatcctatcatctatctatctatctatccatctatctatctatcttatcatctatctatccatctatctattggctatcaatctattgattttatcatctatctgtttatctgtgtatctacctatcatctatttatctgtgtatcttctatcaatctttaataatagaaaatgtcaggctgggcactgtggctcacacccgtaattctagcactttgggaggctgagacgggtggatcacctgaggtcagttcacctgaggctaggcttagccaacacggtgaaaccctgtctctactaaaatacaaaaattagcaaggcatgatggtgggtgcctgtaatcccagctactcagaaggctgagatgggagaatcgcttgaacctgggagatggtggttgcagtgagccaagatagcaccactgcactccagcctgggtggctgagtgagactccatctcataaaataataataataataatagaaaatttcagacacagttgaattttttggtaccttttccccacttatttccatactgtcttctccccgtgaacccccaaaatctggaccataaatttagtattttttatacatattttaaaattgttgctatgtattagctatttagaacctacatgtagacatgttttgcctgatttcaaaactgtaataatgtaaagtatttatgtaaataaatgcaattatattgtgcatatcctcctggtacttgccattctctgttgctttcaatttgttagattttttgtgtgtgtcaatatatctctagttgactcatttgttctactgtacatgtttttattgtgtggctataaaacacatggttttgcttctctgttgatgaaaacttaagttgtttccagttttttgctgttatagaaaatgcctcaaggaacattcctgtacacgtcattttgaacaccaatatgagaacttcttcaacatatataattaggaatgaaattgctggctcagagggcaggtatatttatttagtattgcttaccaatatggggtttgaaacaatttacctgacaatttaaattgaagacttttaaatgtttgctgatctgattgttatgatgtaataacatatcgtacttattttttaattttttttttttttgggaaagacagaaaaacctcgccaggttgcccaggctggtctcgaactcctgacctcaagtgatcctcacacctccacctcccagagctcacttattgtttttatttgcattcctctcgttaccagtgtagtcaaatatcattttatatgcttattggtcatttggattttctgagaatttcctgttcagattatttgaccatttttttctctaacagatttatagaaatttacacacactaacacacacatatatacatatattatgaatataaaatttttcatattatatatatttatatacatatattattgatataaaacatttgtcaattacgtgcacaaaaacccctgataacaatggtggcttgtatttttggtcttgtttttgttgtttgtcaaagtggtggctaaacaatttactgtataacttttaaggctatcaaaatatcagtcatttccgtgtgtgtgtgtgagagagagagagagagagggagagagagagacagggtcttaccctgttggtcaggctggtgtgcagtggcataatcatatggtcatagctcactgcagccttggtatcctgggctcaagcaatttcctgccttatctgcccaagtatctgtgactacaggtgcacactgtaccatgcctggactagattcgtgttctttatgtctagctaagaaaacttttactgttcaaagtcataacattttaatctattttactcaggtacaattaattatatatatcttttcaaaatacccttcctgtaaagtcatctgcttctgaactctaatagttatcaagtcaggtatttaggctgcaagaagtgttatcatagctgaggaatagaaaataaaatgtatataccatgctcaggcttaattgctaataaaaagtaaagataatcaccttaattctaaagtatatttaacaacctgaacaggaacagaggtaaaacaaaatcacctttgttgaactcttgttggtatcagccacgtttcattatgcaaacaattagaactccaaggcaacgactatttgagctaattcccaatacaaacccctcctgtttaagggtttaggacattcataccaagcctagctggacctttcttaaatcattttactcttatttctactaaagttcccatgtgataatacatcttggttcctatgtacataactaaccagctgaggtgggctgagctgtacaaaagcccccataaataaactcaatttcttttaatggctagtctgcaagctgacactttgtttcataaattattctgtatcatcattttgaatcagtttcccagggcttgatcaatgctgggtaaacagataaaaattgtattttgggtcaggttcagactgtattgatctgagagcagaggtgacagtattcatcagtgtaggctctagcctttttgccatcacaataatttggcagaacccgatgcaagtattatgtggttaaaagacactcagttaaccgcccagataattcttataatgccttggaagagacccacataacttgcaacagctaattttgtgtgtcagctgggctgggtcagaggattcccaggtatctggttaaacgtgatttccaggtgtgtctgtgaggctgtttggaatgagattagcatttgaatcggtggatggtacaggcaaagggtttgccctctgcaatgtgggcgagcatcacccaatgtgttgaggctctcaatagaacaaaaggcagaagaaggaggaattcatctttctccttttttcttttgccttaccgcttgagctgagacatctcatattctgctgccttggataggggtttacactatcagctccctagttcttgggctttcagattcagactgagtgatactactggacttattgggtcttcaggttgtagatggcaaatcatgggacttttcagcctccacaatttcatgagccagtttcttataatctctctcttcctatctatctatcatctatctatctatctatctatctatctatctatctatctatctatctatctatgtatctatctccatctctccagttggaaaatcagtctccaattggctctgtttctctgcagaaccctgactaatactttattctacccatgcgatggcttgtagccagtctggaaaatctgaaaaaaaaaaaaaaaaaaaaaaaaaaaaaaaaaacaaataattatagacctacctgatcaatgcatacgcttttgttctctcttagcacagatgcttggtgcattgatcctagccctctgtgtaggttatggcatcctagctagactggcatggacccataagtagttagaggtgaggaaaagctgcaggtaaccagtacagtgtctactacaggttagggctttagttaagtcagggtcccaaaaggtggctcctaaactggggttcttgggatctcagagtggggaagccagcaaaggagtgagaaagctggatagaaaaagggagaaagtcaaatagagtgtgattcctgcaaagtcccagcttcagtctgatctctggggatcactgaggcttatacaatgtcttagaggatttctgtttgttgttgtttgtttgtttgtttgtttgtttgtttgttttgcctggaggtaagggagctgggcattcctatctacccccattcaatcatcgactatgttggctgcagtttggggctttggtgagtgagaggatggagatgcagaatgagaagtgatattaactactggcatttctccatgctccagcaacccaaggacagcaggtcccctgataaaagtgctagaaaaaagcactcagcagcgagacgttgccacacagaataggtaaaagggagctgctgagaatttggtagagcagcaactttggctacagtggtcgctcagtatttgctgagctaaaaccccatttgtctgtagactctgcaatgattaaatccctagcaaattgatgacttaaagaaaaaaaaaagaaaagaaatgcaccagaaatccatcttcatcttgaatgtattccttgcaaaaaaaaatataattgttgatggcttttttcacaaatcatccttgaagaaaattgtctaatcacaaaatagccttttaaaaacagattctgggctgggcacggtggctcacgcctgtaatcccagcactttgggaggctgaggcaggtggatcacctgaggtcaggagttcaagaccagcctgaccaacatggtgaaacccccgtctctactaataatacaaaaattagccaggcgtggtggcgagcgcctgtaatcccagctactcaggaggctgaggctgaggcaggagaatcggttgaaccctaggaggtggaggttgcagtgagctgggatcacgccattgcactccagcctgggctacaagagcgaaactccatctccaaaaagaaaaaaaaaacagattctgtcagccatgtgtggctggtcgaatctggagtttgtaggagagaaattggtttatcagaaaagacagaggggacttaatttgggggaaaattattgaagagatttatgtagtgacagaaatggttataacttggaaagcagccagaaaaagctgaatcatggggattaaagtaggatcgatactccctcaaacgggttgtctgcgaacaaaacaacagtcagtgaagcacgtgacagcatttcaatttgaaaagtattcatcagtgcaatatttttccctgacacaaagttttaataaatgatttttcagtcataaacttggatgtttttttccccttgatgttcttttgtattccttttttttttttttaacggaacaggaactgttttcgcagttagatacaagtgctattctatttccggaactttattactagttcattgcttatcatcatttgccaccataggatagcaagtagccaattacagctcagaaaccaaattctgtccatcgcctgcttttgtaaataaagttttattggaacacaacaatgcccattcatttatgtattgcctatggctgcaatttaattctactttgtgctacaagagcagcgctgagtagttgtgaccaagaccatatgtcccacaaagcctgcagtccttattattggctctttatagaagtttgctgacccctgcattaggatgtggatgaatgccaaaacctacagcacctctttccttcctcatctgctttatagaaaaatcagaggcctctgagcagatccttcaaaatcctgggagaagataagaggtcagaatttatctcaggaaagacaacatatcctattgcctaatgttttcattaaaagtctctgaaatacagaatgaaaaaagattggagaggaaacacaccagctctcatcaatgattcatctctgggaagtaaagtaatagctgtattttttttctttgcacatttatatattttttgcattttaacaataagcatggaagtataccttctataataaaaaatattttttaaaaaaccctacgaacttgtaaaaaatatcagagcattccttctctgtaatcagtaggtggtggggttggatcttggacataaatccatttctaatgagcatcttcagtgccaagaaaattttacttattcctccacgagcatgacaataattttctggaataaatatcaccattcttactttgaaaggctggagtgatttatccagcactgctgtgtttgctagggaaggagaaagagttgggtgcacagccaattttaatgcttgtggtctttgcagcatatcgcatatataaaaattatcaagtattgaatgaattcaaagcattatgaggtgtgtgctaataattaaccaaataatatattccctgcacaataagagcacaacagggtgttactattgggacactgcctattgccagaaaaaatatataatgtatttattgcatgcacacacatatgtgtatatatatatatatacacacatatatataaatatatcccaaataaatatgctaataaataataaatcatggagtaattaaagtaattttagagtgataatctccattacaaatgtacctattaggtatgcattaatattcataagtaaataataagaggttttaaaaatagacatttgattacaggctgtattttcaaaagtacgttaagttaggtcaagtgctggtctcatgtgcttaaaatagggttgaaagagtagttctatgattttattgtgttcaaggctacctttgtgggctgtcttctgataaatggctccatgtatttggacaatgcagctgaccagacttctttttgtaccacaggactttgcagagcctttatcaaattattgttctttgtgaatattcaggagagggtgctaatccacagcttttcctgggatgccatttggcaatgtctgaagacatttttggctgtcattctggaagggggtggtgatattgggatccagtgggtagaggccagggatgctgctgagcatcctgcagtgcacaggacagcctgtcacagcaaggaagggtccaggccaaatatcagtagtggcaaagacaggaatttccttctcccatcttcctggttcttggggctttagtgcacttcacagaatagtggaccttgggtgctactaatgcaccagtgatcctagtgtgccacatgtgctctgggcccctagggtgattcatagcagttagcaggagatgtcagtggggaaccatcaactagaaggagaaatccctgtgtttagcatagatgggcatacctgaagcactgtggtggaagaaatgatttgtgtttgcatttacgtgatatgagcaccttgaatttctagaaaaactagcaaagattgaacaaggcagatggagtgagccaaccagtagaactcggattgctgtggatcttaattggactcccgacaacatgggactgaggaaattcagtttagatcatgattaaataaaacagggacacactgaataaaccggagggaaacaaaacctgaaacagttaaatagcttcagaaaacatccaaatgactaagagggagtaatgacttctctggcatgatatgcccaaataaacaaaataaaacatattcataataataataaatggaattgttagtgcaaagaaaatgcatgcaattcatttttttcatgggcctcatccatcagtttgtctctccctcacttttcctcccgtgtatattgattgagaaggtattgggttctgggtacggtgctcaaacttaggagtacgaaaatgattgaagcacatcccctacgttttggagatcataatgcacaatgaagtatagatgcatgcagtgacaggcaacataattatggccattttgtcaggatggacaacatgctttgatggatcagagatgtggtgatttctaattacactggaggagtgaattatgagctgaattgtgttttatccgacagtggaggttaagagttttctactcaaagagaatggagagagccagtcacagagttataaatgtctgctgcatatttcaactgtcagccagaagtgcaagagcgctggagtggttacacagacataggcagagggggacggcgggtggggctggaaatgcaagtttggttcagttcatcaaagacctccaatgccaggcatctgagggtagatgttcaaggtacgtgagtaacacttatctttcatatcacatttttaattcattctgctcactgtagatctcatacattttctttttttaggtcaggtgaaaaaacacatttctttttcccttacccatttcttctttaccttcctattaaccaagaaatgaatccattcccagctgaaattacaccctacacctccaaacacctaaaatctcatcctctcagcattgtaatttctaatgggggacaaagaagtccttcagaaggatttgaagtgctggtcagcagccaggctcttggatcaagtgttcttcccgctcggaatacaaatccatgtgtcttccaaaggagcccaaagagaaggttcaggatttcatgacccctggcagtcacacagcactgcaatgttcatactgctttggttagttattcatctccacatgtgagcacggtctgcttgtgttttgatcagccccaattcagagatgaagaaacagacaaaagctgaaatgacatctcaaagtcaaacagtcaatcccagcggcaggtaaagagcttagctaggtttctggatttctggcttctgtctggaattcctgccgtgtgttatctcactcgccaaacttacatggcactggcatttgctgattatgggtttcaaactaaatgaaaaaaaaagggggaagtcgtattgaatataaacacaatattttcagaaaatccattacccactatattgcatttataggaaggtgattaaatttccatatccaatatgctaagtgaaaatggggttgaatggtaggtctaaggttagatcactatggatcagagagaaaaataatgagttactgtcacttttttgtgccttcaatgcactagggattctgggaacattgttctggatggattgacagaaaataacccatcctgaaatgggtcctaaaatctgaaaaaggaagcttgtgttcatcaagtgaatcaacttgaatagtttggtgaataacagtagcatcagattgattcagatataatatgacaaccaaagacatttcttagtgtacttatcaatactaccaggttcagggtacatggactctgactgaaatatttcctgagacatctggtacccagtatattggatgttctttcttggaggcaaattctttcattaaaaaaaaagttgatattggggggaaattattttaaaatccttggttgatagctacaaattacacatatttttcccaaaattctatgacatttatagaagtcatatttcacttatttatataaaaattcatgttatttagttaacagaattttgtactctatgttatacactcaatttgaacaatacagtagggcctgtggaaatgggaacttttggccatctctccattcaaacgtagacatttgtgtatcttccttccacatttcttcccctccacctgccctgttttatagctacttcacatgggagagttgctatgctattggttatggttgctgtatttcagagtatgggagtcaacaaggtcttgtttgcttcctctcctcttgtgggaggtacacaggctgaatgttcctatgcaccttggtttggaggaaaggcttggccttcctcaagtcaggaaggacaattaggagatttgctggtctttaattttactgttactgcaaagctgggattgttgttgtactttctggcctgcaaggatatttgaacaaagctaaaatatgtcctagggcatttttaaaggaaatctcatgagcttgtcattttttatccaaagagatccaggtttataatcatttaattactaaatgattggctaaaatggagatccacataaaatgatgtacgcatacttaaaatagtacacttaactatatctatacctatattatatctatctacttatagatagatatagatcaatctctgtctatcctccaccagcgtttttaaaataagatcaagttgtttctttgagtatgtgttcacaaattggagttgttttctgtataagacatatccatgttctttgtgggcagctgagcttaagatgtccctttgagtgaacacacatgagtttggaagtggatctgcctcagtcaagccttcagatgagacctcagccctggtcaacaccaagcttgtagcccagtggcaaaccccaacacaggaactgtatacgtaactcatgcccagattcttgacctataggaaccatgagctaacaaatttgtgttgttttaagccactatgttttgtggtagtttgttatatagtaacaggtaactaatctattatatacaattgacagtattttttttaaagcagaggtagaaattaagacacatataaagaaatctcagtgcaaaatttttctagatttttatgattttcttctcaagcatttatggttatgctgcccccaccaaatttaatagaaatatttagctcacttttacttagttttacaaaaaccaaccactatgttcttttgaaagtagcagctctttttcttgatgccatcaaataagattaggctacattctggcaaatcaaattccataattacaataacaagtgcaagctgtaacacagttttgggatcaaagcaatggatttctggtaggcaaacaactctactcacagaagcagaaagttatagacaaactagagactgccatgtttatactaagacctcaacatgttagtgaattagccaaaacattttacagaagtgatgggctctgttgatgaatctgacaagatgattaattggaggccattttaagaaaatttttactgtgataataaaactaataatttttaacatggcatttctttcttttttatactcctgctgaattagaaatatcggaagagaacagaagatttgagaaatgagacattctcaaccttcagtaatgttcttttaattctaccctgggccattattatttaattcataataagtttgtcataaacatgaattgaaaaatgggagccgcccaatatttctctgtcatcatatatctggttttactcccaaattgtctgataaatgttcccagggagcaagtttcataaatgttaaacaaacacgattttatattgtagggagaaactcatgattctatccatctgttcactgaaagaaaagaaaggacaaatcacttttaaaagaatgtgcaggaaaatgacccaagtttgtaaactctgtattttttatggcatctcatgaatttcagtcttatttttttttaaggaaatagacctaaactcacaaacagtccttacaagagataagaatggtttctctgaagttgttctacttggtcttattactcagatgagatggactatacatccttggagtgagagtcaaaccagccatgggagaaagcaaagaggatgctgatggtggcctctcatcttatcaagctcagagctgccttttaatggatggagaacccaggtgaccaggtgcagataatttcaaagaccaactggaactttgattcacctgagtttctaaggaatgctagatacttcatagatccaaacactgatacctattatcaatgtagaaatcggctgaacactgtccctctaatttggactcttagggcttcatcagaatgttccctggctataagtagcttcctccttgatcctgagtcccaaaatggaactttaaaattaatatcactggaattcttaaagaccctctgctagacatctgttcctggaagctcttttttatcacaacttaggattatatagtatttacctctatcatatataaatacaattgctattgaactttagaagaaacccaacaatttcacaagtataatcctactttatttaaaaaccactgtgagatgagtgataatcctaggcaggcacatatttcatataatttccatttgatatagcaaatatcacatcctgtttatctactctatgccagatgttgagctgcagaatggcatagatgctgttcctcacacccttggagcttacgatgagtaggagggacaatttgacaactgcaaaaagagacatatagcatatataatggatgcccaacctagatttgggagcttaagttccagcgaaggacaattgaagcctgaagagactaaataattgccagaggccagacaattccaataaataacaaacaagatgtaattccacatctttcctcccatatctacataaagaatgcagcttttcaaaaaataggaacgtgttgacaggacacatgaaggtagtgtctgaactttcacagtggacaagtaattgatcagcagcggattaatttgagttccatctctatgtccagtcagcatgctggaattttgaaggcaaagcccccttatccttgaaggttataatctagttcaacatgtggacacttagagaggaacaacagacactggggcctgtcagaggacaagagggagggaggagggagaggatcaggaaaaataactaatgggtactaggcttaatacctgggtgatgaaataatctgtacaagaaacccccataacacaaattcacctatgtaacaaacctgcgcacgtattcttgaacttaaaagttaaatttaaaaaataagtttaaatgtaataataacctagttcaaaaccaaagatattatcaaatggagcaatagaagagggcaatcctgtatgtattgtcacaattctgtgggacagataacacgtggtgaaagtaatttagaaagggcaagagtttaggtctcatttgtcagtttgtgtttttgttgcaattgcttttgaggacttagccataaattctttgccaaggccgatagtaagaaggggaaattgttctatcaaaaagacacaggcactcatattttcattgcagcacttgtcacaatagcaaagacatggaatcaacccaggtacccatcaacagtggatcggataaagaaaatgtggtacatatacaccatggaatactattcagccataaaaaagaatgtgatcatgtcctttacagcaacatggatgcatctggaaaccgttatcccaagtgaactaatagagaaacagaaaaccaaatgccacacattcccacttataagtgggagctaaacattgggtacacatggtcataaaaatgggaacaatattcctttgggtatatacccaataatgggattgctggaacagaaaagtaaatagcacatgttctcacttataagtggaagctaaatgatgacaacacatgggcacatagaggggaacaacacacactggagcccatcagagggtggaaggtgggagaagggagaggatcagaaaaaataactaatgggtactaggcttaatacctgggtgatgaataatctttacaacaaatccccatgacccaagtttacctatgtaacaaacatgcacatgtgcccctgaacaaagtttaaaaatatgggaaaatagactctagggaatataaggggaggaggaaaagggaggtgtaagggtcaaaaacatctttctattgggtaccatgcttaccacctgggggatgcaattcatttatatattccaaacctcagcaccatgcagtatacccgcattataaaactgcacataaacccctgattctaaaataaatgaaaaaaaaaaaagaatgggtgagagaccctggctctcagggaagtatgaccccgcaaaggccacatcctcatcacatcccatacacaatgcagcattcactcttccccacatgcatactgcccttttctggctttagagttctgcgggtttctgtattcttttttccagaatattctgtctcagaagattcttctttatttagcaaaagcccactttaaatgccacctcctccatgaaacttcaggcctaaatattttctctgttcatgacaagtcacctgctacatcacacctttatgcaatcatttgtaaaatgctaacaataatgctactccattcatgggaggctgtagagatttagtgagagaatcaatataaaattcctagcacaagatgtggctcataggtagggctaaccagagtgaaccttcattacagttaatgccagtattactgttgatgacaatccgcagtcctcactttgcacactatcatgacaattaaaactcacacatgttggaatcatgttttcaccttgcaccgttctgtggtcacagattttcagggagagaacacggttctgatgggcatgaggtttagcatcaggagggcatgtcaagagaaggctgtgtgtaataggaataggaatagtaggagtaactgaagggttttgcactaatgaggaactcgagttagaccctgacagtttacattcttgtctttcagagaaggacaaataaaagaagtctctggcatattgtttaaactctataatagcagcaaaaatgcctcagctgggattacttggatggaaacatgcagagttgatcttggttggtgtgagaggaccttgcactcaatgcaggtcttcgtgaattgtgatcatcaacagatacatgggccactgctgacagcactgtctccatgttaaaacacctgacgttggtaggatatgtcaggggtattgttagggtcatcgacaccatcctgggttttttggctatgtccttgtggctcactgcatccacttttatgttttctgggttatttatgtcaaatctttggattatacctcagttattttagggaaaaaatgtgcatcctggcacaaaaaatgtaatgtgattattgccatgattataggctgctctaataaatatgaaacaacagttttatatggaagacaacatttgtgcaatctctggaggacattgattcaaactcacaggggccttcccttcttcattacaataaaaattgctttatttttaaaaattatataaataaatgtaggtttactgtgaaatactccgaacaacacagaagtaaagcagacataaaattgtatgtacaaattccgttcccagagagagtcaccgtaaatatactggtgaacgtgttacttagctttctacacatgtgcacatatatttgtacagaaagatacatcggttatttttatgctctctcaaatttgcttccccctcccaagaatacatcaaggacagttttgctcagttttgctgtctgcctatctgtctctctactatctatctatgtgtccgtctatctatctatcgtctatcatctatctacctatcttatctttccatccaacatctatctaatatctatctatctacctatctaatctagtctctatctcatctatctattcatctgtctgttaccatctgcgtctctattatgtatctatctacctgtttatctatcatctagctcatctgtctctattatcattttaagtaactcgctatgtttcattgtactataatttgttaaatcaacgctattgatgaacatttaaagtgtttttaaacttttcactctttcatacaaaaatgtgatgagtgtatttgtacatccgttttatatttgtcagacttttttcctgggataaatttctaaagtgaggtttctgagtagaaagaagtgcatatgcaattaagatttttgaagcctacttccaactgtccgtgcaactattgacactgtatattgatattaggcattatcaacttttttcatcattgtcaatcttagttatcaaaacagtgactttttttaatccagatgaatgaggaaactctaaaattcaattgtttttcctcaattgtgataaaagatgttccttttttgccatagaggatactttttctatttcttttccctagttttctaataattcctggtgggcttgttgtagtttgtctttattatactgagacaaagtttgattctgccttccctggtatctgttcagacctcctctgtgtacttatttattggttggggatattgtcatggtctcttccacagaatagggaatcagagccgggtgggctgctacgagctgttgaaaaggagttggggctgggtgcagtggctcacacttgtagtcccagcactttgggaggccgaggcaggcgggtcacatgaggtcaggagttcaagaccagcttggccaacatggtgaaaccccgtctctactaataatacgaaaattagccaggtgtggtagagggtgcctgtaatctcagctacacaggaggctgagacaggagaatcgcttgaacccgggaggcagaggttgcagtgagccgagatcgcaccactgcattccagcctgggtgacggagcgagactctgtcttaaaaaaaaaaaaaaaaaggagttggagggcagaaagaggtgcacgaagcagcctggtttctcctctttgccaaactcccatcattagaacaactggaaagaaaaagacaagacaataagtgtctttagggtgtgtaaactgtcattcttaaaaattccggattatgtgttcataatccccactctgtagaatggttgcaggcatctaaggctaaaccttgagttaggtgggctttctttgtgtaaatgtcagtgcagtctgctttgctggttggtcccttttatcacacccatggtgattttgagatcctttacacatgtgtatctcatccatacattgctggcttagcaccttccattgagttgttctggaccatgcttcactgtctccttctgtatcccattctcacatcatctctctgttgccacctacaactgggtgataaacccatgattgatggcagataacccaggagtattttgttttccaaagaaataatttaaatgaaacactggctattttcttgtaagtagtaagtgatagctctacttaaacagaattaaaagatagaccacacacacacacacacacacacacagtgggagggtcaactcttaataggtgtagagaaaggaaagatatgagtcaagacatctgagttcttgtgccttctatgacaattggacctttggaaaagccacttgatttttctgtgtttcaattttccaatgtataaaatgggctcagctttgatctgcttcatataccaggttgattttttgtttgattttatttcaaaagggcattcttaactaaggaataatacaaaatttaagaaccatagaactatttttatttctagggttacttccagctctgagtctaggaatctgacccaaatttttaatacaactcaaaagtagaagcctttctgttttaactctctattgagctttttattattatgaagaagatatataaattagaacaatataagcctgtataatttttacaacaaaagaccattttatctattttaattagtaatttttatcaagaatatctatgagaaaataataaaggtacctaagccattctttgaaaatgactaaatgattagtaagaaagaagaaactaagacactataaagcacaacaaaattaacagatgcttaaaatttagaatatatgttttaaaaagtgttctcactagagtaagaagtggcgttttccctggaacttttgtaaaatttgatttatatggtgcagtcaaagtgtatttaaataatgctatcttttttttttccacctagcattagtgagtttgatgagaagactgagtctgagtggcaggtcaggaactgccatcacatgggggtttgttgggaaccgttcattcatccataaagcaggataatctttgagggatgctaacaatggagacaaggtttccatgcaggtgggcttcatcccaggtgaaaagaagctcataacattcattgcagcctgaaaaggaatagcaattgtatcacggcggggtgtgtctttggatgtgggtgtgaatggagtcagagtttttttacaggtcagactctaggggcttagaagaaggacttggagattctgatgtcttctggggccagaaagagaaacgtgaaagggtggaataggtggagtgggcacctgggtgagatggggcaggtgtgcactgtctaaagagatcacctactcagcttcagtccacggctgctcagtagaaatgctggtcatgtgtcactaggccatctgctttccaagagaatgtgcccaccctctgtcgtgatcttgatgtcatgacccctcacttgtgctgagtacaattatctaagaccattgccttctttccattatttattttattttacggttttccaaatcacagaccagcatcgagctaccccaaaaggatatgaaattatatgagtgtctctatccagggtgccctctgtcttgatttaaccaaagaaattccagaaaccgtgtacccgaaaggaaaggaaccaagggttcagaaagtatgcctggcaagtattggtggctttttgttttgatttgtttctgaagaaatgaatgttatcttatcaaatgcacaacagaaaatctcttaaacaagctgaactaaccaaataagaggaatttattacaaggatactgtagcattcttcaaactcaggggaagatgtgtaactcagcctcttgagaactgaaacaagatgctgcaaatatattagaaaacaggcattagctctctccctctgcccatatggcactgtagggaataaatgtacttcaatgaaaaactatgctatattagcctgctctcacgctgctatgaagaaacacctgagactgggtaatttataaagaaaagaggtttaattgactcacagttccccatggctggggaggcctcaggaaacttacaatcatggcagaaggagaagcaaacacgtccttcttcacatggtgacagaagagagaagtgctgagcaaaaggggaaaagccccttgtaaaaccatcagaactcgtgagaactcactgtcatgagaacagcatggaggtaaccgcccccatgattcaattacctcccactgggtccctcccatgacacgtggggattttgggagttacaattcaagatgaggtttgggtggggacacagccaaaccgtatcacatgcgttggctcttacacacttttccaggcagtacaactctatccctgttcattgactttgagctattttgtaactctttgtaaattggaggtaactgatacgcaaactctgtcttgtatgatagagtttcaactgattctcaaaaatgtctacagttttgccttcttttgcaattcaactgatttgctgtatatgaatttgtgcattttcccccttgaaccagttatattatctgtccggttgtctcatttgattaatgagtaaaataaaatcatttacatgtgttcattttttttacctgtatggaagtcatgcttttatctttttttctgaaaagcatctcttcctatcttgcttttactaattctgaatgcacaaagatacatggctcccatgctgactttgcaagatcttgcttcaaaggaacagtgcttctaaatctcaattctaatttcctcctagagaaaaaatatgtttttaagtgtccagctggcatgattctacgtttgctacaattgagcgtgaccagagggtgatgcctgcactacctactatcatgtttgataacagcccagaatgttgggatgtggagggagaagttctcaggagtgtgtatgttgtatttgtgtgtgtgtgtgtgtgtgcatgagcttttagtgattgggtgctctgagtggttgttctgcacagtagatagtcaagaacaagttgattgccacaaatgtcagggctgtagaaacagaattgggatatctatggggccaaagaggacctcaaacaggaacaaacagcacacatccttcacctcacaaaacttcattaaattatgtctactatgtaaacccgttgctagaggttcttgtgtatatgaagggaacacagaagagacacatgactcacagttattcaaattagtggccaggtgtggtggctcaggcctgtaatcccagcactttgggaggccgaggcaagaggatcacttgaggctaagagtttgagaccatcctgggaaacacagcaagaacttgtttctgtgaattttttttaataaaatcacccagttgtggtggctctgtctgtagccctagctactttggaggctgaggtgggaggattgcttgagcccagaagtttgaggctgcagtgagctatgattgcaccactgtactccagcctgggtgacagagtgatacactgtctcttaaaaaaaaaaaaaaaaaaaaaaaaagttagtgtgtgataagtcctataaatataaagaattccaggtttatgggagtttgaaataaaggtctatgggagtttggaagaggagaatatgacttcctctttgagggaattaaatttgtctttatagtataaatggcatgcagtgaagaccatcaataagagaccgggttggaacatgggtgacaaggttgtggtggtggggatagtagggtttagaagggtttcacatgttctatatgcagggacagcccaagccaaagttcagaatattcagaagcaaagaattatttggtggaagcagggaggtgtgaatggtttgagcacgttgacacattggtcaggctgggtgaagagatattcatgtttggggatgaggaccaatttacatactctaatacaaagcatgattcttccgagggctcacagccagcattgggagtggattttctgaacccccttaatgaaggatgcaaacatcagaattcaagtcaagttaattttatcaaataaaaacatgtttattctaaggacaaaggggcatcctgtggcagcaaagggaagttggacctcctaaaagacaaaaatcagaaagtttctggaaggtctgatttacatcattaatgtaggtgagacactatatagccacgggccaataaaggcaagataaggcttgatttacaaaaagccaagaatctttgaatttatgacatcatagtttatctcaaggaagctttaaacctgtgaatctgatatctaaaatagtataaagcagattgaggtgaattttaggagaaacatttttggaacttctcacagctccagaactgcattctttgaacttaaaggagttcttttgcttagagtttggtatgataaaaaatattttccatttctactagctgtttttatccttttggcattacaaaacaatttattttttatttattcttttacagttgctgaaatttagacagccgagtgagagatttctctctaacctaggagacaatttgatggttgtgttcatatagaagcatcttaactgaattctgaatcctgagggcatggaagattgaaaagtgccctggcagaagaaaatctagcaaaatttctattattcattggaaaagcagggaacaacaaatggaattcatgggtagatgcagcaccattgctaaactttcacaggataagccagcagaggtagacaatggattggaatttaaatcaacctctttagtccacagccacatggtgtgggtataaatgatgaatacaatggccaaggagaaagaatgggaaagacaagagtcatagctaggaagcattggttggagagtttaaagaaaaacttcgacagagtcactttctaactttataatgtttttatttcaagtggatatctttggttgtgaaacatatgtagtccccgaaactctatgcatcagaagaaataagtacagaaactgcaagagtttttgaatattgagaaaccataattcaaatattttgatttcacaaaatcaataatgtattctctcattttatttccttttatggaggcacatgtcctcttcaaatacacacacacacacacacacacacacacacacacacacacacatatatatatatataaagtcaagagacaatcttttataggtaaagttaatctaacagaagaaaacaatgaagtaaatcaggaaagaaaattagtgttcccttcttttcttttggaaggtagagcaatcaaaaagatggtcagggtttgaaacaatttgaaaacatactagaagtgaatcttctatgttgaattaattgaaaatatattggggactgaatctcataaaactggcaagtagagatgaaaatacatgcaatggagataattcatgtttattgcactcttgtgaccttataattattggttttctagtctatttaatattgatgtattcatcatgtgatttatagctaatattctccttctaagatggcaactcaatcttgatatattcagtgtattcgctcatcaccagattttgtatcctatcattcagaagccacattttccatgctcataaatgcttgtatgtggcaacatttgacatttgggaaaattgttattttaacattattttaaacatacagaagagttgcaaaaatgtaacacagaactcttgtaaacattttacatagattgacaaattgtttgcattttgccccatttactcactctcttttcttattctttctctctgtctctttctctctcctctcccttgaccatttgagagtaaattacatataatgatctttcattgttaaacatttcaatgtttaacattgaatgttctttagaaagaacaaagacattcccctgcataactacagtataatgatcaacatcaaaaaatttgatgttagaaaccctagccagagcaatcagggaagagaaagaagtaaaaggcacccaaaaaggaaaagaagaagtcaaattatctctcttcactgatgactctctaactagaaaaccctaaagactccaacgaaaggctcctggaaatgataaataactttagcaaagtttcaggatacaaaagcaacgtacaaaacttagtggcatttctctacaccaataatgttcatgttgagagcaaaatcaagtatggaatcccatgtacaatagccacgaagatgacaataatagacactgcagattactagagggtgggggataagcgttgaaaaactgttgggtactatgtaaaacaaagtctgcacatgtacccactgaataaaataaaagttgaaattatctttttaaatattgaccttgatacattcctattatctaatccatattctgtatttaaattttgtcaatttcctcaatattttgtatataaaatatacatacattccaatcataggtctaatctaagatcacacattgcttttagcttttctttaatatgaaacagttcctcagccaattatttcgtagactagtaccaaaaggtatatggtgaccaatatttacttttgatattccgttgattcctcactgagctggtggagcacagatattgtagaacatacagttataggatcaacctgaaaatgacaacaaaaagtcagtggtctgggtcctcagagaaatacttgagattggtaatatgttgatttagttttgctcttccactagggtctttggccaggaggtctgaaatttaattagattcaggtcaactctaaggttcctaggttctatgataaatatagccagaatagtaaatgttatgaaaaggaacataattgggcagtggaaacaattatgatttaggtttccatagatgcaaagctatgtaatgtcacacacttggattcttactctttgagagtaatttgtatcatcattcaggtactgtttcaccttagtccaagacagaaaattcaggtgactaaggtttcttgaccaagagcacagcagagactctggtccagggacaccagcctgaaaaccaaaccctggttagaaaggattgatagtgtccttgcattatgtttgctattacatttccactgttaaacaattgtacacattgatatggtttggatttgtgtccctgcctgtattagtctgttctcatgctgctaataaagacatacccaagactgggtaatttataaaggagagaggcttaattcactcacagttctgcatggctggggaggcctcacaatcatggcagaaggtgaaagaggagcaaagtcatgtcttacatggcagtaggcaagagagtgtgtgcaggggaaaccctctttataaaaccatcagatctcatgagacttattcactatcacgaaaactgcacaggaaagacctgacaccatgattcaacaccatgatttaattatctcccactgggtccctttcatgacacacggaaattatgagaacaataattcaagatgggatttgggtagggacacagccaaaccatatcactgcccagatctcaccagatatcatgtcaaattgtaatccctagtgttgaaggtgggccctgatgggaggtgattggattatgggggtggagtgttcatgaatggtttagcaccaactccttttggaactgtgtagtgaatgagctctcctgagatctggttgtttagaagtgtgtggcacctccctccttcctcctgctttagccgtgtgaagtgctggctcctcctttaccttctgccataattgtaagttcctgaggcctcccagaggcagaagccaccatgcttcctgtacagcctgcagaatcatgagccagttaaacctcttgtctttataaattacccagtattgggtatttctttatagcagtgtgagaacagactaatgcaacagtctatttcaaggattgagtttttccttagtgtatcagtccattttcacactgctataaagatattaccccaagactgggtaatttataaagaaaagagttttaattgactcacagttccacgtggctgggaaagcctcagaaaacttacaatcattggagaagatgaaggagaagcaggcacctctttacaaggcaacaggagagagaagcaagtgcaggagaaactgccacttataaaccatcagatcttgtgagaactccctcaatgtcacgagaacagtgtgagagaaaccacccccatgatccaatcacctcccaccatgtctctccctgacacatgaggattacaattcgggacgagatttgggtagggacaaagagctgaaccatatcacctaggtatcattttgttttcctcaaagactcctatggtatacaggattatgttaagattctgtaaatgaacccggagaatccagtaggcctcactgaaactctcctggtgcacaaatatgagatgacatgttacggtagctcatagaattggtagcccaaagagtggctatttcctctttgattgactcatgaaaatgaaaggacttcctcagacccaaagaatcccttggaggggtgaggaattcccaaggaagcccttcctcggtaagcacatcaatatcacaaacatttattggatgctgctgtagttgtttgattaatagaaaggccagtcccgcctagaattgggtgggtaaatgctagaatgacaggaataagacaggaaaagttatcaggggtcagtttatagagggttctgggggttgtagaagtagcttgaattttattataaattgaataagaatccattatagaaatataacacacatagtcttaatccatatctccactgaatattacctaaaatatttaccttaaaaaatagtgtccaagaaacagaggactaagtgaagagagagatgctgaaatgaggaaattgctaggttatgtgtgattcaattggaagatcaacataaaaattcatagcagaatatatcaattttggtagtatcagggacaaggtggctaaggagacaagatgattaaggatgaggtttcaatcttaaccttgatgaagggaagtgagatagcaactgtagttagacattcttgtctttctgtttcgctctgcaaatatttaacaaaaggaggtggcctctggaaagtgagaataatagagaagggaagtgcttggggaaatgatgaggggaatacatgggaatctgacactttcttcagtgatgattaggcaacaggagctgggtgccaagatgctggggagttgaatgtatgtccaaatatcaaggtggcagtgctggaagcatcagtgtcaaatgcaaccattctgctacggatttgcttagattttgtgttaggtttctattgcttccagaacctaacaaatcaccaccaaccaagcagctgaaaacaacactatttttttatctcacagttcttcaggtcagaagtccagatggacttggctgtgctccttgtgtagagtcttataaatctgaagtcaaggtgtcgtctgggctgggtcagagggggaggatctgcttctcttctcattcagaactaaaatccctgtttcttcagtggcttcagcctgggattattctcagcttcaagaggtgacctacactccttagctcataccccctttccatcttcaaagccagcaaggaaactgaatttctttgacttcctctccgcctttgtttttatattttatttatttactaagagatggagtcttgctatgttgcccaggctcgtctcaaattcctgggtttaagcaaccccaatgtgctgggattacaggtgtgaagcactgtgcttgccctgccttgacttttaagggcacctgtgattactttgaaactacctggaccatgcaggataatttccctatcttaaagtcaaatgattagtaatgttaattacatctgcaaattccctttttccacataaggtaatatgttcacagtcccagggattaaggaatggaaacttctcaggggtcacaattgtgcggactccagatttcaatcctagtgttgcccttccctagatgcattgttttaggcaagtttctgcaatcctccttctcagtgtccttgaatgggagatgaagaaaatgatggtaactacctcaaggggtgtttgaagagctaagcaacttcatacttgtccagcaaatagaatgatgtttggcaagtggttagagttctgtaactgtcagctattattttaaagggaaaacataaacggagccacgatcaaaagttagagatgactcactaatcagggaagaacagggattcaaggtcacagccagtagttagactgagtctaagtgggtaagaaaacagcaacaaattcctcctgcaggggagttgagtttagttgataagcaaggaagcaaatattatttcagacaaaggctactcttctgcgttcctccaaggaaaaagcaaaaccaggtctgatgaaggaggtgatggaaattcagcaactcctggctgcgggactgcacttagtatgcatactctagctagagtgaattgtcagtgtgagaaaaccaccagatggccacattctggaggactttccacggaagtagaatgcccagttatttctcagtttacaaggggcatccatagatcccactgatggaggttttctgagatctgctaaagagatcttagaaatgtgtttaatgttgtgcaccaaaccaggccattaaatcaccctgcctgaattttaactgagatttacctacatttcataattttgtctgcttgaattttcttctcttccccttttcaaaatatctgcttcattttgtcatggaagatctgcttcaaggatcttttaaaacttgtctagattcattgactgcccttaggacaaagagagtgaacaaattacctttattttcctttgatgtagtgtatcaaccatgcttgtttaaaaccaaaaaggaagagactgtggaaaaatgaggtcagcaaaggccacagagaagcatttcttaagtttcagagaggatttaaagttttctacactatgaaactattaaaaataaaataagacatttttatagatttttttctttatttctgtgactcccattagctgagaaaaagatattggttctgtgtacagagaataatgggagattaaacctcttcttgattcagctgcatgcaaagattgttgaattttagactgagaactttttgaaaaaggtaattgggaaaagttgagctttaaattgaaattttctttctatctatctatctatctatctatctatctatctatctatctatccatctacacacaatgtataatgtctctttttctctatatgtagagatacatataatgttaaaaattatgctatatatgttatacattgtaaaattgttatataacaatgcatatatataacataatacttttcactgtactataattcataagttatatatgtaatgtgcttaatatatataacatatacatgtatacagtgttttctatataatgtgtatgtatacaatactatatataatctacatttgttataacatatatacatttatagttatactcacacacagacacacacaaacacacacatatcacttggatatacttagtattatgaaaaggaataccttttccaacttttcactattagcccaaggtctaaatagataatctttaaaaccatttatataccatttatataaatgtgtaaactgtccaagaaatggactattaaataaatgaatttttctccatgtcacagtgacattctgagtcaccagcaaggagaagtactggaatcttccctgaagataaactaaatattcaaccttgttggtccacatgcagtatctttttacattttccacacacaatgctttacgtacatagaaaagtgttgacttcattctccctccaaatggcatcctatcattcactctctgatcatttcctctgtggagtgaaaggcctctgcaaacagccccgtgtcacccagggcaagctggggctaccaggcagggggacaggcaggtcacatgtcctatgcacagtccctcttttggggagaagaggagggggcactggtaccaggtacattattgtccagaaaagagacagctgctctgtgttatcctgtggacaacccggttgtctctctattgtaacttttataagtaaaaagaaattaagtgaatgtctgtaagtagtttctttaaaattatttctcatcggtaacagtaactatctccccatttacctgcaagagagctgatgtgtagccttgctatccaatgcaggcaaacattgtaattcatggtataatgcactaacctaaaagagttctattcattcatgttaaaattcaatatatagtgatcctaaagagatgagtgtaatctcaatccaagaagtataaaccttcatgcatccggctataaatattaaaatcaccttataatggagacatttaatgtgggccagcgggggagagaattaaagtgagaggaaaagatgaacagtgatactctctttcatataattattttcctcttcagacttaatttgatattatgcgctgttttcccataatgtgcaatagtattatttttccttttttatatcgttctgagctgatgtgaaaactctatcatctcttatgtccttttttgagccaaggaagtcaaaacattctacccctgaagtgtggtttcctcctcctccttctcctaattattttcctcctaggatttacttttcagtcttttgttccccagtctaaatccattctctctggaaacacatgtgaagtatgatctttttagtacagtgactatatcctcacccgctttgtgtttctagcctcactggactttatcaaggtaacctcatgcattcataaccacctgctgtcgtatgtgtaccctttaacctccagctgtaagataaacttaagtcccataattcctgtcacagaacactcaaaccatagggaacttatgaattacttgatgggaaatgtgggatgattcattcattcaacatgtatttattgaatgcctactatgtgacaacatctttctacgtgcaaggtattatacagcaacgtataaagaaacaaaaactcctgtcctcccagagctaatactgatgcgtttgaatctgaggatgactttactcacagagttatagataatgtagatcttaattacaaactactatttttttgttgaatactcgaatttttgctgtgacgtgaggtttgtaagcattcttcttttttttttttttttttttttttttttttgagacagagtcttgctctgtcgcccaggctggagtgcagtggcgcaatcttgactcactgcaagctccacctcccgggttcacgccattctcctgcctcagcctcccaagtagctgggattacaggcgccagccaccacgcccagctaatattttgtatttttagtagagacagggtttcactgtattagctagggtggtctcgatctcctgacctcgtgatccgcctgcctcgacctcccaaagtgtgtaagcattattctaccacacttggctttcatgttttacttctgcccttgggaatttgcttgtgattcagaacctgtgacttcttccgctttctttttcatctgccgttttcttagcctcacatttccatatctcctaggattagtaattatcttaaaataaattttgtgtaaaaaagaagcacggtttcattgtttcaaaatgggaattgtcagctccagaaatacctcaaatgtccatcaaggtctatcacattatgatttattagtcaggctggggacgggggtatgcaaggcacagataccttcacgggccagcttaatcaataaaaaacatgtgtcatcttatacatacatgtgcctgatggctccaccagagccatgtagattagagggaaggccttttcttagtgggaagaggatggggacctaaacaccacatggccctccttttcctctcatcccaagttagtgcataggcagagttcatagcagtaagctctggagtcagaatgccaacatcacatacctgttccaagtataataactccaccttcataagctactttttgtccacgtgtaagatctacacccaatagactctatggcattctgataccatgaggattaaaagcgacaatagctgttgatcaaatgatacaaaatgtcaattagacaggaggaatattaaggaacatggtaactactgttagtaatgatattgtatacttgaaaattgctaagagagtagattttaaatgttcttacctgcaaaaaataagtatgtgaagtaatgcatatgtcaattaggttaatctagcctttccacaatgtgtagctgtttcaaaacatgttgtacatcataaatgcatacaatttttatttgtcaatttaaaaaataattttttttagagaaagacacaatagatagaaactgagtagcacaggctctaaaatggagtgcctgttcagttaatgttaactcttattaatcaatgcatcattgatgatatgacatccttgagacatagactagctattaggatcactcttatgaggtatacattctttcagatactcactccaagttctgaattgtttataattactcatgagaaaatggagccagaggttacttgtcctggcaaagatgaagacagaggaagaatgtgggctttctgcttcccatggcacgaccctacttactagcccccaaatccgcctctcatgttatgtgtgatcttggttaaatgtctcctcccatgctggtcagtggactttttctctaaaaaaaaaaaacattatttagtaccttcaatcacaaaagctcatttctttgtttgtctgaaatatgcttactttagatttcaaggtaattttctatggccctcacagaccaaatcggtgtccacaacacttagcatcttattctgttttgcaaactgacagatgtatgtcaccagtaacaagataaaaaagggagtggaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggtgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaagggagtggaacatgactcttctggaagacccattcttgcccactccgaaccactacagatcccaaaatggtaacattcttctgatatctgtcatgatgggtgagttctggttgtttcaaatgtcctgggagaccggtggactctttttttctttttcaccctactgcagaattgataattatttttataacttccaggagggaaggaggtaaatgtggctgcaactgactcagttgacactcttatcacttaaaaatttccttacaaatgattattaactagatgatcagagcctattttatatcatggatttatggagattttgagatttctgcatcttctctttaaacaaaaatatgtgtatgtactgatcccaaaacacatttgaccccacgggataatgacctgttttctcaaggctgattagatctttggatgtttgatcttcctatttcattttgactcatattttacaattaattctttgacctactgaccttgggattggacttccaatttttttttcatcattctctcacttgttccttttctctctttctctacctcattttttcttggattttctattttaccagaccaactgtgcacaaaatatgagtaattattatttagctgcagaagattgaccgtgtctttatcaggaagccagagtgttatgtttaggcagattctgtttccactaatggggatacagtaaacatcacttcatttgcaagttcataccgtccttcacacgtaaggaataacatgatttgtcatattgagctttttctcacagttagagttcttagttttgtcaggaaactttgaaatagataaaaaggcacaaatttacaatataaggggaatttcctgttacatttaagaggaactataatgactgaaggaaattaatctttataaaggtgctttaaaactacatctaattttacataatatggctacttagtaagaacacctcaccaaaaaatagcaaaatacaggataaactgaaattatagtagtttcttagaagtgggactatttcaataagagaaacactctgttaactgttccttcacaggtaaagattctaaagtaatttcacctaggctatcaacacttgaaaatttactcaccagtgatttttcaacagtcaaaattggcttttctcaatttatagtgttagcagaaaaggcaataaacctcatctagcaaagaatagaactaatctactttgaaccaaaattagagcattatttgcatcaacaagtaacggttcaggagcttgcctgattctaaattcagctctgagcaacagctaagttggtgctcaaagcccactgaacagtaataacatgttgtatgctataaaatgttttacgctaaggtacacaccaaagctcatggtggaagaagattccaaccctattatcatgtctagtgatattaattactgtgcctctcataccttctaattgctcactaaaagacatacaagtcatcatagaattgcaaatgtgtacaacctgaattcttccattcttcattagaacctcgggcaccaagctttcttttgtttaatttttaactttcattttaagcccaggagtacataggaaggtttgttatacgtgaactcaagtcatgggggtttgctgtacagattatttcatcactcaggtattaagcccagtacccaatggttattttttctgctcctttccctcctcccaccctccaacctccagtagaccccagtgtactgtttccttttgagttcatgagttctcatcatttagctcccacttataagtgaaacatgtggtatttggttttcagttcctgtgttagtttgctaaggataatagcctccagctccatccatgtgcccgcaaaaaggcaagatctcgttcttttttcaaggctacatggtgtatatgtaccacattttctttatccagtctatcactgatgggcatttaggttgattccgtgtctttgctattgtgaatagtgctgcaatgaatgcacatatatatgtatttttatggtagaatgagttacattactctgggtatatacccagtaatgggattgctggttccatgtgatttcctgaacctatttcctcatctgtatacttagggtatagaattagagacatggttagcatagtggtggaaggtacaggaggaggtgaggctttagacctagacctttgttgatgtaaaaggacctgtgtggcctggatctgtgatgcccccccaccttaggctgagaaccctgtagtggatatctcaaatattgtcatcatcccgatgacaggcatgaagagcagatgcagaaagtcatagcaaaggccacctccatagaaagcaaagcagaacaaaacacaagcaaaagggttaagcacggtggcacacaactgtaatcccagcactttgggaggccgaggagggcagatcacttggagtcaggaattcaagtccagcctgaccaacatggtgaaaccacatctatactaaaaatacagaaggtcgctgggcacggtggcgcgtgcctgtaatctcagcttctcggaaggcagaggcaggaaaattgcttgaacctgggaggcagagattgcagtaagccaagatcacaccactgcactccagcctgggtgacaaagtgagaccctgtctcaaaaacaaacaaacaaaaaaccacacacacacaagcaaaaggagacacaggtatacctgcacaccctatggatttaaaactccatgtcaaactccaagtgtttatttccaccttcaactctgaattgaggaaaaaataacaaaataaacacttttctatagttaggtgctagcaccaatagactcatttgttacattttaggacctttttgagagtgaatctgatggtaggtggatggaattgatttaaatgttttaaggggtcccatgtatattcaaaaatctagttttataatttttgaaatctataatttcatgctgtgccaatagacagatcacttcttaatcagtgatattatttaacctttgatatttcacatccaacaatctttttaagccttaatgtttaaaggaggttttggaaaatatactgttacaaataaagttggttggtaacctggaatatttcactcagtgttcaaatgacattttgtgtcttaataaatccttctatggaaacaaatataagaatacaaaagagcattaaacctttcagaaactgttgcatggaaaaaataaaacacagcccccatatttttctgttaataaatacgtgacattaatatagtaatataacaaatagaatatattaaatgaggaaaatatatatttcacaaggtggttcacatgcattctcaagaaaaattcaaaacatttaagctttttacttaaaggaaaaaagaaaaacagagacttcaaagaaaagtgtaccctaaatcaaccatttacttattcaggtagagaagataatcacatattcttagactctatgtcaaaattcttaaagtcacttgtctcaataaaaataaattttattcaggtaggttcaatggaagtagctatttttgttgacaacctggtgtgtttgaggaatgttgcctaaactgttgctaagccttaccgccaccctgcaaagtgaattgtgcagcgcacatgatacagatgagaaaatggaagctcataggcaaaaggcatttgcaggaggtccagaaagcagctacctccccctcaggaccctgaccacatcacgagtgggtgtcacctgtggccacattaaccaatgccccatagcgggagaatatgatgttgggacgggaggttgtgaatatgcaccacaaagatccttgaaaggctatgtaaggactttcaaattttgataaactttgccaatcaatgtaaccaatgcacgaatataattaatatcccttcattatcacccccaaaggattctggaaacatagtaattcaactggcatttattcatccctttttctgttctctttgtggctattcatttgttcttcatctgatcaacacacacatatatattaaatactcagcaggagctaagtcttatctttcctctttcttcattgagctaaaacaaggatgagctttcaaaaagggagatttttctttaaaggctaacaacccattcccagctactgtggtggtttctcaccaactttagttaatactagtgcctgggttcttaaaacacacaaggcttggttcaggctattaggtcaattggctcctcttgagtgtgaaatataacttttggtcatttctatatggaacgaaataacgtgctgatttcatgtgccccgacacttccatctcatcttgtagttattttgaaattgttttcttggaacattgttttgagagttttgaggattctgagttcagtcagcaaaggtgaactttgaaagtcaaagcatgctacagcaaaccgaaaagggtggatttggtgagcggttggaatcacgtaagcacaaaggttttcctggccacattacagaccctatttgtcagttttacacaccttctttacctgtagcggtggagagatcctggcttgcaaaatcataaaggaatttatggactttatggagatttatttaaaaatgaggtggggtcgctgctaattcagaatgtatgaagagtgaacttgggtaaaaggcagtgcagttgctgggctggaagccagaactcagaatcattgtaattgtagatgaaacaataattatttgtgattgcttgctaatcagcgaaaccaaggaagagactgctgacaagtgctagctaggtaattaaggtgaagcactgtatttgcatacatttacactttgatcattgtttgcaagattctctctccaaaaatagtcttggcttctttgaagatacaggctaaatcaaagtagagggtaggagtaactgctgtacatcaataatgcttaaatttcccccaaccccatagacaattatctaaagactctcttaattttaagatcaggctcatcttctgtttttataatattatttaatataactaattaataattgttttttggcatcttcaatccatattgaagtttggaactttgcaaacacattcaatgtgcctgtcaagatgtgttgttattgttgatacaaaaagtcttgtattccctgtccacttgctgaatggcctgttctaacatttatgcagaatctggcattaccactttaaactaggagtcaaatagtttacattaagtgaacgcaataccaagtaaatgttttatgcacgattgagactctagttttactaaacttgacatgtggatttcaaatttagagtaaagcataatcgaataggaaccttgcacaggataccccatgtgaaaatatttgaatatgtggttcagactttctttttctagttgtatgatcttgcacaagatcatacatttgtctattccttagtttccttatttagaaaattaaagagttggcccccaaatatcccagtaccattgagatctcttccaatgcctatagccagcaataatcatggtaattgtatatattttgtattgtttatatgtgtattatatatattttgtattatatatgtgcatattatattttgtattttctatatgtccatatgtatacatgtatatatgtgtgtgtgtgtgtgtgtgtatgtataaaatcattctaaaattccattggtttggttaacaaattattggcagtttgtaatttcttaagaatctattttgttcttgtaaacaaatatttcattactaatcctaacaggtaatcatttttcaatagtggagctttgcaaatggactttagaggccaagtacaccaacagacaatggtaagaccatatatgacaacagaactctgtcctaccacccattcagcacccagttctgggatccaaactacaatctctgcaacagtcatccccagcaatcaagacttcatccatttctgccagctttcctatatttttcccctcttccaactcagaaccaaccagggaaagtgaaatatgctccccaaaccaatgacgtgagatgccccactttcggacagctcacctgaggttcccccatgccagcaaactccaaatgcggcacatccacagccttctccttttgttagcggtggaagagatccaagttaccttgagttgccagcggcgaatccgtgtgtgtctgcagcaacttcagcccttgcctcctcagaagaaagagtttgactgaggagcataaagcagaaaaagagaccaagccaagttctagagcaggagtggaagtttattaaaaaggctttagaacaggcaagaaaggaaagaacccttggaagagacccaagtggccgcctgtaggtcaaagagaaaagaggagaaactttagtcttgtacctggactttatagggtactctctttcccatgattctccccttagggtgggccttccacctgcagtgtcctccttacccttgggagatgagcatgcgcagtgtgtttagggaattgtatgcatgcccatctgaggatttcttccttcttccagtggagtatacctggaaggtcatacgtcaccatttttgtctcttaatgcgcatgcccaggaagttgcttcatcctggggcctgcctttagttaacactttaatgttaagaggtgtggaccagcagcaactagcctcttcctagtgctggcaatttatcccttttagagaggcaatgccataattgctgaaccatcacctgatatttccagtgggggtggcggggagagtcagctcatgcctgactacctgtaacactttaaagtattctcactccccactggcctttgagtctctgccaaatgcaagcgatagtgccggactcccttgctagagcaagctctgactaaaaagtctctgctctcattttggaaagaagggggaagtctttatttagttccacaaacttaagatggtttttgatacagatggatagagtaggtacaggctgaacgcctcactataattattattgacacgggctaattttcatattgcactatagctttttctatttggggggaatagggaataatcatggttaacttctcaaagaataaaagagtaatgtttgctgtttgtttttttaattaaaaattcagcaccactttcccagaaaaccctgtcttgtcccttgttgttgttgtttttctgtggtatacctcaagagttgtagcagaaactgtagtcagcaaggcaaacagtgagcacgggtgtagaactcagggagttgaggaagaagtaggaagtgaatagtcagtcattttaacaaccattcaggaagtgaacagtcagccattgtaagagttgattttgtatagaaacaaactctgagtatgtatctaatacctccccagaggaaattttagcaattggaaggcaatttatcagatggttttggggaaagatgagattcagggaaagtatatacagctgaataggagcttttctttgtgcaatttgctacatctcagtgctgcccacagatgatgaaggtgtttagcttcaggagttctttgtgtggggttattttgtctgggttttttacgctgttgcatcatgagatcccaggcatccacctctgaaggacttctcccttataatgtgctgtcttacctgtgggcatttgtaagaaaacgaatacaagatgaagcactctagttagacatgtgtgatgtctctcaccatccaggtttctgtgagaaactaatgaaggccctttggtgctgtctgttctaagagacaacccttggtctctccaggaatttcactgaaacaggacgtgggtgctttgaagaagccaggaattgtacagtttaatgctaaggcaatttaagcaaaagagactcaagaacaagttgtgaatttgatcccttggaaaggaaaagacagacaatgtttctgaaaatataagcttttgaacataaaatagagaaattgcacgaaagcaatcttctatgtttgatggtaatttccatttctgtttcaaccgctccttcagataaaattacagtggagcttgcctttctatttaaccagtctctggatacaaagtcacctgaaatcttcaggtattgacagcctttgaaatatcgcttacagaaaaggcacctctaaaacatgtatcttgtgtttctttgtaaaaagaaatgccagtaggccattaggtcagtatctacctggctagccatcctaccatttgacattaaggttgatcagaaagaaagggcattgctcaaccgctcttacaaaagtccattgagatatttttagtaaacaaaaatttggtaaacaaggataggaagttaggatatttacccactgattcccatctcctgttggtttgaaggtggttctcagggttttaacttcctaacatgaaagtcttttttttttttttttttaaagattcagggggtacgtttggaggtttgttacatgggtatattgcctaatgctggcttctattgaacccatcatccaaatagtgatcatactacccaatatgtagtttctttttacctcctttcctctctcactctctctttataaaagtcttcagtatctattgtttccatcatttatgtccatgagtacccttcgtttagctcatgcttgtaagtgagaacatgtggtatttgactttctgtttctgcattaattcacttaggacaatagcctccagcactatgcatgttgctgcaaagggcatgatctcattcttttttatggctgtgtagtattccatggtgtatatgtaccatattttctttattcaatccaccattgatgggtgcctaggttgattctacgactttgctattgtagataatgtaaagcaatgaaacctatggcatattggcattcttggcctgcacttctatgagctgaattggaatgaagccatggaacaggacagagattgtcaaaggcggggcagaggtagtgttcctggagctgttcacttcaacagtgctgaaatcagaggcaaacagagggtgccaggagggtccctgtgtgagacaggtctcatgctcttctatgagataaacatattatggcttggagaaacatagacgaaagagtaataaggtaaaatatattcatagagaagttagttagctgtttttttcccacaattagaatgaatgaaaggaaaaatcaaaatctaagtttagaatagtgatctggaatgagcctgggtttcaaagtcataaagatcagactttgtagtcaaaggaagcttaaaataaagaacaagcatcatactcatcatcaaaatgagaattagctctgtcaatgacactcttgtgctctgtgaaatttgacattcaaagcaggagaatgaaaggaaatgatggcaaagatggaacaaggctgtggcatttgtcagagggagaaagaacctggtttggtggaagttcggtggaatcagattataaagagtatgaagagttaaaaaagaggcctaaatgagaaacttgaaatcaataagttttaaagctcaaatgtgaagtgaatttattttgactgggttagattagtttataagtgactttgaaaaaaagtgctggattttagttattcactaataaaaaatgcatgaaccctgccgacttccttgatgaaaggcattttctactaagtcagccctttggtcattcgcagaataacaatatatagacgcactagccagtatatttgtctagtatacttgctgtacagtgaacatcttgatattctattgagtgaccatcctattaaaattgccattaacaagtgtatggcacgagagagaaacacaagcagctttacaccagagttacaaaatcatttgttattgtctatctagtggaattatatactgaccactgtatataattctgaagcatttccaccaaagtactaaatgcatttccaccaaaaagatagaaatagatgcaatacaatgaaacccacatcagtggaacagacctgaagaaaaaccagctgttgaggtagtggtcattgctatggaataaaatgccttttattccatattagtgttttacatgttagtgtagtgggttaaaaatatttgtttggggagtcaggaggaaaaagtgggaagggggtgagggataaaagactgtaaatcggattcagtgtatattgctcaggtgatgggtgaaccaaaatctcacaaatcaacaccaaagaacttattcgtgtaaccaactactatctgttccccaaaaacctatggaaatatatataatatatatgtttatatataatatatatatataagagctgtaatctgagagccacaaaaatagaatgtaacatatttatgacatagtaacagtaattccatgtaaaaggcagattaagattaattaagattaatgtatatatttgtgtacatatttatatacacatatacatataaatatatatatatttgtttgtcagtttactcaaccatagcttaatctgccttttacatggaattactgtgttactatgtcataaatttgctacattctatttttgtggctctcagattacagctctgcgcgttttatacttgttttcttagcaaatacaatacttagcttattttgttgttagtatttattgacatatcctatccccaagtaacacacagcattaaatacgaaagtgtacctttctgtttctcgggaacatgccacacattaattagcagctggacttgtctgagggtcacttaagtgtcacatcaccaccaactgtcaatactgtcttctgtattgatttccactggatggcatattttctgcagtgcagggatcttggcttttaatttgcactccttttttcattcagttcccaatttacagagtgtcaataaggtgttagcaacttcaacatagcttgtcagggctctttcagcattttaggcgtatctccattgtagcatgacactattttatgattattcatctctgcagctgtctgtctgttagcctgtgaactcttatggtatttattcttgtatctttgtcttcccatctaacttccccaaaatctgcatatacagatccatacatcatactgactgtatttctggactagtagaagaccctacttgtcaaatgactcaaataatggcaccccatcatttctcaagctgtttgtgatctgatataacagaagtaggcaatcatgtgtctgattaggtatgtaaatatgacttacctcttgcttagtctggagaggctatggaaaagaggtcaggaaaaaagagccatctgtaagaggattccttagctggaagatgaatgcattgccattgtgtttataggatgtatctttttgtatctttcatctcaaatatcctgtcactcccatgggaatacttcttgtttttaagaaaaaaattccaaacatctttgattcatcaagctaataccctgtggacctcagatagtgtatccttatagacttcatggaatggcacacaccttcccctgaaagtcagagctaaaaattagccagtatctgcactttgccccaagccattaagcctacacccaatttctgcaagggaggatggagccttacttggacatgccatttcctgatctctgtagcacctcttattgatatttcatactcaacccttgattccatctagccttttttctttccactggttcctgctaatgcaagccttgacttttcattcctattatgcattcttcaatagtgggctgtgtcatggattgagagcgcctggcggagccctggatacatggcagtttttcaataagcagttgtcggcgggcagccctgagagtgtgaattatgagtactagcaaaaggcaaggttcatttgcataattataagctgaagaacggcagaggaaatgaggtactgaactgctttggaattgttctggctgctccagtatagttcacattaacaaattttattgttaaaatttaaatattccaaaatgtaaatattccaagtggaaatttctggaagagaagtgatatgtgttgttgtggaaggggttacaataacatcccaacacaccccagccagtctgcaacatcccagcaaatgcaattaaagagtgctaggaaaacgttctaggtacatccagctttggattaaacatgtctgataccattatactgaggttcttaacttagataaaaaagctccttgtggataaactttttagcgggtatgtgaaactcaaggcttcacatacatacatacataaaattatgtatgtgcatctgtgtatttaaaggagttacacacgttatcaaattcttgaagggaggtgtttcgagacaatacagaggaaaggatgcactgtttttccagagacctgtttattctctgggctgattccagaagtaaaaataaaacccaaaaacaaaaaacgctacacagtttgatcagaacactaagattctcacccaagcagctttgatgtccaaagtgtgtttagaatccagcttatcgattcaatagttctagtaagtttaatatacatagcaacactcaagactggaaaggttccttggggtctttacataggctgtctacccagtcttgcttccatgagaaagtagcaaacggtcttttcagcattctttgtcactagcaaaaatccctggattatccaagttgtcaactggctgtgctgacctgtcagttcacaaaagggtgattataggaggtattagtcaaagctttgctttttctcttttctgaacttcttctccctgggctatacccttttcctttcgaattcctcttcagaactccattctacagagaagctgctcttggaactgtgaggctccctgaagacatccagtgatggattggcaagaacacggaaccctgcctgactttattctgctctttcctgtgcctaatttaattcaatttcactgggcaagcagttttttactccctaacaccttttatatatcaatcattctgttacaaatcatgaccatataattcataagagcttagcattgttcattttggagactggaaggcgattatgcattgcaattatcatagtgcattttgcaaatacaggtgcttcatgcattgcaggataccaggcataaaacaagatcaatttccaaacatcagacaaggacctttaaaactttgtcaaatgcaagagcaattatgtggtaataacaggaaaaacaaaacaaaaacaaaaacacaccttatatagtccaaagtcttcaagggaaacaaacacttctgacactaaattgggggttttatagtgtggttcacagaccccggggagtctctgaacactttcaggggttaagccaaaactattttgataataatgctgagataatatttttctttttcctactgggtttcttttgtactgacagtgccaaacagtgcagagttaagctgccggtaccttagcacaaatcaattcagggatactaaactgtgctagttgtcacagtatggttccctgctatgcactagtagtttataaaaagccagtatcactgaagaatgtccctgatgaagcacaaaataatcttaactgtcttcaaccttaatcctagggtaaacatagattcaatatttggtatgacaagataaaaactgtgagttctccagataccaaagtgtcatttcgtgtatgtgtgaaggaaagcacttgtgcagatgtgggaagtgtgtgctaaatttgccactttttagaggatgcacaattttcatttgaaataatgacttccagataaactattgtcctttggacttgaggatttggttgatattttcttgaaagtgaccaaagtgaggtcactttggtctctttcagtatattccaagtatgtattccaacgataaattcctgacagtaattgtcaatgataatgttcaacagctttccaatacttaaagacttttctgagaagatgaatggtgatattgaccagcaagatatttttaatactacataataaaatgtgtgagtatttggaagatctaaataaacttactgaaacaatattttttaaatgaagaatgcattgtgatacaaaatgatgcatggctaaaagacccattttaaaatatgtatttttttttaggctggtcaagtgaagccaagagacccatttgaagtactcatttaaatccatatatccatggattttaatacaacagtgtgattatgaacactgaagacagattccaaatttcaactaatctttaaaaatcttctctttctagattttgggtatagagtcaaagaatgtccacaatcatctgaaaggttgtttaaagcctcttctcttttccaaatacatatctgcacaagactggattttgttcatagactccaaccaaaacaacatatgacaaaagattgcttgcaggagcaggtattagaatcccaccatttctattaagagatttgcaagagtgtaaaccaatagcacccttctcactttttcactttgctttgcaaactacaaatgtgttatttacgttatgacatagcattactcagtccatattacagaaatgtctcagtttcaatttccaaggtggtaaataacaataaatatatgctctgggtatccttcaaagctccttggggtccttgacaatctttagggatataaaggcgttctgagactaaaactttcaagctttaaaataataatcctgaaacagagtccatcattaaaatcaatggagcagttttctaggtgtgtaatctttggctccagcttttgaaaattctaattctggggtgtgattcaagccaagtgtcactaaccttgccagggtgaatgtactcactgtggtatttagaggcatgattcgtgggataagctttgaaaataaaatagaaatttcatactgtaccatgctttttgaaaatcttaaagaatatgctaatttatgctttctacgctactggtttttagatttcctaatataagtggacatggctattgttcgggaaactataaatgatcttttgttgctgttctttcatgggacttcgttgctactttatgtttttaacaggcgggtggatcagtctcttgtataatggcacatgtgggcttagagtcattttacttatatccaatgcttagaatatgaaatgcttttttttttctttttgtccgtacttggtttattcggtcaggcataaaacacaaatgttgtttaccaaactagttataactaaacaagaacagcttgttaagtgctgtctatccaattaaagaaaacagagtacattttaaaatacataatttctttataattcttatgttattcatcttcttgtgtgaaactaaataaactgaggaatgaagatgaacattttgtttcataatctagaaaaatgacttaaagaataattaatagtggtaaggagaggaggtaaaatgattgggttgaattcacaaaagaaaggatttatcataaatgccttggagaaacagaaatgaattctggaaaagaattcaccaagattcaatttgattgaaaaaacctttgcacacctgcagtgtattctaccacaagactatgactgagagatgcatagaatatagttggggtttttttcaagaatttcaaatctagaacaaggattagaaagttggaaaccattgcacataatttgaaatattctagaagtgtttccaaaacatgactagggaagcattgcactatggaaatcatgagaaagggtgttagacaagattaagcagcagcaaaaaatgaaaaaagaggtaggatttagggtaataaatgccatagggtaaacttgatacgaatggaaatgtatgagagaaggagttacatcatcttagcagtgattgcgggggaccacgaggtttgtaaggaagagggaaagtgcgtaaaattattctacgattttcaggagagacaacaactggccatctttgagatgactctgtaggggtggaaacagaagcagagatacttgagtcttagagtagattttgagggtatcccacattgcaagctttgatatcaggattcacagaggctcctgaatctacttttagatttcatgcaatttagaccaatctccaattaccagcctgcagagcactttatgtcagcctgcttttccttaacaggaaatgcaattcctgtggcatgttcttggcctgacagttattggtgggtgtgaaagacccctgaaatcttcctaaagaagatgggtcacctttcctgggaagccatttccatggtcacttgtggcattttattgtggaagagtatttctttcaacacccacagagtgtggaatgttgacaagacttacgaaaacaatttgcatccagttttgacctggaggaacttcatggaatatggttagttatgatgaggttgcctaccaagtccagaaaaaccatctacccttgccagatgaactggtcaacttcagattcagagccagggtttctattggtgctgtcattctagaaggttattatagctaaacttgcttcacgttttggtgggtaggctctgccagtgaagaagactcaaaggtgatttttatggctcacaatctcaaggattttataggatcctgccattttatttagatgcgggattccagaccaggctctgcagcaaagacacatgggattctttttgtttatggtgtgctggattttattgggttggtgcaaaagtaattgcagttttggccattaaaagcaatggtcattaaaagcaattacatttgcaccaacctatactcatcgatttatatttatgttgtcattcttggaacagaaaacatactttatgaaaataatggatggcctttctctaattgattgtaagaaatatctccttgactcttgggtttggtatacattcttctataataacaaatggtataattgtttggaaaataaaaactttatcattgaaaaagcagaacaatacaaaataaaacacacacacacacacacacacacacacacacacactccaaactgaagtatcatatacttcacaaaatgtttacaaagtcatgctaatgcagatactcctttaattcaaggttcttttaaaaacttaagacaaggattataaaataatgttaagtgcccagggtggcaacatatttgattatccaggggaaatgaatgatttcctaggaacatgtaaacttccaaaattaatctacacaatatagaaaatcttagtaagtttaaaaaatctgtcgttaaaaatggcagttgatgggtttatggatgggtttatgtctgatttacatgtatccctttgattaataattcagtgcagtgtgtagcagtatttctttttttttttaattatactttaagttttagggtacatgtgcacaatgtacaggttagttacatatgtatacatgtgccatgctggtgtgctgcacccattaactcgtcatttagcattaggtatatctcctaatgctatccctcccccacttcccccaccccacaacagtccccagagtgcgatgttccccttcctgtgtccatgtgttgtcattgttcaattcccatctatgagtgagaacatgcggtgtttggttttttgtccttgcgatagtttactgagaatgatgatttccaatttcatccatatccctacaaaggacatgaactcatcattttttatggctgcatagtattccatggtgtatatgtgccacattttcttaatccagtctatcactgttggacatttgggttggttccaagtctttgctattgtgaatagtgccacaataaacatacttgtgcatgtgtctttatagcagcatgatttataatcctttgggtatatacccagtaatgggatggctgggtcaaatagtatttctagttctagatccctgaggaatcgccacaccgacttccacaatggttgaactagtttacagtcccaccaacagtgtaaaagtgttcctatttctccacatcctctccagcacctgttgtttcctgactttttaatgattgccattctaactgatgtgagatggtatctcattgtggttttgatttgcatttctctgatggccattgatgatgagcatttttttcacgtgtcttttggctgcataaatgtcttcttttgagaagtgtctgttcatatccttcacccactttttgatggggttgtttgtttttttcttgtaaatttgtttgagttcattatagattctggatattagccctttgtcagatgagtaggttgcgaaaattttctcccattttgtggagaactacaaaccactactcaatgaaataaaagaggatacaaacaaatggaagaacattccatgctcatgggtaggaagaatcaatatcatgaaaatggccatactgcccaaggtaattgatagattcaatgccatccccatcaagctaccaatgactttcttcacagaattggaaaaatctactttaaagttcatatggaaccaaaaaagagcccacatcgccaagtcaatcctaagccaaaagaacaaagctggaggcatcacgctacctgacttcaaactatactacaaggctacagtaaccaaaacagcatggtactggtaccaaaacagagatatagatcaatggaacagaacagagccctcagaaataacgctgtatatctacaactatctgatctttgacaaacctgagaataacaagcaatggggaaaggattccctatttagtaaatggtgctgggaaagctggctagccatatgtagaaagctgaaactggatcctttccttacaccttatacaaaaattaattcaagatggattaaagacttaaatgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagcgaacaggcaacctacaaaatgggtgtaccagtatttctaaatgtgctacagagtgctggtcaaccaaaagtatcagcctcaactgggagctagttagaaatcatagcctcaggacccgcatggagataactgagttgaaacacagcactggggatgggagcagaaatctgtaatttaaaaagctttctaggtgccttgtgcatgcttaagtttgagaagcactggtttaaaatattctagacaatagaaaatacgtaaactatccaaattcattttatacatgagtataacattgatgaaaaatcagatggtaagattaaaagaaaataaataaattattttttattatgaacacaaatgaaaaattctgaataaaatgttggcagacattacgcaagtctagctccaaagaataatatattataatcaagtaaaatttattccataaatgataaagggctcaacatcagcaattacatcagcataattgataacaaaaattgaaagagaaaaaacacataactaccaatgggtgccagaaaggtgtttggtagataaaacagcccttacaaataaaaaatctaagtgaaatagatatagaaagaagctgcttaaatatgataaatattatttaccgataataatcatcagtctaacggcaacattctggaaaatttgttttacagttaagtacagaaatgagatattagttgtcatcactattatcaattttttggtttactttagatgataaaacacaaaagaaggagataaaatttatggcaagattagaatgtgaggcaaaattatttatatttgcagagtatttttggaaactgataaaaactaactagaattaagtaaaccttgtcaggttgaattagaaacatcaacacaagttaaacacacaagtcaatagtttttaccccatggtgataatcatctctttaaggaattaaaaaaaaactcataataatgttgaaaataattaattcatggagagtattctaataaaaaagatttagaatttatatgcagaaatctggacaatcttattaagtacaaaatacaaaacctgaacatatgtagagatagttcattgtcctggatctgaatatttaattttataaatacataaatatgtaaactagatgcattccaataaaaatcccagtgagtgaggagaaggagaggaaattgattacatattcttaacgttccaataagaatcttagttagcttaccttaagagcgaaaggtcttgtgaaaaataatggtgtttgtaccatgatgtctacgagtgtgtgcctctgtgcatgtgtgcatgtgcataattcagcagaaatgaacacttaccatgaagtccctgctatttaaagcagataatattggtgaagaaatggataaatatattaattaacctgaagagattactgatatatgtatgtgcttatacatacatatatatacttattaaataaataacatatatattaaatacatatgtaatcaaggtaacagtataattcagtggaaacaaactgatatgattgatttcattgataagtagctctatcacggaaaaaattctttatacctgcattgttacaggcaataacatttacaagcaaattacacatgggtttgatgattaatgaaaatatatatactattagaagaaaattgaacacatgaaattgttgatcctggagtcacctttttatcttcccttttgttgtgtaaactaattttcagtcatttttcttatatttctagtcattttatttcgggccttttgttgttagtggaaggcatttttattgttacattggacaagaaaagatgtctactaagcctccaacaccacagaatttcaaggcctcaattttgtagtcaagaagctgtaaattatattttgagaagttataaatgcaagttattcacatgtaattacttacatatacatttaaggataaaaaggagagacaacactttaatgtcagttgatgcacaaaaaacacagtataaagaatatttaatttttcttactctctgaaaaggtctaggccatgtgatttgtgcctgtcgcacgaaatagtacaaaatgtaaaagtcatgggggatagatgctaataaaaggatttatagtcagtgcaaagaaaaaaaaagcagcaggaaacacaatttgcaactttacataatgaagaaaagtgtttgaatacctacataaaatgcagagataatagatttgctggcaggagaagggaacatgagtaaaagaaaaagaaattaaaaggaaaaataaaactggattgctgacaggtaaattgatggccttaagttaacggctctcagtagttcagcaatattcactgagtatccacaaagggttgggccatgacttgagctctgtgttgagatggaagaaaattgaagcgtcaccagttatatagatgtatatattgagtaaaggagaagagtagaagtttaagatgaagaattcaattctagaagaatattataattgtagaattgatttatacatagtaaattttagcacttttgatccacatttgcaacagaaagagaaacataatgaaggaattaggaacactctacttctcctcaagaaagattaacagctaagggaattgctataacactgtaaacaattagctggaaatatatgaaactatggttttcagactatggacaagaggaaacatgacggtgatctttgagatgaagaacaccaaaggtcagcactcacatggccccggcttattgcctagggtactttctacgcttcaacgcaaggaggagaaagctaaatagctggtgattttgctgaactgatgacacagagacccaagttaaaactgttaggaggctgaggttgctgagatttgcaaggcacagtggtggaggggaaggataactacaaagaaatagcccctgggatctacagagcagtctctagccaccctctctgttcagatctctacaatattgtagagaaccaacagaagtaagtccactgaatgagtccctgaattcccaccggaatgaaaacagtttttgttcacaccagccagagtgcagagatctcataatacacaggagtcatcaacagcttcaagacaaagacagagaaaatactcaccaaataaattgtggataaaagactgagaactatgatctatgagcaagttttacagctcagtaatgaaaagacaaattattgcattaaaaaggcaaaaaaattaaacaactctcataaaaacataaataaatggccaatatgcacatggaaaataactcagcttccttggtcatcaggtatatgcaccaagattccactagacacccaacatcccaacattaaaattgaaaagactgacaatgtcaatgttcacgatgacatgaagcaaaaggagttttttttggtacttttctttagcagagttgggggtttcaccatgttggccaggctagtctcaaactcctgacctcaggtgatctgcctgcctcagcctcccaaagtcctgggattacaggagtgagccaccgtgcccacatgcaaaaggaacttttatatacatttagtgagtgtagaatggtacaatgacttgggaaaactgctggaaattacacaaacttctagatatgacccaagacctagccattccactcctatttacccaagataaatgaaatcttatgtccaaaaagactagtacaagaaaattaaaagtagctttatttataataggtttaaaaatggaactggcccaggtatctatgaacaggagaaagggaaaacaaactttgctattttaatacacttggcaatgaagggacacaaactgttgatacataggatatggattattttattaaaaatatgctgaatgaataaaggcttgaccaatgaccatccactataggattccatctttatgagtgtctagaacaggcaaaacaatacctgttggaaaaatatcaggtcagcatagtgcttgctggggcagttgtggatgttactgaaaactgacacaggaaactctctggtgaagcctgtgctctctactttggtaggagtttggtttacatggtgtgcttttgtctctttattaaatgcatgcttaatatttatgtatctctatcagaaactgtgtcccctggagtgagaccatcactgtctgccatcatgtagctgtttcctttggagccactcagtcattgactgctttccctggaatgaggggaatacccagtcattggtcatcaattgtttctgctggaccaactctgtcctgggctctgttccctccactgactcagtgattgactgttatccttggagtgactcaagtgtcggctgtcttcccaggtctgaggcaatcacttcctgtcatcctcttaacaactgttttccttagagtgacacagtcattcactgtttctcctggatatctccctgtcatttcatcatcaattttttctctagattgactcagttcaccatcaactgtgtcccctggagtgacttggtggtcaattattttccctgaattgatttggtcatcgattcttttgcctggactgactctgtcatcgactgttgtccctggaatgatttggtactcaactgctttccctggactgattggtcatcaactcttttccccggatttactcggtcattgactgtgttccctggactgacttggtactcaactgatttcccctggattaattcagtcattaactctttttcctagtttgactgggtactcaactcatttccctggaatgatttggtacccaactcatttccctgattcgactcggtactcaactggtttccctggaatgacttggtactcagctggtttccctggattgacaccatattcaacttgtttccctggattaacttggtattcaactcatttccctggactgactctaccctgaaatgatttgtgccctggactgtctggtattcaactcttttccctggattgactcagtcatttgccctcatttcctgttttacttggaacaactcagtcattcactattttccacactgagggcatctccatgacttcctatcatcaatgctttccctggactaagtcagtcatagactctaatctctggaatgactcatgatcactattttccaatctctggaatgacttatgatcactattttttctggtgtggcttggtaactgtcttttttaaatgaactgaagagatcatgccctgccacctcatcaactatttatttcccttgttgtgactttgtcagaggctgtgttccctgggctgaggtcatctcctcttctttttgtcatcagtattttccctggagtgactcggtcatctcttcttttccctgaactgttgtgtaatcacgtcttttccctggaatccctagatcatcaactattttccctggacagactcggttattgattatgttccctggagtgactcagtcattgattgcttttcctggactgatctcttcatcacctcagtcgtcttagaagggagattgctggtaataaaagtatatttttattttcataaatatgtacacaaatacatgaacatatctttatacacatgtgtatccaagcctccttcaggaagtttcagcccatctgagaatgcataacaatgccttccaaagttcatgtgtggcaaaacttttaatttttccccccagtatgataggggaggaatggtgtctgtgtttcctgttgtgctcattttacaatcagtttacttggacttcttcttcatgaatgtttttaatgttttttccttccattttcaattttttaaaaaaatgtgttaacgttagcccctttatgaggcaacttatacaattctgtgctgggaacacttcctgagaaatgcatccttggctgatttggcccttgtacaatcatcctagagtgcatgtacccaaacccggatggcacaggtaactgcatacctgggctgtatagtgtagcctgctacactcctgtgcaacctgcgactgcactgaatactctaggcaactgtaacacatgttacatgtgatatttgtgcacctaaacgtatccaaacctaggtaaggtaggctacatatacggtattataatctcatgggaccactgtcaaatatgtggtctgtcattgactgaaatattcttatatggtacatctctatatttctcatgactttttaattgcactgtttgcccagcaaattttttaaaaaattatatattcaaattttgtatatttgattgcatttggattttgagtggtacttagaaacctttctccacactgagattatagaagaattaattcacttttcttctagtacttacatggctgtatgtatgttattgtgcatacccctaagcatgtgtatgtgcatgtatgtttagatacatgattcatgtggagtttattcctgtgtataaataaactgtggatctaaatatatcattttccaggtggtcccaccaacatttacttaaaaatccattatttcagacactggggtgcgcacctgtagtcccagctacttaggaggctgaggcagcggaatggcttgagctcaggagttcaagacccatctaagaaacatattgagaccctgtctctaaattaaaaataaacatgataaagtagccaggcgtggtagtgcatgcctatagtcccagatactctggaggctgagtcaggaggattgcttgagcctggagaccaaggctgcagtgagccatgatcgagccactgcactccagcctgggcaacagagtgagacccttctttaaaaaatccattattgcccagtggtttgagatgggcaataatggattgaaataataataattgagataccaccttaattgtatactaaacttccttctgtacctctacctgtttctagatgttctcttatattcctctagtctttttgtcttctcatgcacctgtaacatattattttcattatagatgcttaataatgtgtttaaaatctgaaagggcttgaccctactaagggtttttctggctattcttgcctgctggttattccacatgaacttccatgtcaactactgcataagacaatttgtaattttcaaaaattttgataacattacttttataaattcacccacttagaatttacctctttacatttttgagccatcctattcaaagatgattttccttttgttcctactacttttatttctttcaggagattttaaaggtttttaaaaattatatagagtttgcacagttcttactatgtttattcttaagtagtatgtcatcttctttggtgtaattgtacatggacttcatgctaaataactctataattttttattttagggttatattaaggacttacatatgctacttttattgctaattttactgaattatattattttgtgaattaatttgaacattaattctttaaagctttccagatatcatctgaaaaataataggaattaatttgtttctagtccctatgcctctaattggtttattttatttccttgtttagaaaacaccttcagcataatgttgaatagcagtggagatattttacattctggcttgcatttctagcatgaatcccacttggtcatggcattttttgcaaagtgatattggattctgtttgacaatattttatttagtacttaagcatcagtattcataactaatattggtctggaatattctctcattattcacctgcatacatattaagttagcatttaaatttttatattatgaatttaaatgtctgaaaacaacataattttcagttgtgtataactttgacatattaaaataaaattcttacattgttcttacaaatgtatccaactgtattttcatatcatagtgactagaattttaacctcaatgtaatagattttttgaaaacatattgattataataatgtcctttcctatattcacataagtatagaaattgaaaatttaccttttttgattcctaaaatagtagtgactcatatgttaacattttattctgagctttcattgtatttttattaattatgatttatcaaaacaaaaatatgtgtcacatctctataagtaataaatatgtcttgaaacataatattttatgggggataattaagagcaaaaaatagcaagaaactgtatataaatctttaaacatccaattgagcaccaattatttggatgactacaggactcagtggtactctcctagccagccacagacccagagcttccaccattgttatttaatctggagtaaaccgctacccactgatggcaaatcaccatcaggagtgggaaggttatagaacctttttctaaaacatgtctcattaggaactcacacttacctgggacattatttaaactctgaagaacatgcttatcccacagacattccgttcatatgagatttttagaacacagttgcattatagaggggttttattgactcaggaataattatacatataattattatataaataaagtacactttacaaatacaaaggtgtagcttactagaatggaatgtaaataatggacaaatatatactagatgattattaaagtaaatatatctactgcaaatgtattactatcagagaaaagagccttcaaggcaaatctcactaatagggacagagaagggcactacataccacattcaaaaaagacattttattcatcaggaaaatataaaaatattattatcttgtatgtaaataaaaatgttgcaaaaacaagtaaatcagaagaacaagaaggtattttaaaaattcacattaccttttttttttttttttttttgagatggagtctcgctctgtcaccaggctggagtgcagtggtgtgatcttgactcactgcaacttctgcctcccaggttcaagcgattctcctgcctcagcctcccaagcagctgggactacaggcacgcaccaccacccccagctaatttttgtatttttagtagagacggggatttcatcatgttggccaggatggtctcaatctcttgacctcatggtcctcccgcctcagcctcccaaagtgctgggattacaggcatgagctaccacgcccagccaacattaccttttttaataactcctaggacatggagtaaaaagtaaaattatacaatacaagagggaacgaggcaatataaacaaagttttgttatactcttgaaaataaaaaggttctcctttaaaaacattgtatcctggtaggatgcactgaagacacaacatcacatgcataacttcaaactaattatgagaaatcttaagacaaacccaaactgagagacagtctacaaaatacctgaccaatactcaccaaaagtattaagggcataaaagacaaggaaataaattagagtagaataaggacacacaaattgcaggagaataaacatatacaaaaacaaaatgcagtgtgagattctggattggatcctagaaattaaaaagatattaggggaacactggtgtaatgttaaggtctgtggtttaattaatagttagtgttcattgtcaaaataggacaccattgttagtgtcctgattttgacaatgatactatagttatatgttgtaaatattagggaaaattgaatgaagattatatatgaactttctgtaagttcgaactttttcaaaataaaatatttaaaagagatattgatgattttaacacaaaatgaacatatttgctatggtaaatctcaacacattgaaacaacaaaaatcaagcagataacattctctgaacacaataaaataaaatttgaactcaagtgacaatataattaaattatcttatttttcacaattaaaatataatgatacatattcatgggtaaaaagggaaatagtaatgagaatgagaaaataattaggactaaataaatgtattacatatgaaaatcagtaaatttcactaaaacaaaattagagggaaatttatagaccaaaatggttatgttagaaaaagagaagaaaataaatcaaaactcaataaataatcatccaacttaagagtatagaaaatgaacagtaaaattatgaaggtaaaagtagaaactaagggaatgtaaaaacaaacaaaacaaagccaaataaagaaacagacaacctgtcttagtctgttttgtgttgctataacagaataccacagactgggtaatttataaacaatagaagctaatgtggctcgtggttctggagactggggacttcaagagcaaggcaccagcatctggcaaggaccttcattctgtgtcatcccatggtggaaggcagaagggcaagacggaggaagactgagagaggaagacaaggcagagctcacttttattaaaaatcatgtctatgataaggagcccacttctccagtaatgacattggtccttgcatgaaggtggagctcttatgatctaatcaccattcaaaggtctgagctctaagtaccatcacaatgacaattaaatttcaacacaagttttgaagggaatgttaaaatcatagcaaaaccctaaggaacctgcatagccaaactctagagaacattatttgcattgtagtgtatttatacaatactccaccctacactgtttatttcaaatttgaacaaccttacactgcagcctagacaaacttatagcaagaattcacaaagtcaagggttgagaagagaaacacttaacaattgttgctgtagcaattcactatatgtggaaaaaaataaaaatcattttctcacaccatacattaaaatgactcccatagggatcaatgtaaaagacaaaactgcaaaatatttagaagtcaacagataggaatatttttatgacttccaagtaagaaaggcttgcttacataaaacacaaaaaacttaactgcaaaagaaaaacattcaatacagtcaattagttaaaatataaacttgtatttctacaaataagtaaataagtaaaacctcctaagaaaaattaaaagagaaacacaattaagtagtcatgaagcctgtttgcaaatattctaaatctcttttggaagcacctggtgtttcatgtccactggaagtgaaatgtaaccatgttgcttgttttggacaatgacatttgaatctttcctgtatattccatacaaatatgttttctgttgtttgtcattgtaggaacatatggggacagaggatggtggccctagaacctaaggcaaagtttgtcttccaatttaggtccatgcaggtgcctttaatattcacactgtggctcacccatccattattccacaacatattagaaaacagaaacaggaggagatttcattttttttcaattttaggaatccttccaattctccttatttcccagctctgctttaggttcctaaattcttagtcaagacagagaggctcttgacaggtgggattgaatttagcttgtaaataactgaggacacccagatgagccggcctagaaacagacgttcggccaagctaggagaacaaagaagttgtgcagctgtatgtaccatattggcttgggcgtgtatcaaaagcatgatttactgtgcatgcgcacacagaacatgaatatagagttggtaactagactgcaccttaatgtgtgtcagagtagactcattctcaacagccaatggcttgagcataccaaggggctattcccaatgactcttgagcctatgtgcagattttcattggggatatgctgttgcctgcagcaccattcaaaatacagccagctgatcagtgagctgttagcaatttaccatcaacgatcaatttggaaagccatatagcaagatggaaagaaactggctatcaccaacaatcatactcctagcccacaagaactttcaaatgggtgcaaaagaggagatgctcatggccattggatctgtgtagttatcatggttatgtagatagatacttaatacatgtatgcagaatagataataaagatcttaaataatatatcataaataaatcttaaataaatcttgaataaacagatcacaaagatcagaatagatcataaagttacacatgtgacaatgtgtgcaagagagtggaacaagagtgagagaattatgcactacaataaaacaaaagaggatctttgtacagagaaagaatggccaacagcccagtggagaaataattcaaataaataccctggaactgagagcaatgcatattgctgacatatgcatatctatcattgtaaggaattataggatgcgtcaaaagaagattctatgcccccagacataaattaggagccagtgacaccagtctagtgttgggcttaccttccagatcagctcagaatatctatcctaggttctgctttcacacatttaaccaaaaataaaacgtggtagaagtagattattaaaacagataaaaggcatggaatattccacataagatgtttagtaaagctagatgagaaaaagaaattgatgaaaatcaaatgtacaacttttgcttactattttccagtgatgaagtctcaatagtttagcacttgaacattacacatgattcatgagaatttgggatttttttttcttctcgtccacaatatgtaactcttatttttatcatgctgaggttcatgcccagaaagtcaatctgttgttttatattcctttcatttgccaaaaaaagagattctctttcacttacattaaaaatctgcaaaattctcacacagtagatttttaaaaatctcttcaatgcaatttctaagtgaatgttttgtatgttaactagaatgaggaacaaagcagaaatattataattcatgattattaattttgcattctgggtttttcaatttaaaaataaatggaaacatttagagatcatttagtattagtattagtacactaatactaaacgtttagtattagtgtactaatagtgtactacaaacactttgttaacactttgttttaataccagtgtaagttggctataaaagaacttaaaccttttaatccacaaaatgcttgcaaactaattggagaggcaaggcccacacatatgaaaataagtggtaattatgtctgtaagacaagaaacatgccaaggtttagagaaggaggagttgacacaagctgtccgtatgataatatgaataagaggaggcagcttttaataaaacaaataatagttggggagatccacttatacataaacataaaaacaaagaaaacatgaaatcatagacacttttgaaggtaactgggaatgtaaatcttgatcaacctttgggtggacaatttggaaaatttcaacttccacaacaatgacaaaaaacagtgcaacctgaaagttctcttaaacttcagattgccctagtttcaattcttaaacattaagatagattatgagaagactataaattctgctgctaaaactattattctcaaatgagaatttctgtcatctgggtgtgtaaaataattcctcagcatgttcgaacccatcgcaaggaagctaaaaaccttgaacaaagattagaagaatggctaactagaataaacagtgtagagaagatttaaatgacctggtggagctgaaaaccatggcacaagaacttcgtgacgcatgcacaagcttcaatagccaattccatccagtggaagaaagagtatcagtgattgaagatcaaattaatgaaataaaatgagaagacaaggttagagaaaaaagagtgaaaagaaacgaacaaagcctccaagaaatatgggactatgtgaaaagaccaaatctatgtttgattggtgtacctgacagtgatggggagaatggaaccaagttggaaaatactcttcatgatattatccaggagaacttacccaacatagcaagacaggccaacattcaaattcaagaaatacagagaacaccacaaagatactcttcaagaagagcaactccaagaaacataattgtcagattcaccgaggttgaaatgaaggaaaaagtgttaagggcagccagagagaaaggtcaagttacccataaagggaagcccatcagactaacagcagatctctcagtagaaacccttacaagccagaagagagtgggggccaatattcaacattcttaaaaaaaagaattttcaacccaggatttcaaatccagccaaactaagcttaataagtgaaggagaaataaaatactttacagacaagcaaatgctgagagattttgtcaccaccaagtctgccttacaagagctcctgaaggaagcactaaacatggaaagaaacaactggtaccagccactgaaaaaacaggccaaattgtaaagaccatcgatgctatgaagaaactgcatcaattaatgggcaaaataactagcgaacatcataatgacaggatcaaattcacacataacaatattagtctcaaatgtaaatgggctaaatgccccagttaaaagacacaaactggcaaattggataaagagccaagacccatcagtgtgctgtattcaggagacccatctcatgggcaaagatgcacataggctcaaaataaagggatggaggaagatctaccaagcaaatggaaaacaaaaaaagtcaggggttgcaatcctagtctctgatagaacagactttaaaccaacaaagatcaaaagagacaaaaaaggctattacataatcataaatggatcaattcaacaagaagagctaactatcctaaatatatatgcgcccaatacaggagcacccagattcataaagcaagtccttagagacctacaaagagacttagactcccacacaataataatgggagaccttaacaccccactgtcaatattagacagatcaatgagacagaaagttaacaaggatatccaggaattgaactcagctctgcaccaagcagacctaatagacatctacagaactctccaccccaaatcaacagaatatatattattctcagcaccacattgcacttattctaaaattgaccacatagttggaagtaaagctctcctcagcaaatgtaaaagaacagaaatcacaacaaactgtctctcagaccacagtgcaatcaaattagaattcaggattaagaaactcactcaaaactgcacaactacatggaaactgaacaacttgctcctgagtgactactgggtaaataacgaaatgaaggcagaaatatagatgttctttcaaaccaatgagaacaaagacacaatgtaccagaatctctgggacacatttgaagcagtgtgtagagggaaatttatagcactaaatgcccacaagagaaagcaggaaagatctaaaatctacaccctaacatcacaattaaaagaactagagaagccagagcaagcaaattcaaaagctagcagaaggcaagaaataactaaaatcagagcagaactgaaagagatagagacacaaaaaaacccttcaaaaaattaatgaatctaggagctggttttttgaaaaggtcaacaaaaatgatagacttctagccagactaataaagaagaaaagagagaagaatcgaatagatgcaataaaaatgataaagagaatatcaccacttttcccacagaaatacaaactaccatcagagaatactataaacacctctacgcaaataaactagaaaatctagaagaaatggacaaattcctcgacacatacaacctcccaagactaaactgagaagaagttgaatctctgaatagaccaataacaggctctgaaattgaggcaataattaatagcttaccaaccaaaaaaagcccaggaccagagagattcgcagctgaattctaccagaggtacagagaggagctggtaccatttcttctgaaactattccaatcaatagaaaaagagggaatcctccctaactcattttatgaggccaacatcatcctgataccaaagcctggcagagacacaacaaaaaaagagaattttaaaccaatatccctgatgaacatcaatgcaaaattcctcaataaaatactggcagactgaatccagcagcatatcaaaaagcttatccaccacgatcaagtcggcttcatccctggaatgcaaggctggttcaccatgagcaaatcaataaacgtaatccatcacataaacataaccaatgacaaaaaccccctgattatctcaataaatgcagaaaacgcctttgacaaaattcaacagcccttcatgctaaaaactctcaataaactaggtattgatggaatatatctcaaaataataagagctattcatgacaaacccacagccaataccataccaaatgggcaacaactggaagcattccctttgaaaacctgcacaggacggagatgccctctctcaccactcctactcaacatagtgttggaagttctggccagggcaatcaggcaagagaaagaaataaagggtattcaattaggaaatgaggaagtcaaattgtccctgtttgcagatgacatgattgtatatttagaaaagtccatcatctccaccccaaatctccttaagatgataagcaacttcagcaaagactcaggatacaaaatcaatgtgcaacaatcacaagcattcctatacaccattaacagacaaacagagagccaaatcatgagtgaattcccattcacaattgctacaaagacaataaaacacctaagaatccaacttacaagggatgtgatggacctcttcaaggagaactacaaaccactgctcaagaaaataagaggacacaaacaaatggaagaatattccatgctcatgcataggaagaatcaatatcttgaaaatggccatactgcccaaagtaatttatagattcaatgccatccctatcaagcttccaattactttcttcacagaattggaaaaaaactattttaaagttcatatggaaccaaaaaagagcccacattgccaagacaatcctaagcaaaaagaacaaagctggaggcatcacactacctgacttcaaactatactacaaggctacagtaaccaaaacagcatggtactggtaccaaaacagagatatagatcaatggaacagaacagagccctcagaaataacactacatatctacaaccatctgatctttgaaaaacctgacaaaaacaagaaatggggaaaggattccctatttaataaatgatgctgggaaagctggctagccatatgtagaaagctgaaactggatcccttccttacaccttatacaaaaatcaattcaagatggattaaagatttaaatgttagacctaaaaccataaaaacactagaagaaagcctaggcaataccattcaggacatagggatgggcaaggacatcatgactaaaacaccaaaagcaatggcaacaaaagccaaaatagacaaatgggatctaattaaactaaagagcttctgcacagcaaaagaaactaccatcagagtgaacaggcaacctacacagtgggagaaaatttttgcaatctacccatctgacaaaggactaatatccagaatctacaaagaacttaaacaaatttacaagaaaaaaacaaacaaccccatcaaaaagtgggcagagggtatgaacagacacttctcaaaagaagacatctatgcagccaacagacacatgaaaaaaatgctcatcatcactggttatcagagaaatgcaaatcaaaaccacaatgagatactatctcatgctagttagaatggcaatcattaaaaagtcaggaaacaacagatgctggagaggatgtggagaaataggagcgcttttacgctgttggtgggagtgtaaattagttcaaccattgtggaagacagtgtggcgattcctcaaggacctagaattagaattaccatttgacccaccaatcccattactgggtatatacccaaaggattataaatcatgctactataaagatacatgcacatgtatgtttattgtggcagtattcacaatagcaaagatttggaaccaatccaaatgtccatcaatgatagactggattaagataatgtggcacaggccgggcgcggtggctcacgcctgtaatcccagcactttgggaggccgagacgggcggatcacgaggtcaggagatcgagaccatcttggctaacacggtgaaaccccgtttctactaaaaatacaaaaaattagccgggcgtgttggcgggcgcctgtagtcccagctactcgggaggctgaggcaggagaatggtgtgaacccgggaggcggagcttgcagtgagccgagattgtgccaccgcactccaacctgggagacacagcgagactccgtctcaaaaaaaaaaaaaaaaaaaaaaagataatgtggcacacatacaccatggaatactatgcagccataaaaaatgatgagttcatgtcctttgcggggacatggatgaagctggaaaccatcattctcagcaaactatcacaaggacagaaaaccaaacacctcatgttctcactcataggtgggaactgaacaatgagatcacttggacacagggcggggaacatcacacactggggcccgttgggggatgggggactgggggagggatagcattaggagaaatacctaatgtaaatgatgagttgatgggtgcagcaagccaacatggcacatgtatacctatgtaacaaacctgcaggttgtgcacatgtaccctagaacttaaagtataataataataataaaaatacttcctcagcaaaccttacagcataaaatatactttcatgagttgttctttaattagctactcaaggaagatccttgtaaaaataattattcggattttaatgtagatagttttgatttaaactccaagatttttttgggggatgggtaatatacatcattgaggtacactatcaacatatacttcacatttactattctttcttctttttttttttttaaaaaaaaggtctgtttttcttggagtgtttaatttcttttcgaatgctggaaaaatttggaggacttgctaaggtttttaacaggatattttttgtgatagttggcaactgggccaggattagggtatggtaaatgaggtgtgttattatttgttgaccatttacctgtagtgcaaaattcaactctgtaatagagataaatagtattttaatgcaatatttaaaaaaattaatgtaagacatccatgaacaacaaaatatcagacttaaatactgagaatcagtagcccttttgtgatgagccaaattggagcttaaggcaaaaaaaatcaatattgatgttcctttcattccaaattttggtattttgttattcatgggtgttttgtattaattctgatttttaagaaataattgcgttaaagatatggaatcaacctaaatactcaatgatagactggataaagaaaatgtggcacatatacaccatggaatactatgcagatataataagtaatgagatcatgtcctctgcaggaacatggatggagcaggaggccattatccttagcaagctaatgcaggagcagtaaaccaaatactgcatgttctcatttgtaagtgggagctaaatggtgagaacacatggacacatagagaggaacaacacacactggcacttattggaggatggagggtgggaggagggagagaatcagggaaaaataactaatgggtactaggcttagaacttaagtaactaaataattggcacaacaaacccccatgacacacacttacccatataataaacttgcacatgtacccctggacctaaaattaaagttaaattaaaaaaatgcattacactattataatctctgtgactgagggtttttttgtgtgtgccctcttaaattttacatccaaaccaagtgcctcgtttgctaatcttcttcccagcctcggttcaggaagggctggaatttcctcatcctctccttcaggatgtcagttctgcactgaatgtgacaaactactgagtgtcatttgtgtgccacactcaggtgactcattctggtgaggaactatttgtcattgtctgcaagttcataagcagatttggaatttctcttccgtgcccttcaatttgcccttgtacaatttgttatgattaatgggaccaaagaaggcaaaaagataacggtaccctcttggctgtggaatgaaagatgacagagaccactcagggtcttagagaacacccaatcaaactcattcaataattattcaccgagtgtttatctgataagaaaaatagttagttgccgctaatatttattcattccacatgaatatattgaacactcttatgtgccaggcattgttctcagtgataaatataccaggaaaaataattatgcccttagctgtgtacagtatgtatgtgtgcatgtacacacttgtatatacacctgtacacacacctgtgcacttaccttgtgcgtaagtgcacaggtatacccatgtctcatggatataatggcaaagattacaaaggtaagaaaaaatagaccttctccctgccctctggaagcttatagactaattgggagagaatgattgggcagttctttcaggctgaggaaactggagagagggagctgtctgtgcaaaggccctggggtaacaaactgcaggcttgagatgcagcagccctgtgggcttctctctttatcctgggagaaatgagaaggtattggaggatcttaaatgggagagggacaggatcatattagaatctctaagtgaggacaagacaaggatggattcagggagatgggtcagagaccagaggacttggtgattgatgtagggccataaagctgggggatatagggcaccatgaactcaggtgccctaagatgacagatggtgtcctttagtgcagtggccccaaccttttaagcaccagggactggtttcatggaagacaatttttctgcaggccagcaggtggaggagatgcttttgggatgattcaagctcattacattcactgtgcactttttttctgttattattacattgtaatatgtaatgaaataattctacaactcatcataattcagaatcagtgagagacttcagcttgttttcctgcaactagacactctcatctgggggtgatgggagacagtgacagatcatcaggcattagattctcataaggagcatgcaatctagatccctcacatgtgcagttcacagtagttcacgctcctatgagaatctaatgcctgatgatctgacaggagggggagctcaggccataacgtgagtgacagggagcagctgtaaatatagatgcacctttctctcttgcctgccactcacctcctgctgtgtggcctggttcctaacaggccacgagccggtacgatttcatggcctggggcttggggacccctgctttaatgcacctagcaaaatcttctgctcaaagaaacttggtttgtgttgagctatggaaggcagtggtgacattagcaactactgtgaactgaactgggctctttctttttagcttcccctcccagctttatttaggtatagttgacaaatataatgtttgtatttaaggtgtgcaatatgatgatttactatacgtatatattatggaatgattaccaccaccaagttgagctggggttcttaaaagtattatttctagaccatgcttcaagtctgttgctaccttcttgtgctccttttgggaaataatttgctctttttgtaccagcccacatgctcacccactcacattcatagagtacctgaaactagctctgtactggtgagatacaaaataaatgaggtatagactatgagtgccagcaacttaatctctctggagccagaacacatatccaccccacccattaaatgtgagtaaccaggacgggagatgttgcatgttactggcaatgacagaactgacgtacataaataaaacctatagtgtacagattcaccgctctgaaatctacatgtttacacacaaagaatagctgtctaaaagcatgggcccttttttctttaagaattgcaattaataggccgggcacggtggctcacgcctgtaatcccagcattttgggaggccaaggtgggtgcctgtaatcccagcactttgggaggccgaggttgggagtttgagaccagcctgaccaacatggagaaaccccatctctgctaaaaatacaaaattagccaggcgtggtggtgcatgggtgtaatcccaactactcgggaggctgaggcaggagaatcgcttgaacctgggaggtggaggttgcagtgagccgagatcgtgccattgcactccagcctaggcaacaagaacaaaactctgtctcaaaataaataaacaaataaaaataaataaaaaagaattgcaattaacaggaaaaagattataaaagattatattctgtctctcaaaggtcttttctttgccattacagggtggagggatgttgcagatgatagtaatagtgactctgatgttcaagtggaatttgattcatttcagaagtatctatagaatttgtttaaaggttctagtgctttgatccaggtttctgcttattcaagaacttaaagaaaagatttttgcaacatcgattttttgaaaattcttcaactctgttggctgccaatgcaaccacagatataaataatgtgggggtttgggttgatttgctgcattttcatcattgctgctagcttgtgacagatgcctgaacagcaggctagagcttagctggctgaaccacatattgatgtaggtgttttgctttaataattcatagagcaagtgaatgcaggtggacagctctgtctcaggtcctacttggcctctcacacatgtagaaagttctttaatgtctctataagttcagtttcttcgtctgtaaaattgataaaaatagtaacacctacactagggaattgttctaggaattaaatcattgacaaatgtaaaatgcctagtgcatcaaaaatgtatcctaaatgatagaagttgttgttgatctctatgcaaaactagaaatgacaagagtaagcaaaccattatcttataatataaacatagtcttctaacataatgcctaaaaagaagcattcctgtgtttacctaaagttacaacttcaaattgactggatatgatagtttgagtgtttcatccttgaggtatttttttgccaatttttaaataatagacaaataaataccctggagtctctattttggtagtcaactgaatgtactgtttgcaagagaattgatcttggactctttaaaaggcaattctcatctcggacatggtacattcagtttgggatagcagactgtctgattgtctatcccagagtttgggataccatactcgtctaattatggtggtatcccaaacacatagaacagcacctggctgatagaggacatcaataaatgctacttcatttcttccctttttgagaatgatgtaagtaaacggaaataaaatctgtgctttttatctaggataacatatgttttactgcaggtcattattacgtcacccccagaatccctggtaaatatcagtgacttagtcagtataggtaatcaataaaagtgaatgaatgattcacattgcagaagaatgatctggtaagagtgtctaggatgaaaatcaatgcaggaaaggactcattaatctagaatacctttgttctcttgtctactagggaagcatatatttatcttttattgtccaaatatttttcagatattctttggcaaccatttctgtagccacctcctcatgatatagcagcagacccaagcccccccacagctggaagaacacatgctgggccatgactatctctgataaacatggaagagtgttttgggaaagaaaagtgagagcttagaaacaatggcttcagataggttcaagagaataatctagcaaagggaagaacttggagaactttgccaacaattcatagtcagaagttaagaatgctaatctgtgaacctttagaggaaaaacagaattaaaaaataaaatggacacccagcccatgttgtgtctacccaaaagatgagaacaagacctctgtatttcaccttctattcccccttcttcagaagtgccaactgtatgcaactacgtggctgcgaattttttttttttttttttttagagatggagtctcactctgtcgcccaggctggagtgcagtggtgcgatctcagctcactgcaaccttcgcctcccgggttcaagagattctcctgcctcagccacccaactagctgggattacgagcgcaccacgctcggctaatttttgtatttttagtagagatggggtttcaccatgttggtcaggctggtctcaaactcctgacctcttgatccgcccgccttggactcccaaagggctaggattacatgggtgagccaccgtgcccagccatggccccagatttttggtggcaccacatgctgactttaatgtgcctattttttacctagagtttccctaactctgtaaccacatcaattgacacttggcccttttacctggccaaaccaaccctatagacccatactctatccacgttccagatgcactgatatttttctccagttgtttaattataccttgttatttaattataccttgttttttgttttgtttttaatttagtcattttatttttaattgtacataattgtacatacttatggcatacaatgtgatgttttgatagatgtatacattgtataatgattaaatcaaggtacctagcaaattcatcacctcaaatatttatcatttctttgtggtgagaacactcaaaatcctctcttctagctattttgaaatatacactatattgttgttaaccatcgtcaccccactatgcaatagaaaagcagaatttactcctgtatttaacagtaactttgtacccattgaccaacttcttcccacctctcctcccctctactctctccatcctctggtaactaccattctactctctacttctatgaggtaaactttttaagattatacatatgagtgagatcatgcagtattcctctttctgtgtctgatttatttcacttaaacttgatgccctccaggttgatccatgttgctgcaaatgacagaatctcattcctaactagtatttccttgtgtatatgtatacacattttctttatctattcatccattgatgaacacttaggctgattccatagcttggctattgtgaatagtgctgcaataaacatgggagtgcagatatcatttttcctgcattgactcttaacttaaactctcttgcaaaattattcttttgcaatgtgaatcatttattttctctgggtttgaatatatgcagtagttggattgctgattcatatggtagttctatttttaatttttgagaaatgtcttagtgtttcccataatggctatattaatttacagtcccatccacaacatgtaaaggtttccctttttcccacatcctcgccagcatttgttatcttttgtcttgtcgataatagccattctaactggagtgaggtgatgtgtcattgcagttttaatttgcatttccttgatgattaacaatggtgagcattttttcatacacctattggccacttgtatgtcttcttttgcccatttaaaaaattggactatttgttgggtttttttttctatagagttgtttgagttccttatatattctgaatattcacaacttgtcagatgtatagttttcaaatgttttctcccattctgtgggttgtctttttactctgttgattatgtcctttgctgaatagaagctttttagtttgatgtaatcatatttgtttatttttgcttttgttgtctgtgctttttgagatcttaaccaaaaatccttccccaatagtttcttctaggtttcatggtttcaggtcttaaatttaagtttttaatccactttgggatgatatttatatatggtgaaacatgggggtctagtttcatttttctgcatatggagatccaattttcccagaaccatctattgaagagacttgtcctttctccaatgtatattcttgcacctttgtaaaaaattggttgcctgtagatgtgtggttttatgtctgggttctctattctgttccattaagtgtccgtttttatgccagaaccatgctgctttggttactgtagctttgtggtttattttgaaatcaaagaatgtgatgcctccagctttgttcttttcactcaagattgctttggttgttcaaagtcttttgtggttccatacaaattttgggattagtttttccatttctgtgaagaatgtcattgatattttaataggcattgcattgaaaccatagactgctttgggtagtatggacgtttttacaatattaattcttccattccatgaacacaagatatctttccatttatttatgttctcttccatttttttcatcaatgttttatagttttcagtgttgagatccttcacctcactgtttaaatttattcttaggtatcctagttacttatttttgtagttattataaatgggaatttttatatttatttttcagatagtttattattagcatatagaaatgctgttgcttttttatgttgattttatatcctgtgactttactgaatttgtttattaattcaaagagttttggggtggagtctttagtgatttctgaatataaaatcatgtcatctgtaaacagagataatttaatttcttcctttccaatttggatgccttttaaaattttctattgcctaacagctctggctagaatttccagtactgtgttgaatagaaatggtgaaaatgggcatccttgtcttgttccagattcagagaagaagatttttatttttttcccattcagtatgatgttagctgtggatttgtcatatatttattttattatgttgaggtgtgttccttctgtgtgtaatttgttgagaatttttattatgaatagatgttgattttttcaaatgctttttctgaatctattggaatgatcatatgttttttgtcctccattttgttaatgtgatgtatcacgtttactgatttgcatatgttgaatcattcttgaatccatgggatgaaccccacttgattatggtgaatgatctttataatatgctgtttaattcagtttgctggtattttgttgaggctttttgcacctatcttcattggagatatttacctgtagttttctttgtctgtatgtgtccttgtctaattttggtatctgggtaatgctggcctcatagaatgagtgtggaagaattccctcctcttcagttttttggaagagtttgagaagaattcatattaatttttctctaaatgtttggtagaattcagcagtgaagacgtcaggttctgggctctttttttgatggagactttttattactaattcaatcttgttatttgttatggtctgttcagattttctacttcttcatgattcaatcctggcaggttatatgggatcagggatttatccatgtcttctgtgttttccaatttgttggcatacacttgttgacagatgactcttataattctttgtatctctgtagtgtccattataatgtctattttcatctctgattttatttatttaaatattctctctcttttcttagtctcacaaaaattttgtcacttgtttatcttttcaaaaaacaaactatattgtttatcttttttatctctgttttctttatactgctctgatctttattagttctttctttctactagttgtgggtttaatttgttcttgtttttctagttctttgaagtacaacattaagttgtttatgggagatctttcttcttttttaatgtaggcattttaatatagtttattgctataacttccaaatactgctttttttggtaacctatatgttttgggatgttgtatttccattttcatttgactctagaaattttataatttctcttttaatttcttcgttgacctgttggttgttctggagcatgttgtttaatttccatgtatatgcacagtttccaaagggagcaaaaaagaaacaaatgatctacaaagcaaccagaaaacaattaataaagaggcagtagtaggtccttgcccatcaataattagtttgatgtaaatggattaaattctccaatcaaaatacataaagtgactgaatggacaaaaaaatccaagatccaagaatatgttgcctaaaagagacccactttagccttaaagatacacataaactgaaagtaaagggatagaagaagatattccatgcaaatggagaaagaaaaagaaaataggattggctatgcttatataaatatgattaaagacaaaaactgtcacaggagacaaagaagatcattatttaatgagaaagggctcaattcatcacgaagacaaaacaattggaaatatataggcacctcacattagagtacctaaatatataaagcaaatattaatggacataaagggagaaatgggtagcaatacaataatagtaaaggacattaataccccattttcaacaatagacagatcaatcagacagaaaattaataatgaagtattggaattaaactgcactttagccaaaacagaccaaaaatatacatacagaacttaatatccaatggtagcagcatttttctctagtgcacatgtaatgtccttcaaggtagcttatgtggtaggccacaaaacaagacttaaccaacttttaaaaattaaaatcatcttaagtatcatttctgaccataatggtatgaataaataacagtagaaactttttttttttcctgaactgggggctttcaaaaatcatgccttccttttggaacacacttgatcccggtcataaccctttcactttaattctaactttaggtctcagcaaaaatgtaatttctgcatggaagcagcctctgatcccccaagctgaattacgtgttcctgcaacgtgttgactataattttgctctagcagaatgtatcagtattgactatagtagtttgttagttttctactaaagtagcactttagctctctgaggccaggactgactgtatctgtttaaatcaccctgaattataccctcatccttccatcaatctctactcagtaaatacttctgaatcaacaaataaatctagccatggagagcaagttgagtgaacaatgaatggggagtggaggggacctggtggagatatccacagggtacaaattaagtgtatgatccttagacataaaaatgtctgttcctgatgccggtgccaccacttaacaacattattatttgcagcaaatgttttcacttctctgtgcctcagtttcttactctctttgtttggaataatttgaagtccttccccatagacatgctaaaagcattgcctgaggtacatgtgtaaagtgcccagaatggtgcctgatacaccattagcactcttgagtgttagatattacaagggttgcactgtctctggggtgaagtactgttgctggtggccatttccacgtgcacatctgaatagaaagtcatgatggtgaagcatgatggaactggcagctctgatgtagaagaaaaatctgctagacatggaagactgagtaaggagttccacatatcagccattatcccatatctgtaactctgggaagacagtttatgcaactgatatcctccaaaagatagatccaaggaaaacacactctttctttctcagaaaacgctagatgtgtatgtttttttaaaattttagttccagaatgaataaatataaggaaaaaataaacaaatataccacgagtcctattaaaataatttggaacaggatgaagggatgatggaattttggaaacaatagtttttcaatattctgttgaagtcttaggtttgcatgtgaatagcaactttcccatgtgatagggaaaaaagtatttctttttttttcccataagttattggggtccaggtggtatttggttacattagtaagttcttcagtggtaatttcggagattttggtgcacccatcacccgagcagtatacactgcaccatatttgcagtcttttatcccttgcccccctcctactctttcccccaagtccccaaagtccattgtatcattcttatgcctatgcgttctcatagcttagatcccacatatgagtgagaacatctgatgtttggttttccattcctgagttacttcacttagaataatagtctccaatctcatccaggtcactgccaatgctgttaattcattcctttttatagctgcatagtattccattgtgtgtgtgtgtgagatacatatatgtatctcacagtttatcctctcattgattgatgggcatttgggttgtgtgtgcaagtatctttttcgtataatgacttcttttctttgggtagatacccaggagtgggattgctggatcaaatgatagttctacttttagttctttaaggactctccacactgttttccatactagctgtactagtttgcattcctaccagcagtgtagaagtgttccctgttcaccgcatctatgccaacatctactgttttttgatttctttgattatggccattcttgcgggagtaaggtggtattgcattgtggttttgatttgcatttccatgatcattggtgatgttgagcattttttcgtatgtttgttggccacttgtatatcttcttttggaattatctattcatgtccttagcccactttttgatgggattgtttgttttgttcttactgatttgtttgagtttgttgtagattctggatattagtcctttgtcagatgtatagattgtgaagattttctcccactccgtgggttgtctgtttactctgctgactgttccttttgccgtgcaaaagctctttagtttaattaggtcccagctatttatctttgtttttattgcatttgcttttgggttcttggtcatgaaattcttgcctaagccaatgtctcgaagggtttttccaatgttatcttctataatttttatagcttcaggtcttaggtttaagcccttaatccatcttgagttgagttttgtataaggtgagagatgaggatccagtttcattctcctacatgtggctagccaattatctgagtaccatttgttgaaaaggatgtctttcccccactttatgtttttgtttgctttgtcaaagatcagttgactgtaagtatttgggtttatttctgggttctttattctgttccattgatctatgtgtctatttttataccagtaccacgccattttggtgactatgaccttatagtatagtttgaaatcggatagtgcactgcctccagatttgttctttttgtttagtcttgctttggctagactatttcaagtgtggatgagaaaaatctgcaaggacttccagtccaaacctaagaaactgtaggttgacacatgtcatatttgatttagtatgcaatccataaatccctaccataaaaaaccataaatagcttataatcaagagatcttcttatctttccccatcacatttattatcttggtagctggtaaactatttaaagaagaaaaacagaaggaaatccttcaaagtatgaaacctctggaactgcacaagaattctgaaactggggctgcagctggctctactcatcacatccttctctactggcatcatggcacattccttaggaaaagacaaactggtggataaggcaaaactacactgagctgttctcagtaggaatgagcacactgtccatgtgttcatgtcatggctaagccagacacattatgaagctcagagtcaacaatcgccaggggccctgggagtgctggctcaacataccgaagcatgacagaaagaatcaagaaaagcattgcttccttgcaaatatggcttgtttgtttcttattagcaatgcatgatattgatcctgcctgcagcgcattgccaatacttcagataaaatcggtatctcagcatggtgagggacaactggaagctggtctttaaaaagtgatttcaaaagacagacacttggcttctaaacagcttgcaaatggtctcataatacaggcaagaaaattaattacatgccaatggactccccagggtgtcatatattgtgtggaataattcttctcgcacagctgtgagtgaaaccttcaaaaaggaacaaaagctttgctggtcaattctgctcaggcccttttgccctccacatgccacacaaacacaaaacaatgtgttcttttccacagttgttgtgcttatgcccaactggatgcgtttccttcataagagctttgtttctagccaggacctaggaggaaaacttacccatagaagatcaaaggcatctagtgttggcacgaatttttatttaaaatttaaatgtattagtgatttatgtgtcataatgaataatacagcatgatgttctcacaaacggctgtatgagcattaaagatgtatgtaatttgattctctaatgagaaatctggcactgtcatgggaaaaaaatattatctagtcttctaccgtgaatgtgtcttttgactttttagtgggtccaatctttctgaaaaaaaaaaaactatcataaaaatgaaattagacatttgttgaatgtgagaaaaaaatttcacagaaggaaattgtgtgaattagatgcaaacagatggtaagattatgtggctgcctgcctgcctgctctgtcaatgggaaaggagtcgtggcaaggttaagagggcagcgaaaatatgaatgtcctcaccgtccttctaccagggcttgagaagccaacggattaatccgactctgtcttcatcagtttaaaggaaagggccagaggaataaatatgatttttttgtaatgattttgaaacaagaaagtaaaaaaaaaaaatctattcttctctattttcagatgtagtcaattgatactaaaagaaaatcatttccctttgactttatatctagaaaacaaattcttaaatgaaggaggacaattttatcccccaggggacatttggttatgcttgaagacacttttggttgtcacaacttggggaggaatgtgaggttactagcatttggtggggagaggccagggatgcttctcaataccctataacgcacaggacattccctcccttcctgactacagtgagtaattatccagcccaaagatagtctcatctgaacaagaaagaagtgtagcattcctattcctattgccttaaatcaagtgctttgaggattcatttccatcaccttgctcaatgctgtaggcacttgagtttgggacccttagatattctggtgcaagactttttttgttcatttgctttttcagatgaggaacagaagcccagagagggcacgcatgttgcttaagttctcagtatgctggtaacacagactaatacactttccattccttctgtctccacactatctgtttctttgttatctacatgcagaatgcatagtgtgaacataggtttgtgtgtgcatgtgtgtgtgtgtgtgtgtgtgtgtgtgtgtgtgtgtgatttttctttagcccagaggtattcataatgaacagctcactatagcagataggtgttttattttttaagcattgaccaattaatatccagatttctaagaagatattttctaaaacctgcacatttgaaggaaaatttatctttgattgtctgcgtgttatttcctacttccatgatttctctctgtcaccaacaaaataagaatttatataatacatcctttactggtctacatcccacttgtcagtcgatcttttatggaatcactgagctcctcacctctgctttcctaagatgcacagtggaatattttctttgttttgaagcaaaagaaatgggagttgcacaaaataaaagccaagaggccagtaatgaataagcttccaaggatgtacaaggcagatttgcatcaggaacatgtggacctatctggttttgtgctgcttcccacaaactctcaatttggaaagatttttcaaaattgttttttgttattaactagaatgtgaatagggctttgataagcagtgttcctactagataaaatccttagagctttttaattctgtgcttgaggacaagcccagatgttctcttcatgaccttccatgaggtttctttttgctagcaggtattgcaatgtagtttactacaagctctagtggagcaaacctccaaagtaaagcacttttattgccaatatttctgcaaatgcagatgctagcctatttttggaaacattaaacatttcagaataattaattgaggaagagattcacaattcacaaggaatctccatcaagattagttgaggctggcatagtactttgaacagtaaagtctctttttagatatacgccatgatataatttttaaaatgtgatttgtattcaactctttacttctaccaaccttttctgaatagggcatctactcattttaagggctggaccacatacagcagaagccaagatgagttgagtgccttttatgcataaaaataactctctaaagtaggagtaaaaggaagtaaaagaggtttgtaatactgcctggtcacaggcgcaaatcaaagtgtgcacccagtgcagaggggagggtgattttaacaaggacaccaattgaaaggtcagcaagtgactcagaggctgacaacaatgccaggtcttaaagactgaggagggatctccattgaacaaagaaggagaaagacattccagaaacaggggatgcctaggcacaggctcagaggcagaagcaaatgctctttttagatagataacagctagaagagagtggctgctgaattattagacaaaggagatgagaactgaagagcaggagagtagagagactagggaaaggatgagaggaacttgtgtgccatgttaaggagcttgacttttattaggtaaaaaaatatagggtccttgaagggttttaagcagagcaatacatgatgatgatagctacaggaggcagagaaattttagtagacaggggtgggtccctggcaaaacctcaccattgagccagaaagcctgaaacctgaggcccaaagggagaacttccatccctgtgtgccttctgtctcccagttggttgtttctgaataatgtctttttaccaattgaatgttgacttttccaaaactacctatggcccgccctgcccccatcctgtgcctataaagagcacagactcagtcagcaaaggagagaagcagctggacgtcggggagaggagacttaacttcagagatggcggctggttgaggcaacttgactttggaagagaaagactgaaaggtggcttgactttaagggagagcaaactacccttcttgtcccctttccagcttccctctctgctgagagctgctttcattactcaataaaattctccacattcatcatccttcaatttgtctgcatgacctcattcttctagggaaccagacaagaatttgggatgcaccaagtggggtaccccaaaaggcagtcacactggccctttgccctcgctgccagagggcagccgtcccatgtgatgaggcaaagggcccactgagctgataacacaccctaacctggatgctgccacaaggcctgcacagagtttgctcctgccggcgctgaagtggccgaccagttcctgcattcgttcactcacacgctccctcccacaagggttggagcccgggggaccctagtgaatggaatttgctcctgccaggcttccggcaggttcctgcactcgcttgatctggttcctgcacttgttcgcttgcacgctccccgccgcacggcaggggcacccctgtcaagagtcccgccaaggggtcaagaaaatatcctgcatcgatgatgtttgtgttttaaaaacataacaaggtcacagaagaacttatacctgatagattggagactacatgaatctgaaacctactcagtagttgcacagagttttttgataaacataaaaatgggcccttctggtattaaagcttgaaacttacatttgttttatctgagttccatcctcaggaaaggaccccccaagcctctcaaaaagcatcaaagggcgctgggcacggtggctcatgcctgtaatcctagcactttgggaggccgaggcgggtggatcacgaggtcaagagatcaagaccatcctggccaacatggtgaaaccccgtctctattaaaaatacaaaaattagctgggcgtcatagtgtgtgcctgtagtcccagctacttgggaggctgaggcaggagaatcgcttgaacctgggaggcggaagttgcagtgagccgagatcgcaccactgcactccagcctggcaacaaaaaagggagactccatctcaaaaaaaaaaaaaaaaagtatcgaagggctgaaactcaccagatcactgcatgtagacaatgagggtccaggcccttcattcctcatgattgctttcttacccctcccaagttcctgttttctcaggcatagttaacctttcttccctgctatataaacttctgattctagttggtcagggagatagattcaagactgatatcccatctccttggctacagcacctgattaaagccttcttctttggcaatacttgtctcagtgattggctttccatgtggtaagaagcaggacctagaccaaacccctgctgtcttggtaacaaatcatcaccataaggaaaggcacatatgagagtggatgtttccagcaagtgtggatggtgccattgttgagtgggaaaagagatctaataactgggtctggactgggggaaagaagaaaattagttttgtgttggacaaagtgaactttagattcctatgggtatagtgaagaagatgctaggaattagaaggaagatttagatgttataggatgatcatggtcattctaaccctgaaaggtgaagatgtgattggaagataattgtatatcctaatatatatatatatatatatatatatatatatatatatatatatatacacactacatatgccatctgaagatagcagtgtctccagtatagtaggaggaaaggattgataacagaaagcatactttttatagatggtagtctatatgacaatgccaccagtaacagttagtttctgtcttttaatataaatttcttctggtagagtaatgtgacattacccacaagctgacatcagcatgcaggtggagttttttggctcctttggaggctgttacatttctaactcattggttattgccattcatgtagtaaatatttaaacatacttattgaataaatgaatgaacacaagattatttcccccatcatcactgaagagggagggcactcattaaaagtgaattttctagatattgcatattgattttttaaagtacactattccaggaagctccttcaaaaattacagtatatatatatacatgtatatatatacacactactatatatataactatatacagtatatatagagagaaagagagatctataaagcttttgactactcaactagatgtcttcaaagggccattaggattccagggtgctctcagtttattatttgttagtttatcagttttaaatttaaatgattttgttttctgtcttccttgacactcagcctaacacatatagcctagaaaagcactgcagtagaaatgacatcattgacatcattaaaatagtgattatataccttgtccatttggtaggttgtggttgggccagcatcatgcctccctttgcagcaaagttcgccaacactgatgtttcctccccccttttttttcttgcaattgtttcacagtctgaagctactgtatgtctgactgaggttatcagtacatctgaccgctggaaatgtgaaagcattactggagaaagaaaaactagtaactggaaaattctttcccatccagatttgcacagatcttctttctaggaaaatgtagaatttcttaggaaaaatctagattttattacgaaaaccttaggggttcacctttaacgtggaatcggagtctatggaaatgcagtctaaggcaagaggttgcagtttcaaagcaccaccaatgtcaacttcacagaaatacacacaaggcccttttaagaattttgccaactcatgttattagtgattctgagaaaattactgtactccaacactgaatatatcaaataaatattcttatgccttatacaaaaatcagaaaatatagaagatatcagagacacaatatccttaccttccggagagaagaatcatttaccacctactctttgggattttatgtaaatataccatcctttgcacaacactttatagttcataaggcattcttaaaattagtgtttcatttggactttagtaccttttgtaaaggaaattgggggtggatattgcaatccctgtattagaagtaagcaaacagacacttgaaaatgagctcttcttttcttaatccagcaactccacattgctacacacataagattttcctgtgttattgagtgaaaacgtgagaggaaagtaaaagtagaaagcaaattcaatttccttgtctattttagaatcccataatgctcaggggatgattacgaagacaaactgttcttctaaaccttcttccaatatttagtctgtactgaaatctctttagaatatggctaatatgttaaaaaaaaattaaaccacccttctctggaagttgaggagatgggggactctaagcccacccactcatctccccctttcccttattcattcttccatattctctgtcttctgcccatccttgaagcatagtttgaaaatcattctcttgaaagatagattcaatatgttcttggtaatatctaaattaaggctgctttgtagtaagtcacatcctgtttgtggaattcaaagagaacatgaattcaagtcagttacaacaaagtcatttgcccaggaatccactgtgaatgataccattaaaattaaaaaatgatttgcaagttagaaattaactcttcggctaaaatagaatatctgtttaagttattatagattggtgctgattttgtcagtgcgattcactttttttcccctaggatctttttatacttctacatggacgttttagtagtacggtattcaatagtacttaagctaattaacaatataatagtgggaaagaggctatcaaacttaagtagctgattactgagtgattactattgacagtagctcttatttcttctctgttagctttcctcattaacacttttgtaatagacaattgggttgggtttttggaatctaatgtcagatttcatatatctttcactaaggtttccctatccccagtggagaaaaaaatggaatggcccatgcaaaagaatgcattaacatttttttttttttggagacagagtattgctgtgttgcccaggctggagtaaagtggcacaatcatagcttagtacagcctcgaactcctgggctcaggtaatcctcctgccttagcctccccagtaactagctgggagtacaggtgagtgccaccatgcccagctaattttacttttttatttttgtggagatagggcctcactattttgcccaggctagtttctagctcctggcttaacatcccacctcagcctctgctttataaaatattaaaacttcttgttgaatacagaggtggaagctgatatcattctgacgtattggattcatgaatgacaaagaggaatcatttatttcagacttttttttttattatactttaagttctagggtacatgtgcacaacgtgcaagtttgttacatatgtatacatgtaccatgttggtgtgctgcacccattaactcgtcatttacattaggtatattgcagacattttaaagccagcaaaatgttacagaagtatacagatgagagtgaatttactagttgtgttttaggttgaatgggatgctaggtcggatccaatgtatttttatttgtttgttttttgtttgtttttgtttttgtttttgtttttttgagacggagtctcgctctgtcacccaggctggagtgcagtggcacaatcttggctcactgcaagctctgcctcccgggttcaagccattctcctgcctcagcctcccgagtagctgggattacaggcacacaccaccacacccggctaatttttgtatttttagtagagatggggtttcaccatgttggccaggctggtctcaaactcctgacctcaagtgatccacccaccttggcctcccaaagttctgggattacaggtgtgagctaccacgcccggcccagtgtgtttttaaatagctttgctccatgaacgtgggccttcatattgcttttttctctcccttcagatacattcatgataaaacctctgcccaaaaatcttacacagacataattcaggttgtaaaagtgttttcttagatttcctaattaacagctgggatataaatataaatactgaaaattagtatggtagagaaagaaaaggaataatttcttaaagtttttcacttacaagattttttttcttctacatgtttcctctaatccagtaagtggaacaatcactttttgtttggagtctgtatgttaccatgttttcaatttggttacatgagactgactgactgcttttctggaaacttacaaaggccttttttcccccgtcatctgtcctaatttcaaataagcagttagcagccaaaatgactttctaaaagtcatctatttgacctctgattatcactcctctgtttaagaaccctcagtattttccattttctagaggataacgctcaaatttcccatggtgtgtacaagagccttcactattagcctggaaatcctcaccaattaaaagccctgtccccagtggtctgcacctaccccttcaaaagacccttttaagcctgccattttccttctacctagattagctttttccttctagttcacctggggaaatcctattttataatccaggtcaaatatcacacttgctgatctattttccttctaactttagcagagttatcttctattctcctcagacactttgcaatatcctccctacagcacctaacacattacattgacatgtcttatgtagcacggtaattctgaactgaaaataagtgtgttctccaggaaacatttggccatatctggagacattcttggttgtcactattaggaagagctggtgtctagtgtgtataagccaagaatgctcctaaacatcctacaatgcccaggacagcccccatgacaaagacccaccacgcaaaaaatgtcaataataactgggattgaggaatcctgccttagaacatgagccatatcttattcattcttggagtcttccttctcccctcccctcctcccatcaaagagcctgacaccaacagatccttaagacatgtagaatgaaattaacattatgtggttatttcctaaatttcttttcttgcttaaaccacgttatccacaaaaaaattcactccctgtcacttctttcctgctaccaggtttacccttatgtagcatggcattctacatggatgatggggtcgtaaccagtattattgccatttcttgcagatcacaccatttacaaaaacaatgtctctgtgtgttctgccatttccctgtgaaatctgttctccctcattttcaagaatcagattcaactttgctccagtaaatcccagaacccactctttttctgcaacttcagatatgccctagggtccaccatggtaggccaggaaagaatgaacctcctgctctctgctgtgtgactgtggcattacatgccttgtatattttgttttgttatttcctttgccagtgttcaaattcagtttcagtctttcattcctttccaaataccccttggtttccttggaatcgtattgagcccttactcatccattaataatttaaaaattaacctaattctgtttacattagggaatagtcggtttaataatatgtttcttattttttaaaaaataagagaggctctttattcgtgtggaataggctttggttttttttatgagaaaaatctccttcccagtccaacttctcaaataattttaaaaactcccagatggttaaatgggttttaaaaatggaaactccatttaaaagatgtattggtatatataagagcaaaaaggaaggggaaagggcttctttattttcttcagctacttcttcaaaataacttttctctttactataaaataaaatatgattttcttttcaacattcaaatacaaaatactgatgcccaacattaaacttacggtcccttaattctgtagggacatcagaagattaattaagggcggcaatttcaaaggactaatttagaaaaaaaaatattttaactatacaacaaaatagcagcatactgaacacataacgtgctgcaagtatgcttcttagagtattatttttaatggttgaaaacagaagattacttaagggtcctactatagagagcactccacacaatggaatattatcatctttaaaaggtataattaggaagaatactaagggggccgggtgtggtagctcacgcctataatcccagcactttgggagacagaggcaggtggatcatttgaggtcaggagttcgagaccagcctggccatcatggtgaaaagctgtctctattaaaaatacaaaaattagttggggtgtggtggcaggtgcctgtattcccagctatttcagaggctgaggcaggagaatcgcttgaacctggggtgcagaggtttcagtgagcctagattgcaccaccgcactccagcctgggtgacagaaggagaccccatctcgaggaagaagaagaagaaggaggaggaggagaagaacaagaagaagaagaggaagaagaagaggaagaggaagaagaagaggaagaggaagaagaagaggaagaggaggaggaggaagaggaggaggaaggagggatgtgactaaatgttctcatttattaaggggaggaaaaaggggttgaaaaccttatgtgcatgcaattccacacatacatacatgtgcacacacacaaatggactcacgcactcatgcaacacatggtcagaaacagctacacatcagtttcctcttggtggtaagagtaaggcatttatatgaatatatacacatattattttctgagacaggggcttgctcttgctctgttgcccaggctagagtgacttgatcgtggctcactgcaaccttgaactcctgggcacaagtgatcctcccacctccgcttcccaagtagttgggactacaggtgcacaccaccgcacctggctaatgttttcaattttttattttttgtagatacaggatttctcactatgttgcctgggctagtctcaaactcctggcctcaagcaatgctcccaactcagcctcccaaagtgtagagattacaggcatgagccaccacgcctggtctatatttttatttttaaaatttctgtccctatttgaggtatcaaatgcctaaaagtgcaaacagttttgttgatcagttggatgagtttttacctatgagaatcctgtgtaacattcacccaaatgtagacatgggcgatttctgacaccctgggaagcttgttcatgttcttttctacccagatccccaggttgcagcctctattctaactcctctcataatagtttcagtttgtgggtaggtttttttgatgttgttgtcataaatatattttcatagattttgtaatgcatattacgttttagaaatcctgtaagtgaaatgattttagaatgagaagagaaagagaggttggaaggagggatgatggaaagaagaaaggaaggaaagaaggaggaaatgaagagaggatggaggaagtgaggaaaggaaggaaaagaaaggggaaagaaaggaaaaaggaaagggagagggaagggagggaatggaaggagggaagaaagaagggagaaagggagaaaggatgggaggaaggaagggaaggaggaagcgagggaggaagggaaggaaaaaggaaaacaggagggagagaagaagggagggagagagggaggaagtaagggagaagagaggaaagaaagaaggaagggaggaaggaggaggaagggaaagagtaagggagacaggagagaggaagtaagggaggaagggagaagagaggagggaaggaaggaaaggaaggagggaggaaggaagagaggaagaagggagggaaaaagggagggaggaagagaaggaggaagggaggaagaagagaaagaaggggatgagagggaggaagaaaataagggaaggagggaaggagggaggatggcgggagaatgagcttgccagggtagccctgcagtctccattgtctgtgagagcctccatgcttgggcaccacacaaccccaagtcctgaactttacccttcataactgtgacgttcccaaatcaagcactcctttaaatcgatgccttggccatctcctcttgagggatccttgagaggataaaatacaattcttccttttattttttatttttatttttatttttattatactttaagttttagggtacatgtgcacaacgtgcaggtttgttacatatgtatacatgtgccatgttggtgtgctgcacccattaactcgtcatttagcattaggtatatttcctaatgctatccctcccccctccccccaccccacaacagtccctgatgtgtgatgctccccttcctgtgtccatgtgttctcattgttcaattcccacctatgagtgagaacatgcggtgtttggttttttgtccttgcgatagtttgctgagaatgatagtttacagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttataatcctttgggtatatacccagtaatgggatggctgggtcaaatagtatttctagttctacatccctgaggaatcgccacaccgacttccacaatggttgaactagtttacattcccaccaacagtggaaaagtgttcctatttctccacatcctctccagcacctgttgtttcctgactttttaatgatcgccattctaactggtgtgagatggtatcttattgttgttttgatttgcatttctctaatgatcagtgatgctgagctttttttcatgtttgttgaccacataaatgtcttcttttgagaagtgtcttttcatatcctttgcccgctttttgatggggttgtttgtttttttcttgtagatttgtttaagttcattgtagattctggatattagacctttgtcagatgagtagattgtaaaaaatttctcccattctgtaggttgcctgttcactctgatgctagtttcttttgctgtgcagaagctctttagtttaattagatcccattttggcttctgttgcaattgctttttgcatttttgtcatgaagtctttgcccatgcctatgtcctgattggtattgcctaggttatctactagggtttttatggttttcggttttacatttaagtctttaatccatcttgagttaatttttgtataaggtgtaaggaggaggtccagtttcagttttctgcatatggctagccagtagaaagtcttaaaaataaatcttggctcttcaccctgcgttattttcccctgtaatgtttatgaccttctaatatagtcatataatctactcatttgttgaatgaatgaatgaatgaatgaatgaaaagaaccccgctgaattttccttgtcactattttgacttacccattctgatgggcttggcagctattccctaagcgtcatcactctgtttatctcatttttgagagtggagctcattatccaccttcccatctttgccaacaactaggggctgggcacagtcactcatacctgtaatcccaaccaaaatcttgcctgggagaaattcggggaagatgcagcacgtttcctcaagggtctatgggtgtcacattcttgatttatatcccacctaagatctgtctatcaggatgaaagggacatgaaaaaagaacattcggacaccctgacatgggtcctgttttcagctgacagagagactgaaattcataacgttctttgtagggcatggtgggatgttgatattttaattccatgaaattattgaagagaaattctataataaaatatgaccatgttctatgtgcagtcccaaagctcagccacagctgtgcttctctataacaggccagttctgaatttttcctcaggctatttatttgcttctttgagagtggtttgtcttttacaagtagacaggcagtagcaaattcctgtgacttgagaaaagcttttggaaaaacttagaactgacaagttttaaccattgacttatgcttccatcctcctgcgaaccagggcaggctgctgtgattccattgcaactgcacattatttaactctagtttacagagctaggttctgtgagagcaagtctcagcaccatggagatgcaattagaacaaaatactcactgttaaacagtgtctgcccttgtgtctaattgtctcacatggatatttctgaatttatgccagatgacttagtagctattttttgaacacccgtgatgtgcagtcactgtcctaataagtgctggggatatatgaaagaaaatgaacatcttgcttcgagtctaatatggaagaaaaataacaagtgagccaataggtcaaactcttcttagtggaatctctgcttctcaagatttggtctccttagggacatctcagttaaaattgctgatggatcttcatggtgtgtagtaggaaaaatgaagtcttggcaatctccctcgatgcctgaatattttcctggacattctccacctcgtatctcttctgaacccttctccagcctgctctcagctgacctacagtggacatcattaacaggtccctttgccctttgctttctgtcagctgaactctccgggtgagctagtaatgtatccaaaggtgagctgggagtgaagccatggtctgcatcctctgtgctctctgcctaggagaccacaccccgctgctggctgcattcctgagctgaaggaggctgtttctaattctggtacctgctctctcctcctgatccttcagactcaggataagaatggctccctagtccctaaactcagggtgctccatattccccatgtattttcttaccctcacaagccaacttcctgcacatctgtaagtagttcttcactaaatctcaattacttattccatcttagtatgccgccttttactcctcaaataccctgcacaaaatagaaaatcctaacaagacatcaactgctgactctgtgatctgctcccctccctgctcttccttgaaagaaatcccaaactagcccagagcaaaggaatttggtgtgtttttttttgaaatataagttttctagaaagaatcaagaaaaaaattatccatgcatagttttaaaaatgagatgtaactgttgtaactctttagtacttgttccatgtatcattctaccttggattcttgatggctttaaacagccagccagatacgggatgcccaataaatgttcatagagtaaatccgtgcatactgttagggcatttgacatgacagcttaaataaggaactgattgtcttagtgttgatctatatctcagataaataaataaaataacagtggttcagaaacagcaaacaacgcccagccactcaaccaccatattatatttgataagggtagattaaatagtagataaattaatttttattctccctccctctctcctttcctcccttccttccttcttctcttccttccatccttttttccttccttccatcattctttcctccttctctctttctatctctttctttctttacttctttcctaccttctttctttttttccctctgcgtttttagaataaagtagctaaaagaagacaatagagaatgtgcagtaattccatcaatatacaaatggcacatccacaagttaaggctttatgagtgacaaagccttaactttgaaggctttttaagtgctctcttagtaaacacttttgatttcaacctctccaaatatgtgttaatcaaattgttccagtcatttgcgcatttggagaaaaacaggatgtgggtttaatccatctagactgaaaaatgattttctttgtttcaacttaaaaacttagtgggggataagaaagtctacactccaatgattaaataaatggaaaaacagtaggaatgcaacttctcccctgactactccacaaaacagtgtattttaagtcttatttcccaccaacttgtgaatagtatattattcccatgcttacactcatgacatcaaacttaaattaaaaatagttccaatcctccagctcttgatggaatttgaagttaaaatttggcttatgcttacttttactaacaaatacttttgtgctgctgacatgatttttttggtaccattgttagtccagaaaatgccatctgtaacatcttagaatcacgtgaacgctggcttctgtgctaggcaggttcagctagtctaccccacgcatgggaaccatgcgaccaaaccagggctggtagctgattatttttatctctggagaacaaaggaggaggaggctctctcttttatttaatggtgtgtgttaagtgaagccctctaaatacccctccctgatttcatttctctcctttttcaccatggatatgagcactatcctgaatgggtgtttagcactcttatacatgtctttatacttttataacataggtgtgcattcttaaattacataattttacatatttaagaggtttataaatatagagttatagcatacacccttctgcaatgacgactgtgttttatcctttcatcaatgggggaatcactatagaaatttatgctgttgagttcaaaattaatcaccaaaggactctagaacagatgtgttacagtatgatttgtgagctcttcaaaaaggaaaagtggctcacaagaacttcatgatataaaggcgagaccatagagaacaagtgaggttaaggaattgcctccaagtcatgctgcatgaggacaggaaatgaattgagctccaaagctcttgctaaagcttggcgtaggtcctgttggagaaggaaagaagatgacaagaactgcctgacacaccgtatgccggacatcttcaagggtgctatgggattggattctggactagagcctgtgaaccccattcctctgcatgtgtcttagctactttgtgagatctgcctagggtaagtgggaggtgacaaagagaggaccttctccattttacaggccaggtagatcagtaaacagttcctggaggtagaaggttctgtcctcttatgtctagaaccttccaatatttgagtcagtgtgtattaatacgcccaccagatgggctggggtcttcatgaggcattctgcttcctgtagcagtcagcaggtccaccctcccattgtccctggagtccttgttctctggagttcagcagctcgctgtgaatgagctgaggtttttgccatgaggggccctgtttcagagtttgtgacaaccaaaccttaacgaggttaaccccatgtacttcacaccagaacttatgtggttagggtcctctgactagaaactataataataataatatttttcagatagggtcttactctgttgcctacattggagtgcaatggcataatcatggctcactgcagcctcctgggctccatgaatcctcctgcctcagcctcccaaatagctgagactacaggcatgcaaccacaccaggctaattttctttccttttttttttttttttttttttgacggagtctctctctgtctcccaggctggagtgcagtggcacgatctcagctcactgcaagctccgcctcccgggttcacgccattctcctgcctcagcctcccgagtagctgggactacaggtgctcaccaccacgcccagctaatttttttgtattttttagtagagacggggtttcacaatgttagccaggatggtctcgatctcctgacctcatgatccacccgccttggccttctttttttattttattattattatttttttggtagaaaccaggattcactatgctgttcaggctgctctgcaactcctgggctcaagtgatttttctgcctcagcctcccaaagtgcttggattacaatctgattggaaattcttaaacgagatgcaattctgacaccaccatcataaaagatcactctaataaatgggaaggtgaggaacctttaaaaatacatttggttacataaactagagcacatcccaacaatgaaataatgtgcagttgtgaacaggatgagaaagtgctttatgtgctgatatgtaaaatctccagaaagcttttacatagaaaaagttaggaacagaaacagagtatatacagtatgccagtttttgcttaggaaaaggggagtaataatatatattcatatttgaataaacgtttgaagcatatagaatggggaggccagaaatggagaggagggattaacaggtaggagattactcaatatatgccttttcataccatgattttggaaccacataaatttttgtctaagatacattgaatcaagtaagatctagtttaacattctaccgatgttaatttcctatggttgataattacattatggttatgtaagatgttcacattggggtatgaggtaaggacaatattatttttacaactttggggtaagtctaacattagttcaaaacaattgttttaaataaaaggtgatgcacaaatagctgataaacacatgaaaatgtcttccaacgtcattagtcatcaggggaaagcaaattagaaacaagacaaaatgccatttgtatagcaactagaatggctaaaatttttttttaagttgagaacaaaatatttgtgaagctctcctgcattggtggtggaagtataaaatggtccaataatattgttggcaaattcttatggaattaaatatgcacctaccttttgaccccaaaatttcatgcctaggggttaatctatgaaaaacaactgtacaggaatcatcataacttctgtatttacagttgccaaaagctgcaagcaaccgaaatgtgcaaaaggagaatgggtaaaggagctgtttttttttaatgttcctacagtgcagtgccactcagtaatcataagggacaaaggactgacacatcaacaatgcttatgaagctcacatacacggtgatgagtaaaaagaaacttgatagcagagagcttgcactgtatggctccatttacacaaaatgctagagcaggtaaagctaacaaaaggaaaactgtatcagaactgtggttgcctcttgttggatgattaactgggaagaggtaaaagggatgaaaatgatctatatggtagcaaggttgtggattatggaagtgtatctgtttgtcaaaattgtgcagttattttttgtgtgttttagcactacatactttatcgttaaaaaaagcactgtgaaaataataattacctagggtttgggaatgggtagaggtattgatcatagagaatggcagaatatggatagcactgaggtgtggtggtggatttgggggagagtcaataaaccagtctgtttactttttctgtatttgatatttttcacagtaaaaagtttaaaatattctaaaaagaaaaaatacaaattttgctataaagggaagcaatagaagtaacagggatttttttattattaagaagatgaaagcaattataccatgttttaagctaacaggagtagtagagttctcagggctgggagagtgtgtggcaactcaagatgttccctgactgacactgacaatcgaaatgacattttaaaatatgcagtgatcagatcacagtaaatgaatgtcaagaacattgaatcgcaggcttatgaaaaatgctaaggaaagctaagaagtattttggtggtagcttttgggtaagaagaccaagaaaacccacgcctatttctgagagcaggtggtatgttagcagctgtaaagagagttcagagctttttcaaatactgactttcttcttctatttctacaccaaagaaaatggcctttaaattttaaaggtgaaagcaaatagaggtgacaaggatttaagcgtttgataggtgaagaaacaatgagaggacaaagcttcttaaaataaattccaactcagaagaattctatctccagaatggagaatatttgctagtagttgttgattaatgatgcttgacaagagaactactgaaatataagagatgggtaaatataaccccatttcccctttcttttcttttcttaaaagaggatagcattctggaaattacagactattaaatttgacaataatcctctgtgttctagaatagattacctaacaaatgtcttataagcccatagcaaatgaaatagcaatttccagaggctcaatgggtttgcccaaagtatgtccctaccaagccagttttattaaaagccctggatataacttgtctagatgctaacatgttatttggcaatttccctcttgccattctggaggacaagacagacgtataaatgagtgagcctgaaatcagaggattatgcaagtgttcatttacaggcattttgtagtaattttcaccacccactgaaaggctgcatgtctaatgtcacatgtggagacagaacctgtgtttagtgatggaaatgacctatttccatctgcatctatgcctatatttacatatacatgcatatctataacgatcttgtttacctatctcggcataaaattagctcacttttgtcctcacttatatattaaaattagtatgatttaaaatttaaaaatagtgtacattctctatatttgagaatagatggcctgattatttgaatgttccatttcatgtaaggacattgagacatctttctactcttgtgattgcaaaaaattccagattgtaccagcacgttttgctgccatattaaatagagcacatggaatcaaagttagcatttttttggcgattcatcatcttgtgaggcagacagggctggagatggggtggaattagtattggcttctggtagttgttattagaattcaattttaaatagtgccttgtactttccattctcttctgtacaaaaagtgaaaacctgaagtcattagtggacgcttctagctatttatctttgagagccacctgtctttttttcaaaactgtttgtgatggctttaaaaaaatcacagttacttaaaatactagtctaaggaactaccttcctatatggagaaaaaagacataatgaaacagtctctttttgatatttccattcacagactgtcatacttccaatatgtattattgtctgcaagtagctccttagctaataatcaccagtgaattagaaaatcaggaaattcactgtggcatatccaactcccagcactgttaatgagcgttgcggatgattctgcacagataagttcaaagcaaatcactgagaaaatactgacatacttgtagccttttcatttgggggagggtaacacagctccaaaattttaagaaccacctctctttaggcattaacaattcagtgaggaaaatcaattctggttttaagacatcttcccacttaccacttagttaccttctggctcacactgattattttagggtgtgtgattccaaagtaacaatcgttggcagtcttatcacgtagtacatcttagcatgtaattatatgaggttttgagtggttctctaaagttttccttggttgtgcaaattgtgatctcttggtaaaaaggaatggcatttgaactgctttaatatcctcggtctgaaattttattaacattgcaattactctaatagatagattacaataattatttctatacttgctgtggtcgagagaagatgagagtggaaataggaagagttgggtattttacctctttggacttgggcaaagattccttctttcagcttcagttgttcttttgttttgttttgttttcatctacaacagtggaaagaatggtcatcccttagcaggatggtacaaaagttacccaagataattcccaaggtaagtcactgtcttccacaaaatgaggctaatggcattatccccccggaatagtccttacttttagtagcagctcaactaattctagttttcttcttattctgtttttcttttaagaataaacttaagattttgggatagttttataattacaggaaaattacaatgagtagtagtacagagagttcccatataccccagaccctccttcccttattgtaaacatctgctaaatttatcaaaattttagtaaaccaaggttgacatgttagtgttaactaaagtccacttcttattcggatttcccttacatttttatttaatgtctcttttctgttccaggatctcatccggggtaacatatcgcactatttgtcatgttttcttgagctctctttggttttgacaatttttcaaacgctttattggtgatcttgacaattatggggacagttagagaatcagatattttgtaaaatgcccctcagttgatatgaatgagatgtttttctcccaggattagactgggtttataggtttttgaggggaaatcacaaaaatacttttgcttttccttcccttcattttccatccatttcttttttcctttgctcatattttctttttttttttcctttcctttattttctaaataggcttctcttcctcattgccctgggaaaaaatttattcacttatttatttatttatttatttatttatttatttatttatttattgaaataggatcttgctctattgcccaggctggaatgcagtgccgcagtcatggttcactgcagcctgaaactgctgtgctcaggtgatcctcccacctcagcctcctgagtgagtgtttaggctccttttaacccagtaagtgtaattggatgttcagacacatcaaaaaaaggaagttaaatgtacatactctaaaaaacataagagttttattttgatgtgctgaatcaggtccaggtggaacgtttcaggaagcagaaataattaggagggttaggattgtaaacataaataaataataataaacaatccatactgaaacccttgaaaagggtgttaacgaaaagcatttatgagaacggacaagtgagaaaaataatattggaagcatccttaaggtctcgatattttgcatagctttcttatagaatttaagtttcacacctttattagcagatttattgcctaaataaaatgtaaattaatttttttaaacctgggcagaagatgaaacacactcagaaagcgggataggtttatttgtttcatggggttgagtaataacaaagataatgatttctgggccttggtgttgatttccgacacagtctggcaggtttggcagtgtgagggacttcatgtgtattaagctctgaaactgctaaggcctcccttcaagcctattctattttcccatcaggattgttgcatttctaagcttagagattatctattgcatatctgtagtgtccttggactctgaaagtatcagtcattggttactcaagtctcttgggctggttaattgcatctgtcatcttgactgggccacagggtgcccagatacgtggtcaaacttattgagtctgtctgggaaggtgttttagatgttttatttttaattcttgtgggtacatagtaggcacatataactatggggcacgtgagatactttggtacagtcatgcagtacataataatcacatcatggaaaattaggtattcattccttccagcatttaacctctggtgggagggggttttaggatgagattaacatttacatcgatgactgaatgaagcagattgtccttgccaatgtggctggaccttgtccaatcagtcaaatgcctgaaaagtacaaagactgaccttccccgagcgacagagaattctcctgcctgtcagctttcaaactggggcatagactcttcctggttctgcagctgcctgccagccttaggacttgtattgggagatcatttggagtttctacaggttttcgacttttcagcttctacaattgcatgaactaatttcttatcataagtctctttctgtctctctctgtgtgtatgtgtgtgtgcacagattatatatatcatgtatatctttactggagctgtctatcctgtatctctctatgtagggagagacttgttttaaagaattggcttatgcagttatagaggctgactacacacatgcacacacacagacacatcttaatatgtatatctttattggagacatacagatctcatatcaattctatttatctggagatccctgactaatatagctatcttctctacttatgcacacattgtgtaaatggattaaagtcttttccaaatactcccatgtcataggtcaggactataccatttgattagcataaattatgcttccacaactcgtttggaaaggaatggcagaattcaggctttctgcttatctaatcaaatgggagtgatttcgctgattatcttcattttgtgctcatttacttcaatttaaatcaaccatcattaagctcctacccaacattcgtgggacaggttattatcagacaaggttcttgtgcaattgcattgagctgtgcaaagaaaaacaactcttttgagggcttgggaaaagggtctgaactacacaagagagatatacagggacacaaggtcagaagcacgtggccttttgagaagctgctgagaactgaagttatatttttataacaagaacaaagcaagcctctgttttaacttttccttatgcattcagaactttgaaaggcgagacttgtcaggcaccaggagagacacaagtgcttctagatcaggggtcagcaaactttttttctgcaaaaagctctattatcagattttaggcttttcaggccagtctttgccactaatactcagctgcaccattttaacacaaaagtcacagtgggcaatccacacatgatacacaatgcacatggctgcatgttagtaaaactgtatgtatggacactaaaatttaaatttcttatacacttcacatgtcatgaaatattcttcttttggtttttcttttggaacactatttacaaatgtaagcatcatttgtagctcgtaggctgcataaaatcaggcagcaagcagatctggtccttgggatgtagttcgccaaccactgttctgtggtatcagtttcatacatacttcttatgtggtaatgtgcaccgagaaaaggaaagacaccatttccccctcagtcgcaatactatagaaagtgcttgattaaattgacataagtactaacatcttatccacattgatgtttagctaatttattttgtataacaataatacaaagagttctttttacctgttacactaaaaaaagtatattaatatttcattttacccctctttgaaaggcaccaatgaaaaccaattattttatataacattgcagttctatccaaatatcaagttcaaaaggtggccttggaatttattgttttttgttttttgtttttttttgagccagggtctgactctgttgtccaggctggagtgcagtagtgtgatcatggctcactgcagcctcaacctcctgggctcaggtgatcctcccacctcagtctcctaagtagctggtactacaggcgggtgctaccatgcctattttttattttttgtattttttgtagagacggggtttcccaggctggtcttgaactcctgggctcaagcaatccaccctcctcagcctcccaaagtgctgggattaccggcgtgggccaccatgtccagcctggattttttttgaatgaggtttttgcttggttctagggtggctgtctgaatatatgtgaacctcagcctcctcatcactaaatgaggggattgggccagttcaggtatgaagaaactttttcttaaaaggccagccagtaaatatttgggaagccatactatctctagtgcagctattcaactctgttggtgtggcactcaaaagacactgtaaacagaatataaatcaatgggtgtggctgtgttccaataaaactttatgtacaaaaacaagcggagcccaggtttgaaatatagatttctggcccctgatcttgttggtcttaaaatacctttgcagatggagaaatcagatgaatgttgcttcgtaaaaatggaccaccagaggaaacttgggaatgattatttttaactttctaagaagtagattttatctacattttataaataaaatattggtgcataagaagtgctagtttcatgcaattacatcagtggagtcacctatatgaatgatgcattccttatctcaattcttccataagtagaatcacacactccaaggaatttatatgtttcataaagatcagtcaataaccgggaggtaacttatggagatgaattgcatttagttatttcatctcttatttgacatatagattttaagcctgttaaatgttgtcagttaaatgttgtcagtgatgacaaaattgaagcattttctctccttcaatcaacatggtgagctaagtgttaaatggcaattaaaattataacaaaatataatattactgatgtggaaccttcatttcttatttcattatttctcacatttactattctagggagaatagctcagagatatagtaaattcaggctacattaagcaaaatgtctactcatgggaatctcagaaaatgtatttgaagcctccctagaagagtcttgagtcccttggcagtgctaacttgcacaattcctgacccagttcaccttcagttagggatttaaagttactcttcttctgaacaatggcaatttcaataggagggctttttcgctctgtgcacacgtgtggttttcttgtaaatggtttgctgcatgaaaggcaatctggattactttcgttagtcttgtattccaaggaaatcctccgcagggatttccgctgttgtaaggaaaatgcacacactgcaaatttcttccaggaagttgctgaattaacaaaaattaaatcaactaggaagaaaaccttttgcacaagtgagccccggtggcagatgacagtcatctatcagcttggtgcactggtgcttgcagaacattccaggaacgtgcctcagctcactgtctttttcatcctacattttccttatgaaatagctcagcatgaatgtcatcaggtgcttcaggcagatggtgttggaaaatcatttctcaaattgcctcctcgagaaagtggcacttgtaagaattgcattgccgagaaccaatcagcaacctgtgatgtttaagctgcctgctagagtccatttttcatccaaaatgtgactcatattggttggtaggagacaaaacaaacaaacaaaacaaaaaaatgcacatcatgccaaatgttgaagtttgaaatccctgacttggaataaacttttccaaagatcaaattccatgtttagtttaaaatcagtgagtgtattagtctgttctcatgctgctgataaagacatacccaagactgggtaatttatgaagaaaaagaagtttaatggactcacagttccacatggctggggaggcctcacaatcctggtggaagatgaaaggcacgtctcacatggcagcagacaagagagaatgaaagccaggtgaaaggggaaaccccttataaaaccatcagatttcgtgagacttattcactaccacaagaacagtatggggaaaccgcccccatgattcaattatctcctaccagatttcttccacaacatgtgggaattatgggagctgtaattcaaaatgagatttgagtagggacacagccaaaccatatcagtgagtgacttgggttaaaatttagcgatcatatcaccaaatgacctgaaggaataattacctgaaactgttaaatatgtatttggttactttaatttctgtctccttaactaggtaaacatgaaataaagtctcacactttaatcctggcatagactagtaggtgttcaataaatgtcagttgaatgaatttaaaagtgaatacgtattgcattcgaatattgaattgttttctcttattttttataaaatactcagtaaatatacattttaaggatttcagtagaaactctttgagttgatattcttttatttttaaaatgctactcatctggatctgaaaaaggctatagtcattttagatatactaacatttagatctatgagtcaaatttataccagctcattgttttcttgttttattcagggtctgtagccatgctaaaggcacataaaagtttagggttttgttttgcactaatttgtgagacccaaggtttgttttgtgcataaaataccatgtgagtatgcaacacagatatcacattttcaccaggctaaactagcaatcattgttatcaaatgaagcacacttatgccaagacctcaaaagggacatttaggaaccttaaatcactagttattcataaattgtacataatttatttaaaaatgtttcacatagtctttctaaaatgttaagtgtagcatctgcttattatagaaaaatcagaagatcaatagaaagaagagaaaatggccaggtgcagtggaataaaatgagataaaaatgagaagggcttagaaatactaatctctggaatggtctgagacattagaaagaaaatgtaaccaggtcttagtcatactaagtccaatgaaagcaatgtaaatcttgcaaactctattttttgtaattaaataaatgttggttaatatgagataacatctttaatatcaagcacaaagtaatacatatcttaatacatattttacaagatatcttaaattttaaaaatatgaaaataactcgatattgtaacatacataagcaagccaaatatgcatcaaaagtatggcattttaacctaacaaaatggctaaagttaaaaagaaagaaaatgtcaaaagttagtcacaatggaagcaattttcatgcacagctggtaggaatataaattgctacaaaaattgttgggcagtattaatttgaactgaaaacacacctactatataatacagaaattctattcctaggtcacaagaaataagtgtttattctctccaaaagacgtgaacaagaatgtgtataggaactttgttcatcatagccccaaactgaaaagaagccaaatgtccattattaaaataaaggcgttgttctgtattcttaaaatggaatattatataataacaaaaaaatgaatgattccatgcaagaatatggatggatggcacagatataatattaagtaaaagaggctagacacaaaagagtacgtgttgtatgatttcattggtgtaaatttcaagagcatacactaggggtcaaaacagtgcttaacttcagagaatgttgactggaaagaaaaataagggggcttttgggtagtgaaaaagttttatgttttattcttgtatttggttacagaggtatatatgtacagaaaaaaaaatatcaaggctgggtatggtggcttatgcctgtagtcccagcactatgggaggctgaggtgggtggattgcttgagtccagaagttagagatcagcctgggcaacatggcaaaacccagttgctacaaaattagctgggcatggtggtgcatgcctgtagtcccagctactcagggggctgaggtgggaagatcgcttgaacctgggaggttgagactgcagtgagctgattgcacgactgcactccagcttgggtgagagtgagaccctgtctcaaaaaataaaaaaaaagaaaagagaaaagaaaaaaaaatcaagctatattcagttttaatataagctatagtgtaagtaatatgtactttactatatgtattttagaatccatcatttttaaattgagtgtttccatacaactatattggcttgcttctctacaaatcggaaatcttgccatcacaacttcacacatctcatctgtatcaaaagataaaaggtttgaatgaaagaaagtagattttacattttgaaagctctgagatatctcactgccctcttcgttttcattgacagaaataagtcattatttctgtattattgaaagtggagcaacatattcgcttcctcaagcctttattgtgtttcctgaaagccagttcaagagctaaacaataatccaattactactcagtgtttatgaggagcagttcatatccattaccattggaacatcatgttctttctatagactttcgccagtggaaagactgatagaagtgcgcagaatgaggggtagttataggatttccctgaagtttccttttcctaatgaatacactccttcattgtaatagattgacctttgaacactaatgtaagtcttatggctgggtgttttattaattgctagaaccttgctagttggggttgttaattcaccctaaacaaggaccacttgcaattaatctttttctaattcttgacaccatggtttacaattattgttccctttttaaaaaccaattatatattttagtgttttacaaatggacacaaaactgcaggtcccttaaatgattttagtgtcagaagaaaagagtccttagtaacccatcaaagttgggtctataatgcttaaactcatttacatacaagaatagcattaactattaaaaccaagagcatcctttgcaagtaatatatgaattaaagtattccattcaccaaaactacatttgatctgccccatcttattgtatgcttagttagtaacagacaaggacagttcagtcctgccttgtaccttatgaatcagagctgacaagaacagacacagtcctgactgccatgacactgtctatcacgctgatattcaactttcaggaccagggacagcagagagcagtcctaggaatctttacacaaactccctttgccctctgaacaactctctgaaacgaaatgctatctgcttgtcgtccaagccaattgaaatattacaatatgtttcatgactgagggatactttcattttatactttcaatttctcaattcacttatttctccagttaaatggatccttaaaaaaaatgtaacttccagtagggcagtagtggcaaatcctgaatgagaggaaacatggagacaaaaatttagtgtttgcaagattcacactgaactgtctcttcacctatcagctccttgctgtctctgcttggtttatgttaacccttcaattcatctcttgtacctcattttgacatccttattgatctgagctctcagccattagcttggtatcctctggccttcttgtctccttttcctgctttggttctttaaacttttttacaactaaagtcttctcctaggtttccaacaccctccaactgaatcctaataaggagctccatccatggtttttttttcttcttcttcttggccatagtgtcagagaactggctcctgaatactggtatataagtattttgtctttaagcatgttttctctgcttcctgaaaatttaggggaatatatactgaggaaaaacatgcctttggcattatatatatttttaagttgaaaaatatcttccagccaggcacagtggctcacacctgtaatcccagcactttgggaggctgaagcaggaggatcatttgagcccaggtgtttgagaccagcctgggcaacatagtgaaatcttgtctctgaaaaaataaaaaaaaaattagccaggagtggtgacaagtgccttttgtcccaggtactcaggaggctgaggtgggaggatcacttgaccctgggaggtcgaggctgcagtgagttatagagagagattttgtctcaaaaaaagtcttccagtaagcttaatataccaatgaatactttttatcattactagaaacatggtagctacatgatgaaaatataaagcattaacatttgtataatttatcttttaaatgcctatttgctcttgaatgtgctctactaaaacctttgccaccaacaatcccacaaaacatcccttgccaaagtcgctgataatcttcatattgttaaatctaatggccaattcttaatcttcagtttgtctgctctattaacattatttgagacaattgatgtccttcaacttacataatatagttatttttaatttatattctaagagaacacactctggtgattttctccctacttttgtggtcaatttttatcagtctccttcacttttttctcctctctcccaattctaaatcttggagtatgcctcagtatttatttcttgggcagtttcttcttcttcttctgtattcactgccttgattatcttacataatctcaaattaaaatgttaactggatgatgttaaaagccaaattaaatctccagccctgaaggtacataatgagtcctgaagcccagactcataaatctaacttctttttcagcattttcacttgagggtctagtaggcagctctcacttaccaagctccatatcaagctcttcatctccctacttgaaacgtgttactggttttcaccagctgaggaaatgacagtcctgctctgccagctactcagacaattggttctgagtgcctaccccccaacttcatgtgtttctttccgaacactctcacttgcattcttctttagaaggactgtctgctaaggaccacagttagggtattggaggagagagttgttgcccaaagctttcaagggccagagggctattgcttttgttttcaagtccctattaatgtctctgttcatttctctcaggaatgccttgtcattttcattgtagacacctaactatttttattgatgataatagtgcaaacggtttggttcccaaatgtcattttctggtttcttgctactgacatagaaatacaagtgatttttatatgttgattttatgtcttaaggtcttgctaaattaagtgttgtagtgtgtgtttgataagttctttacgatttttcatggaaaaaaatatgttatcttcaaatataaatagtttaacttctttctttctgttcttatgccttgtatttctttttcttgtcctagcaacttcaatacaatgttggctataagtggttagagtcaatatccttcttttattcccaatctttgaaagaaattataatatttcatgattaagtataatttttgctgtagattttccagagcttttttttcttatcaaattgagaatttatctttcttggtgatatgatttggctgtgtccccacccaaatctcattttgaattatagcttccatagttcccatgtgtttggggagggacccagtgggaggtaattgaatcatgggggcagtttcccccatactgttcttgtcatagtgaataagtctcatgagacctgatggctttataaggggaaaccccttttacttggttctcatttctctctttgcctgctgccatataagacatgcctttcaccttccaccatgattgtgaggcctccccagccacgtggaactgtgcgtccgtaaaacctctttttctttataaattgcccagtctcaagtatgtctttaacagcatcataaaaacagactaatacacctggctactttattaatcaattgttttcatgtgtgtcttcttattaaattttgctttttgggacctggcttaagacaggtaggcattacaaaattgttgttagccttacatgtccaacatttttacataaaaataacacaaggcactttttacagtagggatttgttcttttatctatcactctcataagacaggaacaaaacctgtagctgattttaatctcagaaggccaaagccagttccaagctgtttgctgaaacatctttgtctatctcatttctgtgtgctttcgcagattaatgcatgtagtattcaataaatggtcaataacaacatatgacaattcaaaatatattttctgctgttagagagatggatgttatgatccatgctgtaagtgatttgcagtccatgattttagaatactagcaaaacatgcttcttctccccataaaggcaagatgaataggtcacagattgagaagacatctgattcttcaaaaattcttcttgcttcacctccttaggcctctctaagtagtattcactactgggagtgcaatgaggttgaagtagaacttctctctcattcttctaattaactgttttatcattctttttttttttttaaatctctcctgaccaatatgcaagctaaagtactgaaagtaaagaaaaagcgatttcatgcccaggagcagtggctcatatctgcaattctagcattttgggagactgaggcagaaggattgcttgagcccaggagtctgagaccagcctggggaacatagcaagaccctgtctctgtttaaaaaaaaataagaaaaatgtgaacaattagaaagctacaaatagtacaagacaaattctcactaggttttatattctcagaaacatatcaccatttttctggcaaaaatgaatgtgatacgtatggtgagaagtacaatttgttttcagtgcaagctcaactctgtaatttatgctgattataaacaaaaggaataagggtaagttaaatctcaaacctaattccattcaatagtctcaaactctgtctcaatatctgcatgagcatgattatcaagtaatcaaatttactagattcaattttggctgctttaatttacacctctctctgactagcaacattgctcatagttaatgaaatggccccagaggatgcagacatagaatgatggcttaaattgcctactaacagatgcctaagaatggaaggggcatgggttttcaaggtggttaagctgtcggcaagagcaagctgtgagtgatacagtaacagctgtgtcaggcttgaatgagaaggaatttggacatgttaggtaattattttatacttgtgtcactttagtaatacagtttagctgaggaagttgctcatttagcagacacattgtagcagttttctggattgggttgccaatcccagcaagagctccacatgtctctttgcctattctctatttcttcatctagcaacacaaaaccaccatccaaccgttcatcattttacacctggattttgccatggttaaaatagggcttcattcagtcagaataatctggatcacacaacagatattatttaccagttcagaaatctgcagtctctccatgttatttcttagaatgtcaatgtatcattctcctattaaagagacccataacaatggaaacactttaatttcaaacacatattttcttatttcatatgaccagcctttgtatcgttcttggcttaccctctcctatctcccattccctcattgtcaggctctttctcatattatctccttttgtggaacacattttggtgcttcataattattgttgcttgttcaaatttcatcttctaagagaagccactcctgtcttcccatcccagcatccacaaaccacactttgtgtccccagagggcttaatttactgtttatataactgtcataactgaaaattcattatctgtttcaaacattttgagtttgcagtgatagtggaacatgtattagtattctcattaaatgaaaaatttggaactagaagtcagtagagtagtcaaggagaggaatatacttaaatttacccactccaattgcctctctgcttctattctcagtgttttatcaccaatttctttctacagacttccctattatggtgctggactagcataatcaaaatagcaagcacagaattaagacataatataaaaaatttgaggcatatgcaaatcaactaaggaggtagttcaagtgttgattttatcattgcttcttttctggcaaggcttgggtggtgtcaaggaatctgatttttcaaaataatgtaagataattataatgtaagttgctcaaacacacacttctagaatctccaaaataaagaataggctaattttaaactggtccaacaataggggagtggttatgcaaataataatatattaaattcagtgttgtacagtcataaacatatgtggttatttaacatatagccacatgtaaagatgcatgcagaaatagaaaacacattgtaatatgtttactttccatatcactaagcagtagtttctcattttatatttttatggacatttttacttgttagttgtattagtccattctcttttataaagaacttcctgagactgggtaatttataaaggaaagaggtttaattgactcacagttctgtattgctttggagacctcaggaaacttacagtcatggcagaagacaaaggataagcagtcaccttcttcacagggcagcagaacagagtgaatccaagcaggggaaactccagatgcttataaaaccatcagatctcatgagactcactcattatcatgagaacagcatgggggagaccgcccccaagattccgttacttccacctggccctgcccttgacacatttggatcatggagattgcaattcaaggtgagatttgggtggggatacaaagccagactacattattagtcaatcacagcatctaagagttgttcttaaaatcagaaccatggacatctccctactagctctctggagggcattagacaaatcccttgagttggcaacagttgtgtggtctttacattaaaaagcataaatggatcacacacatttatttatttcttcctacacccaatgatattaagataataaaatgataaagagaagagtggagggtgtatttaaataaatcacaaaaattctgaacacagaaacacatatagaagagtattggtattgagcgtggaaagtgggtgaatcctttttcttagatacttgtagagagtgattagggcaacggggaggaaaatgatttaaccctgagaaacttgtaaatcaatgaaacaaggtacatgatagttataagagacacacagggaggaaacagaagaagaaattaaaagatgcatatcaaatttttgagcctccatctttttttcctcttcactacatggaatactaagttagtgcctggaataggaatgcatagatttcctccctaaataaagtaaatgtgactgcatacaaattaaaaccatcttcattaaaaggaaaccagcaagtaacaaacaagtaagaaaccacggactgggaatgtttatatttgtaacatatacaagtgactaaatgtttgtacctaaaatatgtaaagaatttctaaaagtcaatataaaagacaaacaactcaatctaaaagtggccagaggatacagacaggtttgtgggaatgaatgagcctgattagtacttatgaaaatttaaattaaaataataatgcactgtcctgtaactgaaactataaaaagaggaggggaaattgtacactaacctcacaaaagtagttatctctagaaaagaaatagaggtagtaaatagaaggtagaaagaggtcaacggggtgagagttatatcttttgcattatattgtcttaagcaaaaacctctgaagctaagcagaaaagaaataggaaaggatggcagggaaaagacgggtagggaagaagaacttctcaggtaattatagagatgcttttaaattacagtactttatgccttgtcttctgcctcttcatacatgaaaagactttgtagaataaactaatgtgtttattagggttatttctgatagaacatgcccataggtatgcttacaagataccctgtgattggaatctacctttaaataataattttctcttaatataaagatggacatagaaattactgtctgcaagcctagttataccatttccataaaaactaacattacctatatattggcagaaataaatttcatgacattccagaggactttgctttgctcacagaattctgtagtacaatattttgaatcccaccatgcaaaatgcattaaagaagccaggaaatatttctcccaaaatttatcactattcttcttagcacgatgtttgcacaaaatattttacctcctgtgcgccatgatcctttaggagggaaatatctaggtgatatgaatgatgtttatctacaaggtatgtagagagatgtctggatcccttgatactttctagtgtcctggctaataatataggtaccaagaaatacctgcaaaactccacagaaatgactgagaagtcaagtgagaaattttgaaggtctgggtgtgataattcccacaaaaataagagaaaataagggcaaatgagatgtaaagaagtggtttcagtgaataaactggaagctattcacctttgtcgacagaaaacatatttgaagagacaaaaacccaaagattatgctccaaactagctattctgtttttaactgtccaaatctactgtggcatctcctttatggatattggttttaattattatccacctagggaactgaaactgagtttcctaaataagaaaatatatagtttttgttttaagaaaagctatttaatctatcttagaagtaagggtagatgaaggaaatgcatttactccatcttacaattcatgtttcattaggctgcccacaggcattctgtgtttatggtctgctgcactccacaataaagctattattcgtgagcacttccctgctggctaaccacattttggctactgcttatgtttatttatgagtctcgcttgggaaaggatttgcaaagtctgatggggagtcctcacatgtatgtttacacttctccaggcttaggtatctcgagaagggaagtggccacagtgtcaccagtctccagaatgaattatgcagcaggacacatcatcgataaccagatagaacactccctcaatatttaaagggcaatggcaatgatggaaagaaggaaactgagatgattccagttctgtgggatcactggattcaagcaacattgagaaataatttttctgctcaatccttaccaagcaaaaataatcatcagggagaaaaagcagcattatctctcccagggagagtatgacataagatgttgccactattgtctctgcagctcaggtttctgcttcctgaccattgatttcctgcacaggtaaagaactgtattaattggggttcttcaaacaataggatatgccaaagaactctatctatctatctatctatctatctatctatctatctatctatctgtcatatataatctacatatcttagtccatttgtgctgctattacagaataccatatataattataaacaatatatttttttctcacacttctggaggctgggaagtccaagatcaaggtgctagcaggtttggtgttatgtgaaggctgctatttgcttccaaagtggcttcctattgctgcactctctggaagggacaaacactgtgtcttcacatggtggaagggatgcaagggcaatagtgtcaaatgctgtgtgaagtctcttttataaagcctttaatccctcataagtgctcatgacctaatcaccttctaaataccccacctcttaatactattgcattggaatagtgttgtttcaacataaattttgaaggaacacaagcattcaaatgatagctcactcactgtatctatctatctatctatctatctatctatctatctatcatctatctatctatctaatctattgaaaaagagtgagaaagagaaaaatttactttaatgacttgattcatgtaattgggggtctggcacgtctgaattccataggataagatgacaggcaggaaactcaggcaagagtttcacagattcctactttgctgtttctcagtgcagaggtttattctttggactttcaggataaaccaaagctaggcacttctgtatgccagtcagcaaggaatcattcttttgtggtgtgcagagcgtataatacccattgagaatggattgtaaaaaattcaagagggttcctgtgctagttattaagcatttatctctcagttccaaatccaccatctatattctccacggtgatgatggggcaaatgtctttctcctttgtcagttgactctatatttagtgctaccaatagggggacctagaagatattggcggacaggaagaggtgagaaagaacttactacatcttgtaaggttgctattgctgtctccttcactccagcaacggcacttaacctggcaacatcagttggttccagtgtctgtgtgtctcacctgcacacttagtgacctttgccttgccagcttgttttttagccccaagattcttgctccaccacatgtttggggtcctggacactccagtaagctcttcctggatccacctcttagaaaagaggtactgggttagatatgatagcatttatattttgtgctatgacacttacacattctgacataagcatgtggaatttcttgttattttatttcccagggttaattttgtatatgtgtatgaagacaaaaaataggatgtctttttttgtttgtttattggtagctaccaagatacccaagattgattgaccagtgtttgttgatgacaccaaataatgttattttacaaggcctctttaaaaatgttagctttctgaaactgaaatatttatttaagcatcagacagataacacacacttcaccaccacccctcccccattcatttgtatcatcaattaaaaaagcttagaaaacataaaactttaatgcttattttaactgaaggcttgtgggctaacatccacagtttataaatggcactttggtattttgaagctaaacattacaagaagtctacgcatgatgttcaaaagaaggaatgataaaggtagctttaggaatgtaacatcaaatcccaacatttctgtctggcttgaaaatctttccaaaaattcggcagttttttgaactgttcaatcattatgtttgattaaagtggcccaatttagttttaggtagatacacatggcattctacacgtggcttagaagtttttgattgaaaggggaaaaaagggcaaatctcttgatgttcgattttttttttctttttttgagacagggtcttgctctgttacccaggctggagtatagtggcatgatcacagctcactgcagcctcgacttcccaagctcaagggatcctcccaccatagcctcctgagtagctgggatcacaggcatgtgccaccacactttgctaatttttaaaatttttatagagtcagggatcttgccatcttgtccaggttggtctcgaactcttggcctcaagcaatcctcctgcctcagcctcacaaagtactgagatagcagggataagccactgtgctaggttgaaactatttttaaatttaaacagttttaattgtggtaaaatacatgtaaaattttccatcttaacagttcagtagtgttaagtgtagacatattattgtgcaaccaatctctacaacttttttatgttacaaaactgaaattctttacccaaagcaataattatccaatctcttttcccaacccctggacactaccattctattttctgtttttatgaatttgatgactctagatatcttatgtaaattgaatcatgatgtagttgtctttttgtgactggttcatttcatttagcataatgtcctcaaggttcatccatgtagtagcatgtgtcagaattttcttcctttttaagtatgaataatatttctttgtgtgtatacattatattttctttatccattcatctgtcaatgaatacttgagttgtttccacttcctgactattgtgaacaatgctgctatgaacatgggaacactgatactttttcaggactctgatttcagttcttttgaacacacgctcagatatggaattgctggatcatatgataattcaacttttaatttttggaggaacctccattaaacagtagcaactacaccattcccaccaacagtgcagaagggttttacattcccaccaactgtgcagaagggttccaatatttccacatccttcccaacacttattttctgttgtttgtttgtttggtttaaacagtagccattcttatgggtatgagatgatatctcattgtggtcttgatttggatttccctaatgactggtgatgttgagtatcttcccctaagcttgttggccattttcatgtcatctttggagaaatgtctattccaggcctttgtgcgttttaaaatcagaatattttgttgttgctgtggttaaattgcaagagtttttgtttgtttgtttgtttgtttgtttgtttgtttggtatcctggagagtaaccccttatcagatatctgatttgcaattcttttctcctgttccataggttgctttttcactgtgttaattatattatttgctgcacagatgtttttacgtttgaagtagtttaaattacctatttttctttttgttccctgtaagaaactatttttaagaaattaggaaacatctcaagatgaagtcattaagccaagctgaatgaagacaagaagttgtttcacagatctggctgcataacatgctcgagtcttcctcctagtgggtgagtatggaaactactgacagtacaatgttctccaactagattcagaagattcccaatacattcagttcttctgttctcttatctcaagcaaacactaaatttttgtggttggttcaactcaggaaaagttacattgtcaaatttgattcaacacaggtgtcagaaacaaaaccccaaaactatatactctaaatttgcattttgttgtctataagttcaatttaaaagtcaaagtaatgttaccatgagtaaaattttcacagtgagcaagaaaacaaaatcagccacccctcaaactaaatcaaagtggcagagatgatttaggtaattatttttaaactgaacatctctctatcgttggatataaccatgccagagggtccatttggaagtggcccagatgaaacatgccataaggccagaaactgtaattcaaaagttctaaatgaaaacactcaagtttcattgaggcaagaggcttgagtgcacaatagcaatacaagcagctgtttttgccactcagccttaagcctgagtttgtttctttcttttcttttctttcctttttttttttttttttttttttgagatagaatctcactgtgtcacccaggcgggagtgcagtggtgctatctcggctcactgcaacctccccctcccgggttcaagcgattctcatgcctcagcctctcaaatagctgggattacaggtgcctaccaccacacccgtctgatttttgtatttttagtagagacggggtttcaccatgttggccaggctggtctcaaactcctgacccaggtaatccacccaccttggcctcccaaagtgctgggattacgggcatgagccaccacgcccagcctgggtttgtttctaacatgtgtggtgtcaatgtctggtgtcacctctaaaaaatgctgtttgcatgtaagctgcagttgggtctttgagacttgcttttgaaaggatgctggttagtgtgtttttcctcctcttctctgggtaacacaaataaggagctgtcactcataaagtcccagacaccaattaaatttccagcagttgcctatgacatctcccttcacagggggcctctgaattacatgttgtcatagtaagagcctatgatcttggccatgctgcctcagctcctggctctcgtattgcacttaaaagaccaatgcttgcttgtgtttcatctttccttatgcagtcttggagcatgcattatgagtggctgattttctttttttttttttttttaattatttatactttaagttttagggtacatgtgcacaatgtgcaggttagttacatatgtatacatgtgccatgctggtgcgctgcacccactaactcgtcatctagcattaggtatatctcccaatgctatccctcccccccccgccccaccccacaacagtccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcatcattttttatggttgcatagtattcaatggtgtatatgtgccacattttattaatccagtctatcattgttggacatttgggttggttccaagtctttgctattgtgaatagtgccgcaataaacatacgtgtgcatgtgtctttataccagcatgatttatagtcctttgggtatatacccagtaatgggatggctgggtcaaatggtatttctagttctggatccctgaggaatcgccacactgacttccacaatggttgaactagtttacagtcccgccaacagtgtaaaagtgttcctatttctccacatcctctccagcacctgttgtttcctgactttgtaatgattgccattctaactggtgtgagatggtatctcattgtggttttgatttgcatttctctaatggccagtgatggtgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattttgtgggttgcctgttcactctgatgatagtttcttttgctgtgcagaagctctttagtttaattagatcccatttgtcaattttggcttttgttgccatcgcttttggtgttttagacatgaagtccttgcccatgcctatgtcctgaatggtaatgcctaggttttcttctagggtttttatggttttaggtttaccatttaagtctttaaaccatcttgaattgatttttgtataaggtgaaaggaagggatccagtttcagctttctacatacggctagccagttttcccagcaccatttattaaatagggaatcctttccccattgcttgtttttctcaggtttgtcaaagatcagatagttgtagatatacggtgttatttctgagggctctgttctgttccattgatctatatctctgttttggtaccagtaccatgctgttttggttactgtagccttgtagtatagtttgaagtcaggtagtgtgatgcctccagctttgttctttttgcttaggattgacttggcgatgcgggctcttttttggttccatatgaactttaaagtagttttttccagttctgtgaagaaagtcattggtagcttgatggggatggcattgaatctatcaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaaggtggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgctggttttcaaagggaatgattccagtttttgcccattcagtatgatattggctgtgggtttgtcatagatagctcttattattttgagatacgtcccatcaatacctaatttattgagagttcttagcatgaagggttgttgaattttgtcaaaggccttttctgcatctactgagataatcatgtggtttttgtctttggttctgtttatatgctggattacatttattgatttgcgtatattgaaccagccttgcatcccagggatgaagcccacttgatcatggtggataagctttttgatgtgctgctggatttggtttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcagctgtgaatccatctggtcctggactctttttggttggtaagctattgattattgccacaatttcagctcctgttattggtctattcagagattcaacttcttcctggtttagtcttgggagagtgtatgtgtcgaggaatttatccatttcttctagattttctagtttatttgcgtagaggtgtttgtagtaatctctgatggtagtttgtatttctgtgggatcggtggtgatatcccctttgtcattttttattgagtctatttgattcttctctctttttttctttattagtcttgctagcggtctatcaattttgttgatcctttcaaaaaaccagctcctggattcattaattttttgaagggttttttgtgtctctatttccttcagttctgctctgtttttagttatttcttgccttctgctagcttttgaatgagtttgctcttgcttttctagttcttttaattgtgatgttagggtgtcaattttggatctttcctgctttctcttgtgggcatttagtgctataaatttccctctacacactgctttgaatgtgtcccagagattctgctatgttgtgtctttgttctcattggtttcaaagaacatctttatttctgccttcatttccttatgtacccagtagtcattcaggagcaggttgttcagtttccatttagttgagcggttttgagtgagtttcttaatcctgagttctagtttgattgcactgtggtctgagagatagtttgttataatttctgttcttttacatttgctgaggagagctttacttccaactatgtggtcaactttggaataggtgtggtgtggtgcttaaaaaaatgtatattctgttgatttggggtggagagttctgtagatgtctattaggtccgcttggtgcagagttgagttcaattcctgggtatccttgttaactttctgtctcgttgatctgtctaatgttgacagtggggtgttaaggtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttgatttaaagtcagctttatcagagactaggattgcaacccctgcctttttttgttttccatttgcttggtagatcttcctccatccttttattttgagcctatgcgtgtctctgcatgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtctcgatggtctttacattttggcgtgattttgcattggctggtaccggttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagagtttctgctgagagatccgctgttagtctgatgggcttccctttgtgggtaacccaacctttctctctggctgcccttaacattttttccttcatttcaactttggtgaatctgacaattatgtgtcttggagttgctcttctcgaggagtatctttctcacgttctctgtatttcctgaatctgaatgttggcctgccttgctagattggggaagttctcctggataatatcctgcagagtgttttccaacttggttccattctccccgtcactttcaggtacacccatcagacgtagatttggtcttttcacatagtcccatatttcttggaggctttgttcgtttctttttattcttttttctctaaacttcccttctcgcttcatttcattcatttcatcttccatcgctgataccctttcttccagttgatcgcatcggctcctgaggcttctgcattcttcacatagttctcgagccttggctttgagctccatcagctcctttaagcacttctctgtattggttattcaagttatacattcgtctaaatttttttcaaagtttttaacttctttgcctttgatttgaatttcctcttgtagcttggagtttgatcgtctgaagccttcttctctcaactcgtcaaagtaattctccatccagctttgttccattgctggtgaggaactgcgttcctttgtaggaggagaggcactctgctttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtctgttggagtttgctagaggtccactccagacttgtttgcctgggtatccgcattggtgtttgcagaacagcagcttttcgtgagccgcgaatgctgctgtctgatcattcctctggaagttttgtctcagaggagtacccggccgtgtgaagtgtcagtctgcccctactggggggtgcctcccagttaggctgctcaggggtcaggggtcaggggtcagggacccacttgaggaggcagtctgcccgttctcagatctccagctgcctgctgggagaaccactgctctcttcaaagctgccagacagggacatttaagtctgcagaggttgctgctgtctttttgtttgtctgtgccctgcccccagaggtggagcctacagaggcaggcaggcctccttgagctgtggtgggctccacccagttcgagcttcccggctgctttgtttacctcagcaagcctgggcaatggcgggcgcccctcccccagcctcgctgccgccttgcagtttgatctcagactgctgtgctagcaatcagcgagactccgtgggcgtaggaccctccgagccagttgcaggatataatctcgtggtgcgccgttttttaagcctgtcggaaaagcgcagtgttcgggtgggaatgacccgattttccaggtgccgtccgtcacccctttctttgacctggaaagggaactccctgaccccttgcgcttcccaagtgaggcactgcctcgccctgcttccgctcgcacgcggtgcgctgcacccactggcctgcgcccactgtctggcactccctagtgagatgaacccggtacctcagatggaaaagcagaaatcacccgtcttctgcgtcgctcacgctgggagctgtagaccggagctgttcctgttcggccatcttggctcctcagagtggctgattttcaagaggacatgaagatacaacaaatggtgagtgtcttgtgatggagcttcctgtattttgaattacactttctagctggattctacttacctaaaacacacacacgcacacacacacacacacacacttctttttagctgttggaaaaaaatgacctctatactattgattcctccataattttccagcccttaataatattgtatttatgggacaaaatgactgttgcctcaatcttgcaaaccacaagactatgaactttatgtagcagagtttttgtgcatggcttacttaaaatctttcctcctactttggacaattctttgggaactatattattctgttccttgtggtcccagttagactgtcagtccaggtaggggatttagggttagttataaggttgatatgacaatggttataaagggtttccctttggttgattatagaacattttactaggaggatgtctatttatacctccacaattaagactataacatgtttggccagcagggatttgcaagtttttaactggtaaatcacaaggagtacttaatttcatgcttttattagaaagtgcctacagaaggaaaaaggtaacaataacctggtagagcaccatacccagtaaagatattggtgccctgaaattgagtaccatgcagacatgcagacatgcatcagaagctacttccaggcagtacatttccagctgggcagtgtttatccactgtcttaagaaaaaataactgcaaaaagtgtttttccttgtaagtccaaagagaaccagtaaatatttaacaaacatctatttattgagtagacagagattagtcatgatctataatttaggaattaacacaaaacacatattttgtgtggtaaggaatactgaagagaagaatcctagaagttcagccttttttttgagaaattgtgtggtgtagcattcaagcacagtacatactaatttttaatcagttgagtatgatcattgctatttcgaaatgggattgtttccaaagactaagtgcccttttccaattgaaacagttcctagaaaagcaaaaagtcttgggctggcagtaaccagaagccatgctacttgctttagagtgcaatcatccagaaggcaaggtttaaaaaagtaactaaatttaatctgcaagcatccagggatttaatcaatgacttcgttgtgattcatatgcctgctgttggaagagtagaatatctcctatttcctccgaaaatgtccatgctacatcttacactagtgggtctatttcatgcctggagatttgaaaagtgaagtcatttaagagttttagtgtatggctcaattctgtctaaatttagtggtgtaccagggcttctccatgtcgctcagaatctgtgatgggcttctctccatgggcaattccataaaaacagcactttggctgacatgagataaatttaccagaaacaatattttgcagcaaaccagaggaagcaatgcaggggcaatttccaaaggtgcacagctggtgaggatgtgtgtgcaatgctgttgttatgaagactctaaatctagaaagatgcctaattctaagtcattcatttttggtcaatcacttttagcctctttaaatttttaggcatcattttagctcccttaatggaactgtcatgcatggatttttctagtacttagttgaagttatttatatttgcagtctgcctctagttttcaaggttatgatttctgccaatgtggccattgctacttgctctgttttgttaacttatcctttctctgtttgttctaaatttccctctttcaagatataagggaaagactgttgtcctggcaaactgagatttagtgaacatgtttgtgttcatcacagccctaccttttatgagttttatagacttcagtcatatcccctgtcagcttcagtgtttgcagatggaatcatactaagcctctaaggctgtctgcatacagcaacggctctggacttttaatcatcctgttcttcttctttgagcctttttctgctgtgtttttattttattgaaatgcagagacctggacagtgggcaatatccttactgcaattttaaatatatatatttcaaatatatatacacttacaaatatacatatattcttttatgtatatgtatacatatatacattatatatcataatgtatatagtatatatgtatatacctaatatatacatatgttgtgtatgtatatattgtacataacatacagtgtatatatacatatataagtgaatatgtgtataatcgtaagtatatataatttgtttatatatacatatatagtatatatacacattgactataggtatatttataagatatctgtatatttataatatatattcatttgtatacatgtatatatgcatatacaagtgaatatgtattcacgtatgtatatatgtgtatatatacacacacatatatgaatatatatggatatatattcattttccgtaaactttgtggggaccattctcagaatatttaatattttaccagcgttttactaatcccaatatgtgtacatacttaaaaggtgaaagaatgacctcttaaatcaaaatttcctaatacgaatttactgtgagagataaaaggatttgaagccttatacaaatgtagactatgcctacataagaaatagatttgacactccacctgtgtcttcttggagtcagctggtgttatatccaatatatcctgcagaagaggagcccttgctaatgtggatggccctcccaggtggccagcattttctggaattctcctgttgggtcaagatagttagaattgccaagttagtttgaggatgccaaactgctgtaacgaataaaataaaaatgaataatgttctggcttaatagaagttgtcttcttgctaacaatctaagatgtggtacctagttatcaggattggatggaaggggttctctgctccaagcaatctttttttaaaaaaattgacaaccaataacagtatatatttatggggtacaaggtgatgttctgatatatttatacattggagaaagaacaaatcaagccaattaacatatcaatcagctactcttttagcaattttgaaatacaccatgcattattaactatgttctccatgctgtgcactagatcagtgaaactttcttcgaactgaaagtttgtaccttttgaccaacatctcactgtttccccacaaccagcccctggtaaccaccattctactctctgcttcagtgagttcaatatttttagattccacatgtaagtgagaacatgcagtatttgtctttctgtgcctggcttatttcacagagcataatgtcctccaggttcatccatgttgttcgaaatgacagaatttcccttttatttaaaagtttatctagtgttccattgtgtatatataagccatattttctgcatctattcatccgctaagggatagatacccaaaaattggattgctggatcatatggtaattgtgtttttaattttttgaagactctttatactgttttccaaaatgctgtactaattcacattcttaccaactatgtataacggttcccttttctccacatcattgccaacacttatctttcatctttttgataatagccattctaataggtgtgaggtgatgtctcattgtggttttaatttgcatttccctggtgattagagatgttgagcattttttcataaatctgctggccattcatatgtcttctttgtagaaatgtctgttctggtccttttttccagtttttacttgtgttgtttgttttactgctattgaattgagttccttatacattttggaattggccccttatcagatgtatggtttgccagtattttctcacagtcatctgtggtttgtctcttcactctgatcattgtttccaagccatcttttcaggactcatcttcaatgcatggtgtccaaggtttccctgtggggaagtggtagggtttatttctatcccaggccacagaaagtgagagaaacacagaggaaattcattggagaaatttgtgagccagtcttggaagtggcacacatcacttctgttcattaactattgtctagaatatgtccaggaactgcacctaactgaaagataggctgtgaagtactgtttggccaagtgccagtgaaaaagaggcaatcgatttggtgaagaagtagccatcttcctaatatctacattgtacattttggctttagtcttttcagcatgggtcccatatttcaatgcagaccaaagcttcaattttggaaggtctaggggaaaccaaggcaataccggaacaagccaaagtttagtgcctaaggaaatacagttgggtgtggaggtaaatgccacatcttgcttatgccaaacatcagagaaagactctattgtttatttttttgcttgttttgagacagagtcttgctctgtcacctcagatggcgtgcagtggtgcgatcgtagctcactgcagcctcgacctcctggactcaagctatcctctcacctcagcgtcccgagtagctgagactacaaccaccgccaagacacccagctcatttaaaaaaaaatttttttagtgacagggtctcgctttattgcccaggctggtctcaaactcctggcctcaagcaattttcttgccttggtctcccaaagtgctgaggttacaggtgtgagcctccacacctgggcatgaccagatttttttaagtagatggagaggaaggtcagaaagttaaatgtgtcacaacttgaaatacaaagctttgtgaggactaatcaaaaagctgagccaagaagagcaggctgaatattctcctgactgcagggaggagagggaaagactttcatatggccaaagttataaactaagccaatacttgggagaattcatagaaacctctgctttagttccaggtttatgtatctttaaatcttatgacaaattaatctttccctgaatgttttagtaacagaaacataaatccttgttgtgaaatcactatttgtatatccttgtacctccttcctttgatttcaggtgtcatttccatgcagatacatcccactgtacattgacttagtttctagtttctaatttccaactctggttgaatagtttcaccttgagacaccactagctcttcaatatttttcttctgaacaagtacaaatggcaatagttaaagaaacatgaatatatgaccagggagatgctaagtgctttgcctgaattaattcaaaatcataaaaatccccatgacctaggaaatattatgatccatatttcacagagatgaaactaagggttagaagttaaataaccttgtctagctcacatctttggagcaaagatagagctggaatcccaaaggtaagctgtctgaagaaaagtagccttaatttatttcagttgtgaaaatcacatataagttatttgtgccacactcattgggcagctcttcctgaatcaataatccttaaccctcaggcagggcaagcacgtttttgaacagctttatctattgcctgtttcttatgttcattctgtatttcagccaacctgattatgccttcctctttctattttttttcaaagacaaggtctcactctgttgcccaggatggagtgcagcgatgtgatcagagctcactataaccccaaactcctggactcaagcaatctgcccctcagactcccaagcagctgggattacaggtgtgcactatcgggctcagctaatttttaaattttttgtagagatggggttttgctgtgtttcccaggctggtctcaaactcctggcctcaagtgaacctcctgccttagcctcccaaagtgctgggattatagtcatgagccactgcacttggctttgttctttgtatttttacttaaaacaattcacacgaggcctgacatggcagctcacacctgtaatcccagctactcaggaggctgagatgggaggatcacttgagaccaggaagttggggctgcagtgagctgagatcatgcctctgcactccagcctgggtgacagagcgagaccttgtcccaaaacaacaaaaactccaaaaaccaaaaaaaaaaaaaaaaaaagaccaattcacatgattatacatctcctttttacacagttatagatatcaaaagcagctcataatttaagattaagttaaatactacattttccacctgcctttcttaattatctcagcccaagtcacatagcttcctctgaatttgacagttactgataccatgtgctacctagtatcaacaatggaatttctctttagcagactttaaactttttatgaaaaacccacataattaatggggggtgtccccagtagatgctaaataaggattttccaccttggttaagaagggttttattgtttctggtaaggcatatctaatttatctatttatctcctgagccatgattcatggtggaatattaccgccacctggtttatttcttgccaaaaaagagtaccaatactgaagcctctaatgagtgattctcaagtgttttccaacctccgtaagttagagatagatcagaattacctgtgtgttattgttttgagactgttgactcacacacttgatgctgagatgaagtgggacataatccctgatttgaaactagcagttatattgacctgttgttatcagtgagaacctgttaactttttaaaggaacaaggcaagttgctttgggaaaaatgtttaaggaaccacatgtctaaagtctaaagtacaactaccaagttagcagtctaagtatatataattccatcagtggatgatatttgatgctttgccatttttttttctcaaatctgtatttttgttttttcttattttcttacttatgtcctctgttttacttgatggctcaaatattattggctttttccctcctctggttatttagaaattatatcaaacaaaatatatttggatacttagctctatactagcatcaactgccctctgccccttagtaatgagagatttagcacaatcttcagtagcatttaacttcactttgcatagatttgtattaaaatgaattgagtttttagatcaagactagtgtaaccatgttagttacaatgtattatatatgttatatataacatatttcattatgttttaatgtataaatgctacatcgtttttttctcttctaagatttagttttggctcttgtcttatgcttagtcaccatgatatcatccagtgttcagacattagccaagagtttcactgttccgttgctcactgaccttttgtttatacgtataacttctcttcatggggatattaatttgattcatctattagcttattggagtacttgagtattttaaagatcagcatccatttaaaattcttgcatgacagaatattttccttgtttggttgtagaatttgtgagttacaatgctaggtccccaaatcctcatgtccttttcacagcttatactttggaggagaattatggacctaacttgatattttctcaaagaaaatatcaaaaatatcaaaatatcaaaaatatcttatttcttaaagatatggaggattgaagtcttcatatttgtgaggaatggagaagttcttcttcaaagtttcttaaaaccataaagagcttggcatttctttgctctatgcatgtctatatatgttccagtggagctcttctgacttgacctggcatgcctggacaggcttaagcgagccccgaaccatagtgcatgacattccttatttggaaaccctcctaaccctctcatgactagcttcctcttttctttgttctctttcccctttgcctctttagaacagtttcaagctgttagccaatcgtgtcaagcttagaaggtgaggtcctgttccagccaatggaaatgggacacagccataggacgattgcatcaggttacaaagattataaatgtccctgtctcctttgtttgggtgtgctctcatggcaagactgctagcaagagggcaccctttctgcagaaaataagctagccttgctgagagatcctttgtctcagtggtgatttcgtgacaccaagcacccatttccaacaatatttttttcatggctttgaatttaagcattttctcaagatatatttaggcatgggtttagtttaattaatttagagctcccactgacgtgaagatgaaagactccttttttttacagtatgacactatagcttagctaactctatcaccatgtctagttcctttcctcttaatttgcctctttccaaaggctatgaaaataactagattcatctaccttttctgcagcgatgagtgtccatgtgctgtgagagtggccaatgaaacatatgtatcatttattgttgtccgtttttcttttcccttttatttctgcttagaaatttagcacgatatctataggctcagcagacattcgatgaccatgcagataaaaccacttgtgagtaaagacagaagaagtcaatgtcataggtacatttcttgaataaccataaacacaccaatccctatagtttccagagatgaatcaaccttgtattcatcaggtttccctagagaaagagaaccaataggatggatagatgattgatagatagatagatagatagatagatagatagatagatagatagaataaatgaatgagtagaaggtaagtaggtaagtaggtaggtaggtaggtagagagatagatggatatagagatagatgaatagatatagatatatagatagatatgatggatggatgaagaagtatatgtgatagatgaatagctaggtagctgaatagatagatctgatagctagctggatagatagttaaatgtgattgatgaatagagagatagatatgatagatggatagctaagtggctggataaacagatctgatagctagctggatgaatagatagatagatagatagatagatagatagatagatagatagacagacagacagacagacagatagatagaatacatgaatagataggtgatagatagacaagtagagagagatatggagagatggatagagagatagagaaacggggatttattggaggagttggctcagacaattaggaggctgagaagtcccaccacaggctatctacaagctggagaaccagggaagctaatagcatggctcagtccaagggacttccctcagaaccagggaagctgatggtgtaattatcagttcagcgctagaggcctgagatcccgcagacaataagcagagtgagaggggcattgttggttcaagtcctggagtccaaagggtgaagaagctggggtgatgatgtccaagaacaggagaagtgtctcccagctccacaagagaaagattatgcaaattcatttgcctttctctgttttttcttctatccgggcctacagatgattgaatggtgcccacccatactggatgatggtggatccttactcagtccactgattcaaatgccggtctcttccaaaaactccctgacaggcacaccctgaaatcatgcttgaagagctatctgagtatctctcaatccactcaagttgacatctaaaactaaccatcacaaaccccttgtctatttaagttaccctagcagagctttgtgtgactcatagccaaaggatatggtaacagctaaaggaagtcctgacacatggtttttcatacatctgtgtttggagtcaagaccaaatactctgtatctactactgtatctaagaggaaagtcaccgtggccttcaggtctgcacatttacacacaaagttcaaagatcctaatagaaaactatcaattgtacttttaaataaggcaccctaaagatattttgtaacatatctgataaactctaggtcattcacctctaggagttgtgtagtttcaatgctacaaaaacttttcagtgacaaaaatggctttgctttgctacaaaaatttttcagtgacaagaatggatttgctttgctacaaaaatttttcagtgacaagaatggctttgctttgtgaaaatattgatggggtttctggtcaatgcattggcacttaatttctcctatgtgtaaagacatatttcagggtttgcaaatagtagcttccatcccaagtcattcaagaaagaaaatgcaactactgaggatgcttttaatcctcagtaacgtgcatttgaaaaaccacatctaaatggtttgctattggcctgagtgacagatcaatatagcgagcagaatgtcagcaaaaatgaccagatagacatgggaatttagtcaatgttagtgttatattttagaaacatgaataattaaaaaaatacagatgttggggcaactaaaaaaccatttggaaaaataacacaactggtattcctttcttacaatttgcaccaaaataaattatatgtaatgtaaacatctacttaaaaaatgaaaatatagcccaggtgcggtggcttatgcttgtaatcccagcactttgggaggccgaggcgggcggatcacgaggtcaggagttcaagaccagcctgaccaacacagtgaaactccgtctgtactaaatatacaaaaaaattagctgggcgtggtggcaggcacctgtaatcccagctatttgggaggctgaggcatgagaatcacttgaacccaggaggtggaggttgcagtgagctgaaatcgtgccactggactccagcctgggtgacaaagcgagactcagtctggaggaaaaaaaaaaagaaatcatttgatagctttttgagggggtaagaggggcttggaaacagcttttcttatcactgttaagcccagaagtcaaaaagaaaatgtattataagttgatgtcttccaaatagtgaagtctgtctctctctctctctctctcacacacacacacacacacacacacacacacacacacactcaccattgcataagcaatctaaaagtgaaatgaaaatttggagggaaaaatagtacttagaacagtatgtctagttaagttgcttttctttctaaaataaggtctcttagaaataaaaaagaaaaagatcacaactcaagtcaaatatggacaagagtatgaacaagaagtttaaagaaaataaagtaccaatggcgaatgacaaagattctctgtctggccaaactgtagtcaggcttctgaatcttctcctaggcccacctgtgtacctccctgtaaaatccagttttagcagagaaccctgctaagtcagtttggcaggaactccccacactcgatatcctatcaccctcaatacctgagtgagttcctcatcctccaccctccccaggtgatatctggtgactctggcctgtcttcagctagaatcctgttagatgggtttatccagaacctcctttacccctgatgtttccttctagtcattttccatccaatgtccaaatttctactgaccctccctctgctccttggctataaattcccacttgcccatgctatattcagagttgagcccaatctctctccctcactgcaagaccccatactgtctttctcctccttcttctctcttctccctccatcctttctcccagacctccaccccatctcttcttcctcttcctcctcctttcccccacgcaatgcaaatttccaggaagaatcggaaaccgctggtttccatggctatgggccctacacctaactcaaaggtcctgattaaagtcttccttaccatgctttaacaagtatcattgaatattattttctttaacacaaatatgcatagaaaatattcaattctacggaacactgaagaaatttttaaaagctaagatgctttttacacctattagattagcagggatcaaaagtggggtaatctcagtgttgatgaaaagcacaggtgaagattaggcagggccacgatgcccctgctcactgaaccctacttgaaaacaacctctctggtcattctccaggctgtgctgtggcttgggcaaaaactgaccttgacagagaccctgagatccatcaaaaagccaaacatgagtctctgcctttgttcattcccaatgaaattatttgtggtataacacaatgcatgcttacatggtcattattagaactgagcaatgcaaactgtgatttgcttttcatgttgttaaaaataataactgccagcaaggtgttaaatttagtacaagacacagcagctgttcaactcatttttgcaaattattttcatatatggcttacaaagtaccaccactctgaggtaaacacagtcctgtagattgtaagcatttaagctgcgtgacagatggctgcttctcatttcttgatgtgttttgtaatggaaatttaatggggaaaatgctaataataatgctgttaatttactgccttttccctaggagcttcaaacacttgacaaacattacataattaatggttaaatattatacaaacattcacgggaagtgggaaagaagaaaggagttgaagcgtcattctgtggttgcaaacaacgtggtgttgtgttcacatgcaggtgctctcccaacacaaagacaacttaactcatgaaccgctgctttatgagcagcggtttccaattcttcctggatattcgcattgcatgggagaaaggaggaggaagagacagggtggaggatggggagaaaggatggagggagaagagagaataaggagaaagacaagaggcaatagcattctaatctcctctgacaaacacccttcacaccctaatttaattcccatgagttggaggaagtgatcctctttttaaccacagctaggtacgtctaatagatgagacttctccatccttatgctcagatactccaccctaattgtgatggttaatagttaatactgagtatcaacttgattggatggaaggatacaaactattgatcctgggtgtgtctgtgagggtgttgccaaaagagattaacatttgagtcagtgggctggggaaggcagatccaccctcaatctggtgggcacaatctaatcagctgccagcaaatacaaagcaagcagaaaaatgtgaaaggagagactggcctagcctcccagcctgcatctttctcccatgctggatgcttctgccctcgaacactggactccaagttctttagttttgggactcgggctggctttccttgctcctcagcttacagacagcctattatgggaccttgtgattgtgtaagttaatacttaataaactcatatatatatacatgagtttatatattatatattttatatatatattaactaatatatcctattagttctgtccctctagagaaccttgactaatacactactttgtaaagtcaatgacagaactcaaacacacttgttgcatcctccattaaagacccccgttagcattcatatcccttcttaagagagatttggccaggcactggggctcacgcctgtaatcctggcactttgggaggccgaggcaggcagatcacctgaggtcagaagttggagaccagcctggccaacatggtgaaaccccgtttctactaaaaacacaaaaattagccaggcacagtggcgcatgcctgtaatcccagctgctctggagactgaggtaggagaatcacttgaacctgggaggcagaggttgcagtgcgccgagagtgtgccactccactccagtgtcggcaacagagggagaccctgtctcaaaaaagaaaaacataaataaagagagagtagttttgggtacaagatttccaaacctcaaaatcaagagttatggcaaccttcaagtcttgcttgtctcaccaatgtggtgagttttagcgctgcatgaagctaaagtattgcctttgaatggaggatgtggaccacattccatccttggccgaaggcagaacgcacccaggattgcacagaatcataaaaaacctgagctgtaggaataaaatgtggttccctacagtggatgcctttcattcaaaattccaaagcaagccttcagaaggattttttttttttttcgaagctgatgttttaattttaattttttttttatttttttttttaattttttttttaattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacatcttgcaccgcccttaatccattcaaccctgagtggatacagcacatgtttcagatagcacagggttgggggtaaggtcacagatcaacaggatcccaaggcagaagaatttttcttagtacagaacaaaatgaaaagtctcccatgtctacttctttctacacagacacggcaaccatccgatttctcaatcttttccccacctttcccccctttctattccacaaaaccgccattgtcatcatggccagttctcaatgagctgttgggtacacctcccagatggggtggcggccggacagaggggctcctcacttcccagtaggggcggccgggcagaggcgcccctcacctcccggacggggcggctggccgggcggggggctgacccccccacctccctcccggacagagcggctggccgggcggggggctgacccccccacctccctcctggacggggcggctggccgggcagagggactcctcacttcccagtaggggcggccgggcagaggcgcccctcacctcccggacggggcagctagccgggcggggggctgaccctcccacctccctcctggatggggcggctggctgggcagaggggctcctcacttcccagtaggggtggccgggcagaggcgcccctcatctcccggacggggcggctggccgggcagggggcggacccccccacctccctcccggacagggcggccggccgggcagaggggctcctcacttcccagtaggggcggccgggcagaggcgcccctcacctctcggacggggcggctggccaggtggggggctgacccccccacctccctcctggacggggcggctggctgggcggggggctgacccccccacctccctcccggacggggcggctggccgggcggggagctgacccccccacctccctcctggactgagcggctggccgggcagaggggctcctcacttcccagtaggggcggccgggcagaggcgcccctcacctcttggacggggcggctggccgggcagggggctgacccccccacctccctcctggactgagcgtctggccgggcagaggggctcctcacttcccagtaggggcggccgggcagaggcgcccctcacctctcggacgaggcggctggctgggcagggggctgacccccccacctccctcctggactgagcggctggccgggcagaggggctcctcacttcccagtaggggcggccgggcagaggcgcccctcacctcccggacggggcggctggccgggcggggggctgacccccccacctccctgccggacgaggtggctgccgggcagagacgctcctcacttcccagacggggtggctgccgggcggaggggctcctcacttctcagacggggcggttgccgggcggagggtctcctcacttctcagacggggcggctgggcagagacgctcctcacatctcagactatgggcggctgggcagagacgctcctcacttcccagatgggatggcggccgggaagaggcgctcctcacttcctagatgggatggcggccgggcagagacgctcctcactttccagactgggcagccaggcagaggggctcctcacatcccagacgatgggcggccgggcagagacgctcctcacttcccagacggggtggcggccgggcagaggctgcaatctcggcactttgggaggccaaggcaggctgctgggaggtgaaggttgtagcgagccgagatcacgccactgcactccagcctgggcaccattgagcacggagtgaaccagactccgtctgcaatcccggcatctcaggatgccgaggctggcggatcactcgcggttaggagctggagaccagcccagccaacacagcgaaaccccgtctccaccaaaaaaatacgaaaaccagtcaggcgtggcggcacgcgcctgcaatcgcaggcagtcggcaggctgaggcaggagaatcaggcagcagtaccgtccagcttcagctcggcatcagagggagaccgtggagagagggagagggagaccgtggagagagggagagggagagggagagccagaaggattttatgaatgtccttttgtgtgaggattaatagataaataagaagtttattaactggaaaaatgctttttgtttggtaaaccgtaagtgactctcatgagtgagaacgcaacgcagctatagtaacccaaaatttctctaataaatcaatatataattgttgctgctgtgactgcacaaaattaatgaatagagcagcttggagcagctttatttgtaggtccttctgtttgaagcacaatcagtctacttattcaatgatcaggcctgggaaacttagcctgaaaaccaaaacatccatagctgagcagtttctaaacaaaaatcctaaagagagatgaattcctatctcacagcgaaaggtagctctgaaatgaagctccttgatgacatctcatacttgtaacagagatttcaaaaatctgttcatttcatctagggaacatttttctgcaaaggctggtttgagtggttatgtgatccagtatatcattctgcactacacacaatgatgggcaatgttaaaaacagatgaaaatggctgtcttccaagtccagctatgaacctccccacgggatgttgctggacagtacttcggtagcacagttattctacaaaaaaaaaaaaaaaaaaaagtcctttcctcaaagaagggttgaaatgatgctccggtttgatgacttgggagtctgtagaattctttttttgtttgtttgtttgttcgtttgttttgttttgttttgttttgttttgagacagagtctcgctctgttgtccaggctggagtgcagtggcatgatcttagctcactgcaacctctccctcccgggttcaaatgattctcctgcctcagcctcccaagtagctgggactaaaggcatgcgccacaaggcccagctaatttttatatttttagtagagatgaagtttcaccatgttggactggctggtctcgaactcctgaccacagatgatccacctgccttggcctcccaaagtgggattacaggtgcgagccaccatgcccagcctgggagtctgtagaattctaataaatgatatcaagtgatactaagaaaatatataatccaaatcatcactaagtaaaagtcctaaggccggttatttttttagcagcacatgaggttcttcacggcttcagtagaaaccagatttcttcaaccttgtcactctcggcatttggggctgaatagctttgttggggggaactaccttgtgcattgtaggatatttggaagagtccctggtccctgcctaatgctggtagcccttttttcccgcagttgtgaaaagaaaaaaatgtctccacacattgctgactgtatcacataaagtgtgtgtgtacccacatataaaatccccccatttgagaaggactgatataaataacacaatttatataattctttaaatagaaacttacttgctgcactactcaatattgatgttcttgaaattaaatacaatcttatgagttcctcttatacatatgcttccattctcattgtctttttctgaattgtcatgaaaaacactccagcattttttaaacactttgacaaacatgtgtgcctcgctttctccctacatgtcccgatttctttatctggattttttgtgtcctctattaagaccagaatgctgttcatcctctcagcttgtcttacgtgatccttgagcaatgaaaatgttatttttagaaaaggactttagtagaattttgaaaaaatatatatagtaattaaagtgtgtttggcctcattggtgtggccaatcttcaactaaatgttgaagatatacgttaggtacagacaacttagtactacatttattcaaggtttttgcgtggctttagttaaaatgtaattagagttcaagcaatgaaggcattgcaaacgtatttactgaaatttctttttcttttttcttcttcttttttctttttttttttttttgagacaagttctcactctgttgcccaggttaagtgcggtagcacgatcatagcttactgagccttgatctcccaggctcaagtgatgcttccacttcagcctcctgggtagctgggactacaggtgcacaccaccatgcctggctgatttttaaaatttttgcagaaatgagacctcacaatgtttcccatgctggtcttaaactcctgtcctcaagcaattctccccctttggcctcccaaaatgctgggactacagacatgagccactgtgcctggctatttattgaactttgtcccacagctgagcactctatggttgcaaaatacaagtttcaccaaccttctggcagctttaagatgcccatcgataagatggaattatgacacactcagagtgcatatggggataaggaaccactacctgagcagaccaaatcaatcaacatgagagctcttggaactagagatggctgggatcacattctggccctgccatttattatctgtgtgaccttggatctaaatagctcccctctctacgtgttactttctgcacctgaaaagtgggatgatgagatgcgttctccatggttttatgaggaataataaaatacctctgcaaagtggctgtgtttggcacacagcaggggctggatacatactgcttctcctacataccaagactcaggctcgccgacttgttcagggagagagggcatagagaacagaacttgcaccctgtacttcgctgaaacctcaggcatggacagctcagataggagtggggctcagaggcaattcatcctgtattctgaagggcagctaaacttcagctgaaaagctggggtccggaagccatgcaaaagacctgcagtctcctggtgagggagatgataaacatgaaaccatgtggaaatgtggattaaccaccctgaaagacaaggtccctcattgttcccgagacaaggaccatttctttcttttttaaaacagctgtattgaggtgtaatttatataccatagaactcgcatgtttaatggcttttaataatttatagagttgtgcacccaccaccacaattcaattggcgttgccctaaaaaatcacttgtgcctaagtgtaatcaattccttcttccacctccagcccctggcaaccactaatctactttctgtgtctacaaatttgctattctggacttttaatgtaaaaggatttatgcaatttgcagttgttttttgtctggctttttcacatagtgcaatgtgtttgagggacatccatgttatagggtgggtgcgtctgcatttcagtattttctttctttttaatgatgtgctgatattggaccagttactctaaaattttagatttggcatctatatgagtggagttttaataagaccaatgtcaggttatttagatgttggacgaaggaaacaaatttcaatgagacagaaggagtaagttcaagagatctattgtacaacatggtgactatagttaaaaacaacatattgtatctttgaaaattgctaaaagagtaaattttaagttttcttaccacaaaaccaatgataagtacatgaggttacatatgttaattagcttgatttaaccatttcacaatatatacatataccaaaacatcatattgtacactgtacacttacacaggtttttgtcaattaaatttttttctaaattaaacattttaaaaacatgcaaaaagctatagcatggcctctggcagggatcaagagcttcctacacgttagttttgatgttaggatcatcccagttgtaattagttatccattttagtagtattaccaccacagatcttatccatttagcagaagcaataagggaccatctctgggtagtcattgttcctagggactcctatgtaatctgctgggcgattcaaaaattcactgcaaaattcagtttttagaactaggaggtatccaataaaagttgttgaatataggaagaaaaaataaattttaaataacaaaaaacacatacaaaaagggtcaccctttgtggtgaattccccgcacgtggctcagggtctaatgcacagtggtatccagtaaatatttgttgaatgaattaatgaagagtttggattttaaaatattgcacacctataagccggagtttaataaccaaaaggcatatgatccttatactttcaatgttatcactcaaccatctatgtttccattggactgttgtctgatttatgggactgggatttgacgtaaattcaggaattgttggaagtagctgttcagtagtgagaagcagaagaaaacactgacacatggaaccaggtgtctttgttttggcaaggacagcaactgtattctgatactaaggtgggggatgggagttccgggcaaagacattaatagcactcatattgttcttttcgacacagatttgagagagctcttcaaatggcaaacacctagcatgtggggatctgaagcacctctttgtgggtttcactctcaacactcttggaaaatcaccgagtgtcatgagaggtgttattgatgcaggcctgtcatgcaggggactgacagagaggcctcctcagaaagactgagatggcccacagcagagggcagaaaaaaaaaaaccctttcctgattattgcaatcctggcaatgtcagcacctggttaccaactgcagcgatgaaaagtaatacaaacatttaggtattgatatatagaagacataagagtgaggggaaaatgttttcctataaacatttctcaaataattttgtgttgtttcagtaaaggtcactgtgattttgtaggccctcaggtgtgggtttaattgtgtttacttatgatgtatgattacagaaaggtattattcctgaaaaaccatcataatataattaaaaagttggcaaaagtgacgtctcattgctctctttgtttatttttttaataaaaaagaaaactcccattgcgctctgcttggagtacaatgaccataaaccaagagacagaattcacattcttggaaaatcacacactgtggtttccttgaaaagggagatgacttttgctctggaaaagacacatatatagagatcccaattaaaatgtatctattcttccaaatattctttctcatttaatccttggatacctggaactgataattaagaggtaacatcggcaactatgtactaggtgcaaaggcaataatggaatcctcatttttgggtgggtctttgcacagacccttacacgcacacacacacacatgcatatatatttatttttatatttagattccattcatgttaaatacctatagattttatattctgagctgttttctcagacgttctttcacactctgcaaagcctatgcttttttgcttagcttgaaaccacctccatgagtctcttcttatcccccaaataggagtcctgcattacaatcttctttgagcaaattcacaacctagattttggttggagttgaacatgcaataagttatcaagagttaaatctaggaagtggatttgggatagttttactcttttcattataactttccctatttttcatatcgtatataataaaaaatcatttttaaataagaaaaaataaatgactataatttatatatgtatatgtgtttgtcgtaagctcaggagctcaaagcattctcaaattttcttgtgtcatctaatcctaaataagtcatagttagaatctcctcaaagccacccagggctggctgggcacagtggctcatgcctgtaatcccagcactttgggaggcagaggcaggcagactgcttgagtccaggagttcaagaccagcctggccaacatggtgaaaccctgtatctacaaaaaaatacaaaaattagccaggcatggtggtgcgcacctgtattcccagttactcaagaggctgaggtgggagaatcttgaacccgggaggcagaggttgcagcaagccaaggtcccagccactgcactccagcctggacaacagagcaagcctctgtctaaaaacaaacaaacaaaaaaggacccggggcttgtgaaaatgaagtgtgttaatattcaagctgagtgagcagcccgtctaacaggctgtttaaattttgccatgcaattgttgaaggcttaaagaaaatcttcatttcctgggtgaactgaaacctggctaaatgcttttgtgaggcacttcttgttgagcaatcattatgtctattaaatgcttgattccatcacatctggggagttcactccccagaaaagaattgggatggtggtttcataaatgtaaaacaaacttcaggctaagccccctccgtaaatgtgagccaagaatccatcagctcacctgtgagagctctgtcaggcagtgtcacttcaatgcccctaaatattaaggcattcagtccttgaatctcttagctatgctcacttttctaggtgatcttattcagttccatgattctaaccagtacctgagtgctgatgactctagcagtgacttccaccctgaatacacacccacatattcaagtgcttcttgaataggaatcttaaatttcatatgtctaaagtgagtgatttttgctattttacccaacctgctcctctgttcagtaaacgaaatcttcatcaagttaatttgacccaagctttggatacaacttggactttgctgtttctctcatacccccccaagctctgtgcctgtctgtcagtaggaggaagtttatggtacaacaaattgccctttaccttagaagtgatgttccagcatgccccagactgctggacccctcaaactccaccagtgtggcaggccgtgaagtcttcattgagttaatctctccccttttggtgtgcctgtcttagtagaccataaacagaacttgccacttcctgctcaatgatgtgatgttataaatacaatagactagtgtgatgctgtgcagaatgtcaagatgatcaaaaatagagagagagagagcaagatagcgagagagtagaagagtcaacatgtgaaagggaaatgcttttgatcatccctgatgatgagtacacagaaggaataattctcaaatagtgacacaccaaacatgattttgaactgctccactaaacaacataccatttctggagtagtggctgcagttggggctactgtctggttaggtctatggtgaacagcaattactttctatgtcccaattgactttggcacagattagacaagtgatttgaataggatatgatggtacttacagctcctgagtccttcatgtcttcatgcttcccctaacctttgccatttctcctacatgtatgattgctactgatgcactgtcttgacgagtttaggggattcttcttggcttttcctattataatgacacttacttcttaggtcagaaaactcacacgaagcctctgcccgcttcagtagataatctcagttatacacttgcaaacttggagaatgacctgggaaactctacagaaccagtgaatctactgtgagaagaatttgggtcaaaagttcatatgtaaggctcctaaaaatttctgggtattccattctccctaatgtcctggcaattgtctatggataccattgaggaaaagtaactgaaatatttacccattatgttcttgtaatagtgctgtagggtctttcctcagcagaatctagttttccctcctatcagtgggctctaggtctgtgagctgccttagctttgcaaactgattaaggggctcggcactgatgcagctgatagagttttctgtttgctagttctagtttctttttatgaaagcaatagagaaacaccactgaaaccacaggttccccaggcatcagacatcctgactgttaccctgggtcgacgctagttacaggaattagatccaccttgcatctgatggctaactgctggcatttcctccaccagaattcagtcatgtcattggtattagggaacctagttgtatggctgcatcattcagtctcaaccctggcctgtagataacagccactgagtagcttctaaaatgggctaatgccccattcattcatgcgttgcttagagccacagtgaagtggggaggggtccctttgaatcctcccagagaacaaagtcaggtaggaggtctcttattttccatgtgcaattcattctagcatcccagcttctcttatccttctcaccccttcccatctctatgctaaggagatctggcaactccaccatatttatagaaggcattgctatgtccactattccaggtgccttcacgtcagactctcatgatcagctctagatgtccttccagaatttgaacctcaaggaacgtgtgagtgctacctaatcaatgacttctctcttctttagctttatattattatcctccaattccactctcattgttttaagatccaagtcccaaagcaggcgcagtggctcacacctgtaatcccagcactttgagaggccgaggtgggaggattgcttgaggccaggagttagagaccagcctgggcaacacaggaagaccccatctctacacccaagttaaaaacttatcttggtatggtggcacatgcctgtagtcccagctactcaggaggctgaggcaggaggattgcttgagcctgggaggttgaggctgcagggagctgtggttgtgccactgcacagcctgggtggtagagcaagatcctgtatctaaaaacaaacaaacaagcatacaaacctatgttttcacaactgatacagatgagcccagtgttgcaactcctctgacatacaggagtttatttctgaggagttgggcttgtactgcccaactcgggctatgataagacctggttataggactaggccagaggttcctatatagaccacttgtataagagttcttatctgccagaggttcctacacgtgtggcctccagaccaccagcagcagcatcacctggtaaataattaacaggacacattctcagcaccaactccaacccaaatgaatcagacaccttgagagtaggtcttagcaacctgtgctttaactagtcttccaagtgattctcatgcatgctcaggtttgaaaaccacagttctggagaacacaaacacagatgggggtgggtcttgcagaacctgtgcttcattttcaaggcacctctgccaggtgaggtcactgcaatggcagaaatgtttcctctgctcggtggaatggggctgcttgtgccatttaggaatgttccaggagatgttgggagcttgagatcctcaagcttgtccaccgaaatatttccatcacaggtctcaaggtgctgctcttggggctccttgtttagtcacttttggagcttagtcttattattatccaacttgggactgatttgttacataatcagccctgtagctgcagaagatgaaagtcttctctagaccttcccaaggggcctcctggccatcacagtatcccttaaatgggcaacatgccactctgagtctctcattttcttttagtgcggtccttcttcagtcctgttgaaagtagccctcccacaccagactcattccaatgatcactgcccgcatagcagttaaggatagcagccactcgtctttcaaagccttttcttccatctgtaatgcatcccaattatccacaggtgaaagcttttgctaccatgaggccactgtttgcaaagtgtaatcaccatctccacttacctccagcgagctagtccctactgcttcaaatgacatggacgacttaagtcctgaatcctctccagtgggtctgttttctagtccaagaaggtgcttattgtctgtacctggattccatagaaactagtggctaaggcacagcttgtgggattacattatttatttctttatttttagagacaaggtctcacccagactggagtacagtggtgcaatcatagctcactgcagcttccaactcctgggtgcaagcaatcctcctgcttcagcctccagagtagctgggattacaagtgcaggccaccacgcccagctaatgtttacatttcttgtagagatgggggtctctctttgttgcccagcctggtagtgaactcctggcctcaaccaatcttccgcatgagctggtatgcccagcctactttttttttaataaaagaaaaggcatacacatttatcaacatgtcaacatgtacatggggagaatgagagagtgattacccccagaattacattttaccaagagaaagtaagctcaaggaaatcaaggaggaattgatgcatttaaagaactggctatagcttgaggagcaagcacagctggctgttcaggcaggctggacatgtctgcataggaagaatgacatcatccagagaagtgcaccgggggaggaaggggtatatattaataggtatggctttgcatctgagctcccctacggggtcttaacactgttgtacttcagggccatccaagaaactctgggggctgggggcagcggggaggaccttagcagggcctgtttgtttagattcctcatggcctctttgtgcagcattccttccctccaggtatatatggcaggatccctctgaaatgaggtcttatgacttcatttcaggggaggtaggccagaattcttttatggccagctctcagggaggaaggatgggatatggtcagagagtgaccatccttgcttctgctattttctcagtttctgaggtgctaggttttggggtagcattttttgcaccccgacactaaggaggtatgtaaaataagttccaatacatgtatgtgctaggcaatggcctacctgtttctcagggctttttccaatacactatgcagcaatcttatttctttgcgtttataatctgtttcttcctcttccatatttaaagaccaaaaagcaaaaaaaacaaaagaaaacaacacttttctaggtgaaccttgtaaagaattaacattaataacttagtaaggtcatttatgaaaaaagaaaaaaagaattaacgttaatatgttgatcatttaatggtaagagactctaatctgatgctctgtattttttagtttttttttcccctaaggggagcagtcaagaaacattagtttagcaaccctctaattttcttgccctctcataaaccccaaagcaatagaaattttccatttcccataacaatcagtggtccattaatttttaatcttattttctacacgtttccaagtacagtagcttttcttagccacaatcttagtatttgcctctatttctcctctctctcgtctcatgcctgaatcattaccaaaacttatgcaaagaacaaagaggcaaaatgatagatgtataaacaaacctaagacgacctaattagtgtgaggacctgtcaggtgtcttcctctactttacctgagtcagtcctgacagcaacttggaactcaatggtattactccccctttggagaggaagacattcaggcacacagaaaattgtcttactttccaactcccatcttcataaatctgctacatcttaccttctgtcagagtcttcatttccagacacctttctgtagtacttccttgctgtggtcaaattaccaccccaacattgagtgttgggacaccctccgtgtgcactccagtctaggaaaagggccaccattctctctttcatagctactattacagctaccatcttacagcttccctccctccctccctcccttccttctctctttccttctgtcattttctttctcccttatttctatcttgttagccttacaccttttttcctccctccctccctttctttctttcctccatcctttcgtctttcctttctatctcccttccttcctcccttcctctctttcttccttcctccttttcttcccaccctcccttcctgctctcctctcctcccttccttgcttcctttctcctccctcccttcctgtctccctccctgctttctttccttccttcctccctacctccttctctcccttccttcctccttccctccctgccttccttcttttccttccttccttcctcccttcctcttcctctccctccatccccctcttcctcctttccttctttcctcccttcccctccctccctcccttccttccttctttcctcactccctcccttttcctcccctcccttcttctgtccttccctccctcccttccttaatcccttccttccatcctcctccctccttctctcccttcctgcctccctccttcccttccttccttccttcctccttccctctcttccttccttctttcctttccttttccttccttccttccttcctccctccctcccttcctcctcctctccttccatccctctcttcctcttttcctttttttcttccttccttcctccctatctccctcccttccatccatccttccttccttctttcctccctccctcccttcctctgtccttccctccctcccttccttaatcccttccctccttccttccttccttcctccctccctccctcccttcttcctcattctgtttttctttcttcattatcctttcttgtactatcttctcctttttaagttgacatcgcttcatcttagccctaagcttcctatggacagaaactaagtctattttgcttagaattctatctctactcctcatctgttgaataaatggacagataaataaatgaagggatgaaaatatgagcataccatatgaaaagccaacaacccaaatggtagtaactctctccccttgtgtcatataccaccccacacatgatagctcatttaacattcacaataactctataggctggtatttatactccctttctacagttctgtttccattacaccacatgttttcttctagtaacatttggtgcttggtattggaaatatactacagggttataatagtatcacctaccagaatctgcttatgtgtggccagggttattatagtatcctcagtaagcagtgctgtgtgccctatggatgaaattgttattcttatgagtggctatgcaatgacctaggaagagaacatgcttctaataagcttggctctgttccccaaactgctgtatcactcattgcatctcctctgtagtgggcaaaggtagacaatccaagtggttctattcccagacctttctactgggacctagaaataaagagcacctattccagcaaagagagttgattctgttagataagccaaaaggcaatttttggttaagaggaaataattgtctaaactgtatgagagaggctgtgctctgggaaacagtgtgcataggtgacaggctgcagtgtttctctgcagagactttattgacaatggcagtgagcttcctaaattgccaaggaagctatcctgtcctcctggtgtaagtcatttttcttttttctttgatttaaggcaaacaatgtttgagcctttcaattattaaagatgctctcatctgtcctgcatccaatcaattcttttttgaaaattagcaattatttagacaggaagcccatggactattcattcatgaaatgcctgagacctcgactttataaattgttatcttaaaggtcttgggagttcagggatagggtgtccctctgccacggcttgggcattatgttagagccttttatttgctcgttttaagtaatgtgtggctgcaggatacctacccttgatgcctcctcaatagagaaggcatattttataatctcagcattttctttaggtggagaaatgtctatccctgccttggtacacaacatttatcagactgaaaaaaaaaatgattattaaggaaggttcacagaaatagctcctacagcagataagatggtcttgccattactactttaaattatttatttgatcttttaaaagacaatttcctaagtgtttgagattttttaaatattttaatcacaaggttctttgtcctgaaagtgttactaaatacctgccttacagaagtagctaatcttatctctaagtacaaaggactgactacaggcatttattttcttgccagttcaagtggatgaaattgaagtatggatttgcatagtaaaggtgaaaggcattagcattgagagtattacaaaagtcttgttcacagcactgacttgtattagcaacattcccttttgactcctgtaccaaatcgcacatctaagcatctctctcaacagctcaaagggccttagtgatcccttctcagtatcaaggtaaaatctcaagtgctctccaggcccttcagctgaccccattctagcctctcccaaggccctcctcaacctatgccccaaatggaccatagtccaggcacacaaattactcctagaaagttctttgtcctgtcagtgggtatggttttgcatctgtgcaagtatccacttctagtatgtggttagtagaatgttgacttattctagggcagcagaaagatcatatttccccagaagccttccctgaccatacttcccatgtcctgggagagtccccattcctcctctcctcccatccccagtgaacttttgtttaactacatcccagggctcccagtggcccagaactgagtggaagaaagagaggcagtggggtggtccctggatgagaagcaaacatttccatcaagggctgggcagtactaatggatccaggaaagcctgcagagacatctcttgagcagtcagatgatcagtttgagtgctccctgtccacattccatctcagctcaggaaataccttttatccacggacactggctgcccgcatcccatccctgaacatcatgcacatggcggtgttggccccccaggagtatcttatcaggacctgtgatgaagaccatgctactctgccagccccactacaggataggataagggattactcctccagctgctaggaggtgctgtccctgctagtagccctcaactcttcatcctctccaagaattacccttctctgaagacatctcttttcctaggtcgtgctgttacttcaggaccatcctgcatccagtaactgttcagtgcaagggtataaatcttcctccccacaaacacacctcagagcactctaccaggccactgcaacctcatctactcaatagcactttaccaggccactgcaacctcatgtactccagagcactctaccaaatcactgaaatgtcatctactcaatagcacattaccaggccactgcaacctcatctactcaatagcactctaccaagtcactgaaacgtcatctactcaatagcactttaccaggccactgcaacctcatctactccagcgcactctaccaggccactgcaccctcatctactccagagcactctaccaggccactgcaccctcatctactccggagcactctaccaggccactgcaccctcatctattccggagcactctaccaggccactgcaccctcatctactccggagcactctaccaggccactgcaccctcatctactccggagcactctaccaggccactgcaacctcatctactctggagcactctaccaggccactgcaacctcatctactcaatagcactttaccaggccactgcagcctcatctactcaatagcactttaccaggccactgcagcctcatctactcaacagcactctaccaggccactgcaacctcatctactccagagcactctaccaggccactgcaacctcatctactcaatagcactctaccaggccactgcaaccttatctactccagagcactctaccaggccactgcaacctcatgtactccagagcactctaccaggccactgcaacctcagagctctcatgggctcagccaagtccttactgtgagagcactatagctcaaatttttccctttgctcagatgtgcctccttcctttcctcctcctgagaggatgccccccattccccaaacttctcatatgctaagctctgtctccttggctttcccaggacagccctgcaacagttccaagttccaggcatagcaaaggatgcacataaacagcaaactgctttagcaataaaaacaacctggtccttccttttctgcaagttgtctgcccaaatctaaacttccaggcagattcaagtaagttctagaaggtcctttgtcccttaggtgggtatgattttgcatctgtgcaaatgtccaccttctactgtgtggcgagttgaatgttgacttaattcttctagcagcagaaatggcacctttaccaggaagccttcccacgtagactaccatgaacaggggttatttattggaggtgtgatgtttgcttgtgtctgcacacctgtgctcattaacaaccaactttttcagcttaggtgaaggtttcctattgatctatgtggtaggcatatctcctgccttccagagaccagatgtatccagactagattcactcagttacagaagcctggtaataaaaccaattaactttaggagaacccacttcctcatcttctaacacattatcaaagttttgataatacagggcacaaagagggcatcatctcacaaaacagaagcagatgaaattgaagttgcagtgctggacccaaagaaacatgcttgtttggggaaaaaaaaaacagagggatcagtccatcgcttagaggtcacctaagcaagtcccctaaatatttgaacttaattcctttttaaaatagcaggaagctcttaatcagagttctgtcttctacaagcatatcttgttgaggaataacaatgcaggtgtatctgtgcttctcactttttttctttccttgtctgtttaaaagaagcgtggatttgcctgttcagctttccccatgccccaggctacatctaaatgaggagctttagactaagtctggaacgttgcagtgctgtaggagccactgattaggagggaatcagatgcaactcagggagaaagaaattaagtttgtaaactatcgctgtgggcaatctatcatgccatggtgttcaagaaatacaagtatggagattgagcacagtttcaaagtcaccttttggatgctggattttattcccttgactgttaagccccactgagaatggtccacctagatggtgacttcaatgggcttatagtagctggcctgtcaagggtagcctagcatgtgttagctaaagcacatcatctagtcttatttggagctaaaatcacgactttaaacctgaatcatgaacacacttcactcgaatggccagactattggaacaatgaccaaatactgagatttgatcaaatctctgtcgtgacagtttttggaataatgtgggaaataaatatcatagtgaagatacaatgtacatttttccaatggcagagtttggaactaaatgttcctgtatttagtcctgagagaggtggtccaagaaatatcttttctgtagtggctcaaggcagctgcctgctaagtcatgctcatgtgtggtcttgtggctgaagttgtgaattttaaaaccaaacaacttttgtagcctaggacacagactactttctaagagaaaattaagagtcacaagcaagtactatgctaggtttagagaaaagtagtcagattcatgattagaacataccaggaaattagtacaaaatggactggctcaaagggaggaacttctgtatgagagagggtttacctaaatcctcttgatattaatttctaactttgcaaagtctcacattgctgtgaacaattactactatggacaggaatgaatttatagctgagggctgcagaacctggatatacaatggcatttctgagattacaaagcaattgtctgtgtttttttctgattggaagaaatgtaagcaacatactgtctgcttatgggtagagaataggtcccatgtcttaaagatatccaagcagagtttgtgtagactttaataatatgataatgagccacccatcttgtcacaacttctgcatctattggtgaatgaagaggaaggatgttgtaatcccagtaatcacccctccaaaattagatatgtgcccctgggtatggggtgaacttcaaaactttaggtggcaggatggtgctacactagtttccttgaggcttgggtatcctcttggttcctttgcctccttataatgaagtccttgcctctgtcccagctccagggatacaatgcacgaactgtgttgcaccttaggggactctgctgcatcccaggggaaaacagaagaaatattgggctttaaattgacttctcattgaagagggccacaaacattttccagggtgaaattggatgccaccaaaattactaacatgcaaactcatgtactgtgatcacacaccctgttcccattttgactcgtgggagcctaagcttagttaattggttttattaccaggcttctgtaactgagattgagtgactgtagttttgatatatctggtttctggaaagtgggagatatacctataccaaagagatcaacaggaaagcttaagctaaaaaacttggttgttaatgagcacagatatgtggacacaagcaaagaagagagtcctaatgacagttacagacaggattgaataggtcctcactttggagaagaatgaagcctcctgaagcctctcctgttactgaattgcacaacatttccatgcaggggctactaaagcttccctactgcattgcctatccgcattcctcttggtcttcacactggtttttcctgtgtacgttcaattcccggttcttctgtttgaaagccacttatctccagacagctcagacttcagcctatcaatgcagattccctcttctatgtcctgagtcaccgttcttccaaattctgttaaatatatcttctttaggtaattttcttggctaattttaacagttatagaatgcgatgtatgagaggcagtagatttctcaaggaagcaagcaataatttttaggcaaaagttatatcaaattgaagaacagacagacagacagacagacacacacacacacacacacacacacacacacattttctgttaggaaaactggagtcatataacaccagtgtgattttttaaaaatgcctcctctttggtgcaccatgaaaattggttgattcaatttgatcattatgctttctatggcttcgttataatattacctagttatggaaatatgggtgagtcatttccaatgtgtaattcatattctgggtgtcagacgtggttgtacgtgtgaggaatacaggagcgaacaaaaagtataaaagactgccttattggagctaaaattagtacacattccagttgcacggagtgtcttcattttagcctttgcttcctttcaaatagctcatttgataatctaatagtattattaagtctttttaattcaaataaacttaccctctattgtgttccaatatccagacctgatctgctatttctcaaattctgctgaaacagaggtctcagcagccgtatgtatgttaagactggttctaaaggagaattgctttgggttgactgttatgtcattgcctttccattcatcttcctctgtgctctacttgctgctgattttaattattttgctgagattacacaaccaaatggtgccttctctgatgtctttaaaaataatcacatttgctcttataaggaatattttctgtttcaatctaagaacatttctacagtcattagctgagttggcaaaatacagagcccttcctgcattaatttcaccttctctggtctagaattcaacacaggatttattctgtaatctgttctgcaaacttgaaattctattcataaagaaatgtttaaataaacttcccaacagtgaccctatcttcctccttgattattttgtttcctacgttctgtaccgcttttctacttctgatgaaggatcaaaagtaaaagattgttttgactttattttaaatttaattagaaaataaaaagtcagtataaagcatttattaatataatcagtcttatgcaaaagcctgttcccaggatgtttctgatgaagttaattaagacacataattttgtatataaattttggatattagggaaatatttgatttagaaaaaaattagaaagctggccaaatttattcccctttctaaaaatcttcctatggtatttaaaaaatttatagtaaaaatatcatccactatgaaatatattatttgcatctaaattaaatatttttagtgatatggatacttgtatacataaacatacccacacacccccaacaggtatagttgtacaaatatattaaacatgtacatatacatttagaaacatacagctatgaagaaatgaataatgtttatggtaatctggctttaaaatccttccaaactagagatttttaataaaaaaaccttttagataactgcataaacacattccaataagacagtgtactatgaccatttcatatggtgtctgttggcattttcttctaactaggtccatattttaaaaacaatttctagaccatatgtggcttgcccaatcttgagaaaatgtttcattcttgaatttaaatttcaatacttggagtgggacaggatggccagctagacatagccaggaagtactgttcccaccaagagagaccaacattttgagtaaaccatcataatttgaatagatcttagagagaaaatgctgagaatggatggagatgtgatgtggacactgaggctcaaaaaggaggaagctgggaacctggcgttgggtacttgaacgctagggctacttcccagccctgaagggctcctggggaaggggtacatgaaggactgtgggacttcccactcttgcggtggaccttggggatccttagctagagggaaccccacaaaccccatggacatttgagccagccaggggatcatccagagagtaggcagagatagggctttagccagtgaacaaccgggggcctttgtgtatggggcagctccagcaagcccgaccataggcgccaatccccctggggctccccacctccctccaagaagctctagcctcagctcactgctgggccaggagagagtggaaccagcttccctgtgggactggggcatgtctgttatgcaggccctcttgcctgccagaccctctcagggcccctatctggccaacctacaagagtgtgtgcatgtgcatagtacagtctctgctgcccagcctaggtgctttgctgcacctgagtacattcccagcatcctccaagcactttggatctcctagaacatgaggaacccaagcccaggtgtctggaggatggaggtgtggggtgtcccaccacccagggctgtgatgtgcagctcaggagtgctgggctgagacctgtgggcagcacttgagctggggaggaacactcactctcagagaactgagaggggtgaaatacacaggttcataggctgctgcagaagtggggcatgcctccttccatagagccagcccagaaagggcgtggcctagctccctgccatggattttgcccaagggagccccacggcccagaacacctaacaaaagaagtgtaggcataatgccagtgattggagggggctcccccaaggcccaggagtgggcctggtgaggtagtcacctctcttccctccacactgcagagcatggctgcaaacatgaggaaatacaggcagctaagagcctatcagccattactcttatgcattatctactggaacacagcccaaactacaacaccaaaaatattttgctaaaatacccccctgtgaagcaaagggcaaggattcagccacaaataaagaccctgtgcagagccttgaccctgtaaaaacacccagaaacaaagccaactgactatactcaactttcaccacagttaaaggaacaccaaccctcccagatagaaataatcagcataagaactctggaaactcaaaaagccagagtgtccccttacttccaaacaagtccactagttccccagcaatgatttttaaccactcagaaatgactaaaatgacagatgtagaattcagaacctggatgacaaggaagctcatcaaaattcaggagagagttgaaaaacaatccaaaggatccagtaaaatgatccaagggccaaaaagatgaaatagtcattttataaaagaaccaaactgaacttctaaagctgaaaaatttaccacaagaatttcataattcagtaagaagtattgacaacagaatagaccaagctgaggaaagactctcagagctcaaagacctgttctttgaatcaactcagccagacaaaaataaagaaaaaatattttttaaaaatgaacaaaacctttgagaaatatgggattatgtaaagagcattggcattcttgaaagagaaggagagagaataagcaacttggaaaatatatgcgaagctgtagtccatgaaaattttcctaatctcattagagaggattacatgcaaattcaagaaatacagaaacccctggctagatactatataagaagcccattcacaaggcacatagtcatgagattcaccaaggtcaatacaaaagaagaaatcttaaaggcagctagagagaagagacaggtcatatacagagagaatcccattagaatggcagcagatctctcaacagaaatattacaagccagaagagattgggaactatttttagtgtccttaaataaaagaaatttcaatcaagaatttcatattctgacaaactaagcttcataagtgagggacaaataaaatcctcagacaagcaaatgctgagagaatttgtttcaactagaccagctttacatgaggtcatttagggagtgctaaacatggaatcaaaagcatgatatctgctaccacaaaaacgcatttaagcacatagcccacagacactgtaaagcaactacacaatcaagtctacataataaccagctaacaatacaatgggaagatcaaaatctcacatactaaccctggatgtaaattggctaaacaccccaattaaaagacacagaatggggccgggcatggtggctcatgcctgtaatcccagcactttgggaggctgaggcaggtggatcacatgaggtcaggagttcaagaccagcctggccaacatagtgaaaccccatctctactgaaaatacaaacattagccagatgtggtggcacacgcctgtagtctcagctactcaggaggctgaggcaggagaattgcttgaacccaggaggcagaggttgcagtgagctgagatcatgccattgcactccagcctgggcaacagagtgagactttgtctcaaacaaaacaaaacaaaaatcaaaagacacagaatgacaagctggataaaaagataagacccaaccatctgctgtcttcaagatacccatgtcacatgtaatgacacccacaagctcaatgtacaggagtggagaaagatgtactatgcaaatggaaagcaaaaaaagagcaggagtcaccattcttatatcagataaaacagactttaacccaataacaattaagaaggacaatgaaagcactacatattgataaaggatactatccagcaagaaaacttaactattctaaacatatgcacacccaacactggagcacccagattcctaaaacaagttcttctcgacctacaaaaagacttagccacacaataacattggaagatttcagtaccccaatgacaatgttagataatcatcaaggcagaaaactgacaaagaaactctggacttaaactcaacatttgcctatttggacctaatggatatctacagaacactgtacccaacaactgcagaatatgcattctcctcatccgcaaacagaacattttctaagtttggccacatgctcagtcataaagcaagtgttaatgatttttaaaaaaatcaaaatcataccaagcacactcttgaaccacagtgcaataaaaccagaagtcaatatcaagaaggtctctcaaaactatgcaaatacatggaaattaaacaacttgttcctgaatgactcctgggtgaacatcaaaattaaggcagaaatcaaaaaattatttgaaatttatgaaaacagaaacacaacttgccaaaatctctaggatacagctgaagtaataagaggaaagtttgtagcgttaaacatcttcatcgagaagttagaaagatctcaaattaacatgtaataaatgtacacatgtaacccctgtatctaaaatatattaggttggtgcaaaagtaattgtagtttttaccattactttcaatggcaaaaccacaattacttttgcaccaacctataagttgaaatttaaaaaataaataaattttaatacttggttcacttaaaggtttctttgtagttacacatttacataactaatttagcatatgatacatattttatataagctgtgtatattgtatatcatatatagctgtatatatcagtatgtaatatatattataactaattgtatcaatatctgtgtatctaaaatctttcaacctaccttttctacagtgatggagtattgtatctgttattctgtagtcagctgaaatagcaattctccaacaacctggagaaagcctccaggtcccacataaagcagatttgtataatcaaagaaagcagaaaatccttgagaaaaaaacagacatttttcaaactttcagcatttgctggattataaaaggaggcacatccaggctgacagttattagaagatctcaagaaatcatgttagtaaaacttctgtagcactattaactcccctttgggcagagactgagaaagatgaaaaggatcatgcccaaagaggtcagagcttttgaagtacctcgtttaattaaaaggtgaaagttctgttaattcagatataaaaaatttaacaagttaacatgtcaagtagaagccctgttcatgttaatcatgaagaaaatgacaagctgctgcttcttttttttttttttaaattttggcgaggaaagggaatatttaaattttacaaatcagatgaaatgttatttttcaaacagttgataaaataatgtttttgtcaattgcaaatgaattttgacataatttattaatgcattagagttcattttaaaacatttttcagcaaataagattttatgaaaggaaatactgctttaaacaagtcagtgtggtcccttgtaagtgagacagtaaacacaaaagtgtagaaaaaagtctcactaaagctgtcatctcctagtctcagtacagaagtctggatctaaatgtatgcatgactttgaatgcatgactcatacttcgctaaaagcagtcttacatcgaatgaatttttcaaacaaaaagatcctgagctaactggattcgattcatacagatgtacaggggagttggggtgggggttatcttcttttattttagaatattaaaacaaaattattacattaagactgccacaatcatttaattcaatgacaagaatcatctttaaatgactagttgagaggcagtcgcagtagagaattaagtggcctgaacagaagactgactttgccaaccaccttgaccatgagaaaatgatttctgtcctcagcaagccgccgtgtcctgtgtgtttttgaggaaagcacatgcaaagagacatagaaacgttttgtaattagctgcacttttagatttgaaaaacaaataaaaacgatagggagctaatatggtccaggaagtacagagagtaacctacttcttgacctaagcaagaaaacctaactgccctagaacccaagcaagctaaagcacatgttttcagcctaccaatttcgtggaggttcagattctatgacctgaatggagagagttaggttcaatcacctgaacacctgctacaaatagggggttatgtgttcccagcaagaatggaggtggaggtggtaggtgcccaggtgccacactttgtatagctttagggcattagtacacagtaccccaatcagacaccgagacggaaagccctggagttccccagggcctccattctctgctcttctttctctctctatagctctagcaggaacaggacttaaagaatatcccagtgtgtggctgccgtttatttttagggaacaaatggaatatcttgaaagaacagatgagggggctggatgtggtggcaacttgggaggctgaggtgggaggactgcttgagaccaggagttcaagaccagcctccacaacatagccagagcccgtcactacagaaaataaaaaattaacttggcatgatgacacacgcctgtagtcctagctactcgggaggctgaggtaggaggatcacttgagcccaggagtttgagctatgatcactgatcacaccactgcactccagctagggtgacagagtgagactccatctcaaaaaacaaacaaacaacaaaaaaaaaaaccccccaaaaaaacccaaacaagtaggtaaaggtgaatacatcaaataagattaaacacttcattcaaccctgtatcctaaggatctaatagattttccatcttagcatcccaaatcatctcttcgtattggaatcctgcctgacttcctgagacacatgccaggaggttccctttcatcatctggtaaacatttcattcagacttggacataatgatggcaggcctggcagtgcacttgcacatggtatttcagggcctgcttcctcaaagcaagtgacctttctttgtcattgaaatacaccaaagaaagtctaaagcatgttacactgtcttcagtttcttttttttctggaatctgtccacatttttagcaaacagctgtgaagcagccctaggcttaggaaacagaaaggaaggaaccatgggtagcagccttgagcttaagaaccagcaaatttcaccaacgaaacagtcacggtgcttctttcatctctcccacaacattctgactgactgtcaggttttgggtatatatatatatactttatttttaaaaggggattttgtgtctgtgtgtgtgtgtgttttaatagactttacacttttagggcagttttcttttcacagcaaaattgagtacagaaatttcccatatacctcctgcccctgcatatgtacagcctcccccattattaacatcctcaccagagtgatagattttttacaatttatgaacctacattgacacatcattatcacccaaagtcgacagtttacattagggttcacgcttgatattgcatattctatgggtttggatgaatgtataatgccatgtatctaccatcgtaatataacacagtaggttcactgccctaaaaatcctctgagctccacctattcatccctccctaacccctggcaacacctaatatttttactgtctccatagctttgcctgttccagaatgtcatccttatagttgaaatcatcttctaagcgttttgtagttttgcattttactagatttaatttttaagaagagttttttatttacggaagaacctgagcagagtacagataactgccatgtaaccctctatatttgattttaatgatgataaaatcttttattattttataggggaaaaacagaaaagaaagactcaaatcctatttttcaaaaagatagaagacaattggtttagttctcaagtgatagctgatatctggtaacccggaacaggttttatgcccccttcaggcaggaattttatttcccaaagggcattttctttgtcccaatttaccgctagctcagacatttttattacgatggtttcccgagagtgtctttttctccttcttaaccaccattgtatcacgttttaagtttacagaccttttatcacccacagcaatttctgagcaattgatggtgccacccataatatcaagttattgtcattaaaaccagtgcattttcatggcagcagttgtcacattttgcaaagaagtgcttgccagacatgtaagtcaccgcagccctaacaaaagtgcaaataaactgcttgtcatcagtgaaaagagtcttccagaaactggcattctagggctaaatcttttcaaactctggtccactgatcttaaaaagacaagagtgtgggtgcattcgtgctccttaatgattgtagcccaccctaagaattctgttttattttctaccatcgggaaatggctagtccatttcaatgagaattgatccattgttcctcaactttgcacaagctcttttgagtggatagataagttttgaagccttgccaagcctagtatcattagcacgatgcttccattccccttataaagggaatggttgacactcaatgtcaatggtacacaatttgcaagtttgagaaagcttggggaatcttcccataaaaccaggccttctggacacaactgtcagcccacaaagagaaaaaggaggatactggttgccatttggaaaagataaatgatagcatctgccctgataacttacaagacacatcactgtctttcagggttgagggaataagagacatcttgttaccttcatccggcctcctaaaccacccttcatcaatttctgtccatatattttactctttacatttgacttattcataagaccatggttgtgccatggtggaagggggaatgttaccaatgtggaccattggttctagcaaaagccctaatcactgagaattctactggaggagagtcattataaaatgagaatgctacaatgaaataaaataaaatcacagagagttataattatgtagccaatgaaatagaagatgattctagggaaaattagcatgtcactgttttagtcttctttcctattaaaagatggcattattcactcagctggcgaatttattgtgtagcatggattcgattagtgctgtttccccacttatgtctttagtaattacatttcttcatggttatttaagcccatgaatcataaatcatcatttatagttgagcaattacctcatcatgtagcacttcaaatggatagagacgctgtacttggtgtcaaacataagcaactgtgcgtgtcttggtactatattaatatatatcagtaaaaccttgaatatagaataaaaatgttatctacagccctcatcgagattccagcccaggactcagcaagctttctctgtaaaggatcagagaataaatattttaggcattgctggccaacaagacatacactctgcatttgcgtcaagaaagcagccacaaaccgtgcagaaatgaatgaatgtggctggcttaattcagggcagcacagaacaagcattggccagatgtggcctctcaggctgcagttagctaattcctgttctagccccaggatagaaactgagtgttaccacatgggccacctctggatacctctgaatattggtgaaggctggcttagaagggattggagaggaatcagtgagtgtgaatacattggaatagagtactctgattcccaatactagataagtgttactaattccttagtgtgtactagcctctgtgttgagacttacatccccctaaaacaaatcagagcttgtcttactcttattactcccattttacagattgacaagatgaggcaaagtgacattaagtagctttcctaaaatctcacagatgagaagtgaatgtctgtgtatgaagagagtagaggggagaagggcaagcaggatttgaactgtaggggccaagggaaagcttccctctccgctccaaacccttccccccactgaaggttcaagtctactgaaatgaactgacaatagacagattaacagaagaaaagttaaacaaatttactaacgtgcataagcatggaaaccatacaaaatatgagactcaaagaaggcactgatggctgacagttaaataccctcttcataggagagaggggaatggaaactgtaggcaattgtgagggctagtaaattattttcaagagaaatgaatgagcccaaagaatacacaatggctgggacaaagttcctcggagctctggaggaagtggagggaaggtgaggagcagaattgcacaatgaacaaaggttgacttattatgcaaatgaaatttcccaggtaatctcttggaaccgtcctcagaagaatagatgaaaaatctctctgggcacatgataacttttggtcttttctcttcttcagtggttaatcatttctgattatttcatgagattccaagggagggggccttaagacaattaacatgtcttttggaagaagttttcctttgtcacataagggaatttccagagaggccctacctgagcattggaggcagaaatatgagaagattagaaagtctttgaatctgaggcaacttctaaggccttccaatgtcctttaattcaaaagttctcagcatgccaaaatagcaaatgacactttgaggtatcattctctgagtcccagcagaaccaagaccaggaaacaggatgatggaggaggccttaggccatgggtttgttcttccaaaccagcctcttaaaaagaaaataaactgtttttctatagtctcaacacttctgacaacaaatttatggggatccccccgatactaaccaattctgcagttctcagctaatacagactgggtgtcctcaattccgatactaactcactggagttaactcagactcacaggttaggggtttggtagcacaagactgcccactcttaccccaacactaatagcaagtagtggtccccaggttacccacaacttctatcagacttgattacaaattgggtttggcaatttgccagaacagctcacagaactaaggcaaacagtttacttactattaccaatttactatgaaggacattttaaaggatacaaaagaacagtcatatgaagaggtgcatagagtgaagtccagaaggatcctgagcatgacagctttggccccatggagcttggggtgcaccactctcccagcatatagatacattctcgttcatcaacctggaatctctctgagctcctccatttgggttttttatggagcttccattacataggcatgattgatgaaatcattgacctttggtgtttgagtcaagtctcagcctttcttcccttctgggaggttgggggtagagcttaaagtcccaactctctaattacagggctggttcctctggtaagtggaacccattgtgaaactatccatgggcccaccaaagtttaccttattagcataaactcaggtagcatcaactatggttgaaaggggctcattacaaataacaaaaatctctgttacttaggaaattctgagcttaggaattttaggacctctctttcaagagctagggatgaagatcaaatatatgttttttattatatcacaatatcacacctctcctaaatcagtaatgtttacctttatgatctcatatatatatacatatgtatatacacacacacacaaacactataaatatgtatatataatatgtatatatatgtgtatgtgtgttatatatatacatgtgtgtatagacttatatgtatctatatgtgtgtgtatatatattaacatgacgtgttaacaatcaacagtcaattgttattcacatgtgcctagcttctacgttttagttactcatcatcattgagactaaaataatctagaatattaaacagcctgtaactcgggaagtagaaaaaagcattaaacatttgacataaataatttatttgtactaatgattgatttgaactaatttgagggggtaacttgggtgggcaggcacagacacacagatgagcatatatggccatgaaaattttatatttagggaaaagccatgagatgtcactcaaattatcaagatgtattgatgtttacagggttctttaactcttttgtaaaataattgttcagaaaacccctccacacatcactaaatagttataattttgatatgtctctttgcagctttttcttttacattttttcttcttaatatttatgtatcagagcattatatagctatgtctatccctcacctatctacccattgcttaaatttaataaaacagtatatacacaatgcatacatggacaatatgctacttcctccttgaatctttcaccacaaatattgtcccatgttactgaaaatttctcttaagccacgatttttcattttcacaattttgtcctttgacttgggcatacattatttgatcattaaaaaaacatgacattttagatgttgactcatttctgctatcataattaaagctgtagtggcttatttaacagtaagtttaaaagtgtgctgattattacattttttgcatgatggagatgagaaaaaaacatctgtagaacatagaaatgttagaataggttaaagacgttgctatccgaatgtgttgcctctgtattgtgttttaaaaggttgtgcgaatgtttgtttgcttttatctctttggccatgttttgtcatctttggtatcatctcatcctctgtgctttgtgactgaaattgaagtgtatttgttcagaacacaatgatactagatcgttgattgcctacagcattatggcttggaaatgaacacagtaaacagaacagagaaatggagttgtgcagttccaggagtggattagtacgttatgttgttgtagagcagtgtgtattcaaaagatttaaagatgccttatcaatggagacaaagattattttcaattgtgagtggcttaacaacatcactcactctgacatggcctaaatgctaatttaggtgctaaaccaaaacaaaattaaaaaaaaaaaaaacaccaggtgaagagcatttcctacaagcttgaatccagagagagttcatatataagtttacatatttatgtatagtatgcagtcattacatatctgactacatatacacatggtaacatgttatctatatgtgtttatgcacagaaatgcatgacaaatacttgttatggcatgtgatgaatatgttcttcatgtatgctcacctaaactatttacgttgatttaatgaaattgttctgtctgaagaatgccactacaacgttaagaattatccctctgtaccgtaaatgaatctgagttatctgaaaatcatagccaaaaatcttggagtcttgaaaaattctagaaaaggagagtatttctcataatgtatgtgaaataaggaaataaatctttaattttacaacccagagttttagtttttacctattcacaataatcaggcagggtcccatcctcccagggtaagctgtagtcaaggcctgggagaccaaactgtaaaccagaagggagattgtcccaagatttttgtttttctcaggaaaagatgcaaaatatttgtgacatttacatctgaaacagaaggacattccagagatttctcaaatcactaaaaatagaactaccgttcgacccagccatcccattactgggtatatacttaaagggaaataaattattctaccaaaaagacacatgcatgcgtatgttaattgtagcaccattcacaatagcaaagacatgaaatcgagccacgtgcccgtcaatggtgcaatggataaagaaaatgtggaacatatacaccatgaaatgttatgcagccaaaattatatcttttgcagcaacatggacgcagctggaggccataaccgaagcaaattaatgtagaaacagaggaccacatgttctcacttataagtgggagctacatcttgggtatacatggacataaagatgggaacaatagacactgaagactccaaaaggaaggaaggagggagggagaagggcaagggctgagaaatttcctattaggtactatgttcattatctgggtgatgggatcagtagaagtccaaacctcagcatcacatattaaacccttccaacaaacctgcacatgtacctcctgaatctaaaataaaaaataaaaataaaattaacaaatgaaacagaggactgtgaagacttatagtttattgttttagctgatttccttttcccactacccactttaatcttttttgggcaatactcactgtattagttcgtttccacgctactgatgaagacatacccgaaactggaagcaaaaagaggtttaattggacttatagttccacatggctggggaggtctcagaatcatgccaggaggcaaaaggcacttcctacatggcagtggcgagagaagaatgaggaagaagcaaaagtggaaaccactgataaacccatcagatctcatgaaacttattcactatcatgagaatagcaaggggaaggtctgcccccatgctattctcatgatagtgaataattctcacgagatcttacgtgtagacctcagataaggggtgaatgaggactgaactctgactgctgttctgtgttctaagtttctgaggtggctggaggagctttcacctataggccaagctcaaattcctttgtctaaaacccccaagtttttagacaaagcttcacttccttaaccaatcccaaatcagagaatctttgaatccacctctgacctgtggacccccctttcaatgtggctcacctttttagcacaaaccaatgtatagcctccatgtattgatttatgactttgcctgcaacctctgcctcctgcctttgaaaaccctgacacacaaggcattgaagagtttgggtcttaagtgttagctactgtattcttctttctcagagccctgcaataaatgcctcaccttcttttgctgcaaatcctgtcaatgtttgcctttgctgttccaggggtgctggatccaagctcggttcagtaagacggaagtcatagagctgactcgtggtctgtggtaccaggaagggccaaagtcaggccacaccaaccagagaggtctattgggtcctgacagggaccaagtggtcagctctctgggcttcagtggtgacttccagcaggacaagcagtgaccaggagacctttagggtgcacttcccaggagaacatgggagccagagaggctgtgttcagacaccctgactatccctctcatcgagttaggacaattcacacacatgaccttccatgtacctagagatcagtatagtggtaccattcagagaacagaccatagcaagtgtgagagactgagattaacctcataacaattccaaaccagatgagattaaagaataattatcctctaaaacaagggtggagtatcccttatccaaaaatccaaaatccataatgctccaaaatccagaactttttgagcaccaacatgactctcaaaggaaatgctcattagagtattttggatttttgattttcagattagaaatgctcaacccctaagtaaaattcaaagattccaaaatccaaaaaaatccaaaatctgaaacacttctggtcctaagcattttggataagggatagtcaacttgtatgtgcatatgtacatatgtatattatatgtattatatacatacataatcatatagagacagaatacaaaggatatacttttgtccctgaacatccaagttggttgcagtatgaatgaacttttgaggaaagcctcattggttatcttcctagtttagtagaggcattccttggatcagaaggactgtgtcctatttatcttaatattctcagtgcctgggaaaatgtcatccacggaccatcagtatctatatcttctggggggttgctagaaatgcagaatcccaggccccacctcagacctactgagttagcaagtgcgttctaacagaacccttggctgattcgcatgcccatcaaagtttgagaagtgcggccctaacagatgatcagtaatcacttatagaaagtatttatagaataaatttgtaaaatttattttcacgtgcaacattcatgaataaataaatgaatgtttcacattaataaataattgaataggctgggcacggtggctcacgcctgtaatcccagcactttgggaggccaaggcagatcacgaggtcaggagtttgagaccatcctggccaacatagtgaaaccccgtctctactaaaaatacaaaaattttccgggcgtggtggcacgtgcctgtaatcccagctacttgggaggctggggcaggagaatcgcttaaaccagggagttggaggttgtagtgagccgagattgcaccatagcactccagcctggtgacagagcaagactccgtctcaaaaaaataaataaataaaaataaataaataaataaataattgaataagtggagtaattaaaactgagtccagttgtgtctttctttacttatttagaatgcttgcagacagaggctgagttctggctttcacatccagcttctcttaaagaagggccttaattttcccccttcttcttcttcccagacaggacatcttggggcctgaagtggggtggggttcttcctctaagcctttctggcagatgcacagacaaagtcttagcctgttcactccatgaattgtaaactgcaggttcctatagaatgtagttctcagaatgtgcacatttatatctgtgtgacatgcttttccattcctttttcgtatctgcctatattcagaataatatgcctaggactccttgtcacaatattcgacatctttaattttacttgatgattgtataataagatggcccatgcccttgtctgtctgctgacacttagcagggagtttgtttagtgctgtgtattattttgatttatgaataacttctgaggatcaattggcattgtccttgggagcttcctatcatcattacttttgaaccattagtttgatgcctttagcaaaaggatctacgaccttaagaccttaaggactcgcttcatcattttggagttgagcaaccccagttgaattaccctccttatggtgttgtagggcttagaatagcaactggtacttggtaagctgaatgggtgagctattgctcttattcatgcattcattcatttaataagcatttattggcatccactgtgcattggatatgaagaatgtacatcctagcactttgggaggcagaggcaggaggatcacttgcacccaagagtttgagaccagcctgggcaacatagggagaccgtgtctctaagattaaaaaaaaaaaaaaaaagtacaaataagcaaggtcctgctgctgctgtctctgaggttctcccatttatgtgggagagatgatcttctgaatgatcagtaatgaaatgttataagaaataccttgaaggtacaatggacagagctgtaaattccacctggaggcaatgagaggaggcatcacagaaaaggtaccgtttaggatgggccctaaagatcagcctgcatttaccttaatcttctctctccattcagcctgcgcaggaaatccctgatcagatttcagccagcaaaacagatcaagtagcttttatggtccacggagcaatttaaagtgaggtctacagagcaatttaaagtgagactctgttttaggccatttcactgctcctgtcccccagtgaagaagaaaggctggatttaaaaaaaaaaaatcctggagcctggtatatatcatgttaggaaagcagcctgtttgaattcctttatcagttagtgcattttgttttattcaaattgaataaaaaccttgcccgaaaagaggtcgagactcttctcaatctctacattttatctatcccctgaaatgcttttccaattctttaaatcatcacggacaagggaaattgtgctctcgagaggaaagaggggcttctgtgaccaatgcttctgaaaatcctccaagcttacttttctgtcaggtcaatcaacctgtctatgcactcttttatttttattttttatttttgataacagaaaacaaagttcacacacgacaagacataacatggcataacatgaaaaatgccacgcaactctgtggcactgaaagcaaacgtcttcagactgacttaaaggacatattgtgttttcttaagttaggaaaataagcccgctctgtagcaaacagccaagtgctggggtagttgtggtgcaggagtgttcccctgggcttaaggtctgtgtctatcaaaatggccaaaaggtcagtcctggcagcaggaactagttcctttatcctttccctctccaatacctgcctctttgcaaatgtttgtttttcccactgagaaaataaatgcactgtggagatggaggataagagagcagtcagatgagcgaactaaataaagcaatcatgttggagacagagtgggggagatcagccaagacctttagaggaaaacagagacctgtggacacagagtggggaggtaaatgtctgcaggatcatcattttgaagagtcttaaagaaataagcttgaattatttttttaaatcaaatgatattatgacaaagagaataaattttatcctgaaagcaaaatcatcccttgcaactatttaaacttatgttaaaatttttagatgtcaacttaaaataattcagagcgtttgaaacttatcaaaattctttgaatgccaaagactgatattatgcttgaattttctacgtgagcatgaattagtttttctaattctaattagatatacttaacctattttaatttgaaaacaaaggaattggatgaatgcaatggctcatgcctgtaatctcagcactttaggaggccaaggtggctggatcgcttgagcccatccatgactttgagatcagcctgggcaacgtggcaaaaccctgtctctactaaaaaaaaaaaataataataataatacaataattagcagggcatggtggtgcatgcctgtaatcccagctactcaggaggctgtagtgggagagtcgcttgagcctgagaggttgaggctgcagtgagctatggtcatgactctgtactccagcctggccaatagaacaagaccctaattcaaaacaaacaaacaacaaaaataaacaaattagtaatcatgtaatctgaatgggtgagtttgtaaaattttaaagtaatgaaaacactaaaagagttacaaactgtatgtaaaaatccaaccattaggtggaaaagtacctgtagcagacagaaagacagaatccgtaactctaatgaacaaaaaataaatgtaaatttaaaacataaacagaaaaagaaacagactctttacatttttttaatgtaaaaccaactaatcaaccaaccagaaacccaccaaacataacaaatttcaaagaggcgccaacttgtattttgtattctggaaaccattaagaatctgcttgtgttggctgggcatggtggtttatgcctgttatcccagcactttgggaggccgatgtgggcagatcccttgatgtcaggagttcgagaccagcctggccaacatggggaagctctgtctctactaaaaaatacaaaaatcagctggggatggtggcaggtgtctgtaatcccagctactcgggaggctgaagcacaagaatcatttgaacttggcaggcgaagactgcagtgagccgagatcgtggcattgcactccagcctgggagacagagtaaaattccatcttaaaaaaaaaaaaatctgcttatgcttatcccctcaagatctttagttttttagttttgtttcccctaaagctatataagctcacattcatagatattaattatagagtttttcactggaaggcattttagaacccttttgcccacagttaaatataattcatgaggaaaatgtaatgtgcccaaggatatgaatatttcttttctctcccttatttccacattatgattctgtatggtatgaatttattaaggctcatgcgagttgagtccagtttaccctctcaggagattacactcccagcagccctaatagagtgttgtcacctagtattcctctgtggatttttcttagcatatgaggctttctcttattttttttttctgatccctgcctcaaggccagtggcttatcaatggagtattgaagtaattgggcacgtgaaacaacagaatgggtttcactccacttttaagcgtctgatatgtgctagtaaaatggacaactgaagcttcagggatacagggattgcttcttttccaagcaccactatcctgcaacctgtaccaagttattgtcagtggatttttcctatacagactttgggcaaactttctcaaccttggcactgcagactttttggaccagataatttttcatagtaggggctgacctgggcattggaggatgtttagcagaatctctgttctctacccactggatgccagtagcacatcctgcctccagttgtaaatttaaaaaatgtcttcagacattgccaaatatcccctgggtgagggcataatcatccctaattgagatccctggtttagagtagttggaaagccctaatttatcttattggagaactgacgtattacagcaaacaataataacaacaacaaaaatgtatgttccaatgtttggaggtattctcctaacctaagtgtgcacaaatgtctgccctacagaatggagacagtgtctatatatatagtgtgtgtatgtgtgtgcatgtacacacgtgtgtgccttcttatatacctccacacacagggtgagtggaaataatctcttctcctatagataatatgttgagtaagtggtgctatagtgtttgaattactccagcaattcaagtcccatcgtggggcaccataacagaatgagttttttcccatctactcacacgccactcaatataattcttctgacaccagatgggtgggcatttgtcccaacacgccaagcaattctcccacggacaccagctgggattcctctagttaaattaatttctggcactatctacccagagatggtgtcaaatcccacaggttgaagactgagtcccacaagactgccccccacgctttcaatgctagtcacaagtcccaggttgtgacctgtgcttctgactggctataaattgggggttcccacaacctcctcctcaggttcagtgaattttctagagtggtcacagaactcagtgaaacactttacccatttattaggaaggatattacaaaggatacagatgaatgggcagatagaagggattcacagggcaagggatgtaagggtacatgcagagcttccatgccctttctgggtccatcatcctcgaggaagctccgtgtgttcagatatctggatgctccctgagccccatctgatatggtttggctgtttccccacacaaatctcatcttgaattgtagttccgataatcccatgtgttgtgggagggacaaggtggagataagtgaatcatgcgggcagttttccccatcctgttcttgtgatagtgagtgagttctcacgacatctgatggttttataaggggctttcccctcctttgctctgcacttcttcctgccatcatgtgaagaaggacgtgtttgcttccctttccaccatgattgtaagtttcatgaggcttctccagccctgtggaactatgagtcaattaaacctcttccctttataaattacccaatctggggtgtgtctttattaacagcaggagaaggaagtaatatgccatccttttgggctttttatggagactttatgatgcaggcatgattggttaaatcattagccattggtgattatgctatagtctgaatgcatgtatgctcccaaaatcatacattggctcctaagagccaatgtgatatgatagtattaagaggtggggccttttgggaagtgatcaagtcaggagcactctgctcttatgagtgggattagttcttttagaaaggaacttgatgggagctctgtagtcttttcagccccttcctccatgtaaggacccagccacaggcaccatctctggagcagagcaagccctcatgcaacactgaattggcagatgccttgatttggacttcccagtctcgagaactgcaagaaaagaatttctattatttacaaattacccaggataagatagatattttatcatagcaacatgaaaggataagacagtgatcaattcaaacttctccttttccctccccagaggtcaagagttggggctgcaagctccaaccctctaatgacaaggttggttttcttggccatcagcccccatcctgaggctgtccagaagcccaccaagagtctcctcatgagaaaaaaaacatgctcctatcacccagcaaattcctacaaatttaggagctctgtgatgggaactgagggtcaaagaccaagtgtagaaacaaatgattctcctagcaatcctacatatgtggttttaggacctctgtaccaggactcaggggacagagaacaaaaatatatttcttagtatgtcacaatatcacaggcactttggagagtattggaactggacacacatgtcccgggtcctccaagctatttcctgccaggtcattactaaggtgtaggtcgttcctcgctcaaacacaggccagtagtgtcacactgagtgacttgagagaacagaagtagatattcctgctcctccactcatatcccagaaaaaccaattgtattaccaggaaaaattatggtaggtacttgcttctttgctgtaggtgctgtcttttctttctgcattcagctttctttaaattagcacctccttcctcctcctcctcctcctcttctcccatcgcctcctccttctctctctttctttttcactctctctcccccaaccccctttctctcttttctctctgtatctctctgtatctctgtctctctctgtcacacacacacacacacacacacacacacacacacacgtgtgttgcccagttatgaaggacgattctgatttctctctttcaaagaaagaaaaaatgacttcataatctcattatcaatgagatcttagtggctaaagcatggcttcttccaagatagtatttgaaaaaaggttctttgggaaaattcttaacaaagattagattaattccaggaaatatttgttaagcactgtcataggcatctgacaagcaaagaaaagtaaagcatggacattcagtgctgctgcaatgtggtgtgtgtgtgtgtgtgtgtgtctgtgtgtctgtgtgtctgtgtgtgtgtgtgtgactgttttggagcaagtgagtcttcctgaaggaaaactaagtaagcacttgatccacctaaacctagtcacaaatctaaatgaaaaagtaggaaaaatcagaaccaattatttggccataatgaagtgtcagtattttaagctctaagagattcctctctaatttgagaagaattgagagattgcccattatgacctattgctggtatcttgttaatgtttctaatcatttttttttaaatggtgtatatctttttatcaattacttatacattgcctcccttcctttccagtagcaatatttatttgtttcccattttaagggagtaggtctatgttggacttgaattttcgttccctaattgtttaatgtataaatacttgtctgttctcagacatagaagtaggcagggtttccaccttcaaattaaagagtcatagcaggatagttcagtaataacatatttctttatagaagtaattcactaatgagtcttatataatgtactactggctaaatctatctccatcatgtaagaatacattttatgcttggtctttttttcgtgatggatgttgcccagttgtctctctcctcctgacgagtcgcgtacagagtgtgggcactatgcagttaacataaaagtgctggctcagccaagtttccccaaataggcccacgaagcaggtggttcctccccagtggaggcatttgtcattacagacaggatctaaccacagaaaaggggcaatctgagtaatgcagagagtttagaagcagcattgaagtgtacatgcacacacacacacatttgctttttttcctctttcttcttaaagcatcctcttgaacaacctaaggaggaagacaattgcaggcacaccaggatcttcataggacaacacagtgcagaatccaaactccagcagtttctaattttaccaactcaggggggactgaaattggggacagaaatagcacaaaaacaatagaaatgcatgtcatgaagcctggacatgaacaaagcaggttctgtcatgctgaactttgggcagacagaaatggagggactgagcttgttctgcaattcttttcagagctattttgcacttttgagacactcatgtggttgaacataacatatataaacaggagtataatagctagtcagagcagcagcatggaattcataccattgtctttgttacaagtatttcatagttatctatagcttttcatcccttttggtttatatttcaagtgtctgtgaaagcacatcacattgtgcagccctgatccactcttgtttttactggcactctgaattttctcattggcctccctttgccaagctttgaagcaaagaaatcaaacaagtaggacattcaggtgggtggtcactggacttgggaaattctaaaataaagcaactgatgaatagcacatagtttcaaaggggcttttcagctgcaagacatatagatccaggtatgttggtgtaagcctcaaagaatctcctagcattatgagggacataatcaaaggagattaggaacatgaatccaaggcttagaaatcattctcttgaaagagtgtggaatcactcactagagtatggaattagagacttattagtctgagtttacagtttggctctgtcacataatagctgggtataaaaattcctacttcatgtggttggtagaggaattaattaaattgcattctagttaccagcaggggagacaggggagaagaaagttggacatgaagcagtggaaagcaaggacaaactggagctttctaggataactgggcactcatggagagtattggaactagaaatactctccagtactcatggagagtattggaactgaaagctgcaaggacacctagagccaataaggataacctggagcccatgcagactagttggagtctaccaagacaaactggaacccacatctatttaattccacattgaaactggaccattcagtgatctgtagaaaaagccagtgccctttggatgaaattgcatgtggacctggcctggggcctggagtcactggaggaagtgcttggaaggatttggaggagttataggcccagtgaccactccataccaacatggagtggaagtgaccaatgaaaacttgaactggtacatccttgcttgtccccatgtcagccttctgtaatggctgctaattcctcataacttccctgtattattaaactcaacttgggtttacccatttggcacaacaaagccaaattctgacatcagggtttgcagtgcgagaaagtgggggtttttaaggcagggaggcagaggctacaggcaaagtcataaatcagtacacagaggctatacattggtttgacctaaaaaggcagtttatcttgaagtgggagcttacaggtagattcagaaactttctgatttgcaactggttaaggaagcagagctttgtttacagacttgggatcagcagaaaagaattttcactctgttctatgggtgtgagttcttccaggcccctcaggaataaatttagagcaaaggatggcagtcagatgtcagtcctcggtcaccctttatctgaggtccagatccaggtatgttggtgtaagcctcaaagagtctcctagcactttgagggacataaagggaattaggaacatgactacaaggcttagaaattcttctcataagacagtatggaatcactcactagagttttggaattacagtttggaattagtttggaattagaaaatggatggcatttttcatttggtagtagcctggattcctgaaaaattagggtcatatgtcaagatattatctttagtgtctataaggaaccaaacattttgggactgtaacttccttaaatattgttttaagctattattacgtccttgcttatcaggttgcttctttacttctcaaggctagctaggtgcctggaatttcccttgtaggaactcaagactttcctttatttccatacatggcaggggatgggggaagggcactggcaggtccctcagagggttctctactccatctcaccagtctcacaaaattttctgtgtggccaaccttaacccagagtcatacaggtaaacaaattctgaaaagcgtagaactcccttagctacattaacacaataaaaaaaccttaaacagactttcttctattacaggtgaaggttaaatagtcctatctttaaaaaccagacaacactggttctctgaacttctgacagtgaatttcatctggtgcacaaaacagcctatttcaggagatcaagtgcacactcaaatctagtcctgctgtatcccaggccatgttgagaaggcttttggttagaacacttctttctctgagatcacgtaactgcaggagaaaacaccaacatcaacaacccgaccaaaatattttgatttggtggatattaggttctaagttttgcctagagactatttagaggggctcagaaataccacgatatgtttcatttcttagttcatgtctcgtctctgtagcatcattttcaccccaactctgaagataaatagcattgagccattgaagatgaaactcacttatcaatccctatgtggaagataatgccatcgaccaccttctgtcttaggaatacatttcaaaaatggaaagaatgcttctctgacctactctttcacttgtacctccttattaaaaaccaggcctcctttgaataggagactcagcacatttgtctaccctgctggcccaaaccaagtgagcataaatccttaaatcctacaagcacatgcacatggtcaccaaggcacaagcacaccatgcagtgtgaacttgagtaaccaatgaggactattccaggacttccagaggttcctgttctgagccactgttacatcctgggagatggccactctccattcaatggagattttttccccctttttgtagcatgaggtataagcacctgggtaaagtgcagttatttttgagtttgacaagtgagcatatattattgtttagcatgccttctttgatgttcaagctcaggagaaaaatctaaaaaaatacacaaaacgtccagatagaggattattgatctacacttcaacagtaaaaaaaaatacaatagatttttcacccacagactttttccccttactctgggaaagaccttttactagcaaagtatgactctagattgtcctggtctgtagatatacaaatattgacatggaatgcaacataaagcatacaagtagtttatcaccctaagttattatcctttttaaggaatcaatcactgtaaaattggccatgttgacactcatatggatattacttacttgataaatgttgaaatagaccattcaaacagatgcattcttaatattttgaagaaatgcccatcttgaaaatgctgcagagattttcctccatatatttttatctgaaaaaaattggattcagctaccagagaatgctccatatttactattagatttactggaaactgaaagaacagaatgatgttgcctctatagtctgacatatgctgggcatatgtaaaaagaaaatgaaagagtacgtttgagtatgaaatgagcattcctttattttttccctgcaaaaatttttccttttttatttttttactgaaaaaataaggtacttaacattctcagatatatgatactccatattttgtctggtaacagggaaaaaaagttattaggatacagtttgtgagtttttgaaaaacaacctgctatagcacatactctgccaggtctgtcagagtgaaatacctttgaaaatagaactgactatattttatctgcttagtttaaaaatggagcgagttcccttgaaatatgatttccaagttttgaagtcattatgagtgaatgcattctattctaactccagaggctttccgagggagaaactgatgggcccaggaaggagatagtcacccgtccatcctggtcttgtccatataattcaataggcttcatagagacatcttttctttaatcaatttaaatgtcatttttaagactaatttgtacagaattgttgtccttattaattcccttgttctctatggagtgatttttcagaaatcattactcttctctctttttgcagttttaaagctttgggcattaaaaattaatttttcatttttttcttcattttgatcaatttcctgaaaaagtaaaatgatgcagagtgtatactatggggtaatactggctggttactaatcttaagtctgcatttactaaatgtgtgatcttaggcaaatgactggacttctgggttattctagattactttttggtttgttttattgtaaaatggggataataaaagtatctattttatgaggttgtggtgatgatcaggaatatatgtgaagtgtattggacattacatggtgtatagtaagcaagtcagaagtgtttgttattaccgttactacttaacaacattaaattatattaaacattatttaataacattgctgacatttgctttgccaatgtaggaaatctccttcttcaatcctcttgcttccattctcttaagctaaggtgatagtttaatcaatttggggtaatgttgatttgatctcatacctgaatatttgatatgccttaattcctcactttcaactgtgttaggtttttgtttgtcattttgtgtccacatagaggagggacttcaattcagcactgatttttcaccttgaaaaacagcataatagcagctttcctttggggacaatcaaagacaaaaacaagcgatccacttcccctgcctagccccttttctcttttcctctccatttcttccaaacacacaggtattgcagaaggtacctttgagggctgtgtgtgggtaatgatgtggggaagagcctggctgaggcacgcctgtctatattgacattttattaaacttatctacttaccatgttaacatgtgatgctttttatcaattccttccttgaaggaagcacagaatatccatcatcttttaagtgcttagtgcttgtaagtgtatgtcacttcacagaaaataaatacttttcttatgagaaattcaacatagttcgagggcagctctcatgagcatcttctggtttaagtacctgtcaggactttagccagtgccgactggggtttgaggtccttgaaatcacatattgagtactgacctgcagagagggcccaatacatgttatgcaaatgaatagctgactggaagttcattctcactgcattgcaacaagtgggtgggaaagaagcagggggagagggaggaaggagagctgaaaggtagcaccgtcacccaggagagaatgatgggtgtctgacccaagccagaggcaaggcatgttgacaggagaaaacagattcaagggcccatggaagatgagaaatagtggactcagtcccaggtgttcattcatccagtggtgggagagggagggtggggaagagaggagtcaatgatgaagttgtgtttctccacattgaaggagaaattgtgatgctttttatcaagctggagggcacagaagggaagtcaagggtagagcacataggatacgtattaatgagatgtccaaaaatcatgtcatttagggttccccagagcaggagacatccctggggaaactggtgacttgttggctcctgggttgaaggagctggcaaaggccagactaagacaagaggagggtcaggaaggaatgccttggaactgagccatttcagaggatttggataaaggaaagtgggggtccacgagagatactaagaagacatcagaaaggagggagcgaaatgaagatgtccacggaaagcagctaagaagagaaaaccaaggatgccatgtacagcaattgcatcaaatataccagggaccagatatgtctattttaaaaacctatttattttattgtggttgtcagagccaagggaaaagttcacacctttgccctctgaagttttgctgaaaaatcaactcacaaaaagcagattaattggagaaaaagcatataaatttatttaaaatgtgcacacaggagacttcaaaatgaagacccaaagataccggagaaattgcccatttttatgcttaggttcgacaaagtttgaaaagctgtgtagaaacagggttggacaaaaagggcctgatctaatgctaatagactgagcagggaaacccagcaagacctgtctgtcgagattcttcttggcctctctgagcaatatttctcccttctgggtgtggggcaggaccctctggggtcttaaagcacttaagactctgaggtcttaagaccctctggaatagggggtcttaagacctaaagtctaacaaggtaggtcagggaattttgttatggccaggttttacacagaaaggcagagggaaaattagagtcatacttttagggttttatggctgaatttggagaaaaggggttttggtttctaggacctgccttggggaagagggattctagtttctgtggtgcctctggaaagaatggaactgagagacagaagggcaggagaagatcagagaaatccttctgtttctgagaccttcactttgggatattgttttatgagccccaacatgatgtaatttacatacagtaaaattaaccctttaagtgttcatcatgtgaatggcatatacagtgacagttgtgcaacaccacaaaatgaagaagatatagatcaactttattaacatcactcttcctacacaccttccagaagtacatgcccttttacacttaacagcatccacaatgcaggccctggccagtactcacctgttctctgtccatatagtggtgcctttgcaagaatgtcatataaatggaattacaaagtagtcagtctttgaatttgccttccttcacttaacatcatatacaagagataaatctgtgccactgcttacaagtggttcattcctctttattgctgagtagtattccattgcatggatgcaaccacattccccattcaaggggcatgtgtactgtctctattttttcatctgttaagttgagttaagaaaatgttactggtaaccaaggcaaaagctgttttagttcagtggttggaatgaaagctgaacagacgttggatgaggagggaatggggagttgtgaagaggagaaggcaattttagtttaatattttatgaaatttggctgggaagcaagggagagacagtgatctgtagttccaatgagaaatcagctgaaatgaagattgttacttttattgtaggaaaatagatatttaatcatacttaaagggggatacttaaagggagaatacagagtttttgttcctgcttgtttgtttgttttactgttatgatatatacacacctgaaaaacatatccagtagttagcaaaattgttgtctaaaaatagcagggctcgtgggaagatatgtgggaaatacttttctcaaaattttttgaactcaactttctaacctaattaaaaaaataaatataactgtatcaaaaacacaggaaatgcagatgtttaaagtcctatttttaaaaggatgccaaaatgagtgtagaatattatcataaaataaatagtgatagtttaatgggagggggtgcacagaaggtttcagaagaaacaggcaaaaatgcacaaaagtcagggagcaccaggtaataactgccagaaagagaaaatggggtgaacgggaattgttatagttctctttttttcgtatggggctgatgccttcatgcttttaaaagtacactttgtattcctttgctgttatttggtggtatgaaacatttatctctggaatcaaagtaatataagccaatgcaactttcacatttttctgacattattcttccatttctcaatggcctatcagctaattaatgataaagaaatgggtatgtatctgtagaaataatgatgttaaaggtgcaggagagacaaagtaggtggagtgaggtctcaaataatttaggatgagatagcatgaatgtgagtaatcccttaaccatgaagtccctttaggaggcatctaagtcaactccaccatcttatgagtggaccacattgaataactcatagatcgttaacttcacctcccaagtttaattggaaacatttttcaattgttgaaatcattatctaccatttttttaagtgtttagtacacatctcataaaaggcaaagatacagtagcacacagtggatacattttggataaatcgcaaggtgaagagttatgaaagctatcagtagattatttcattttcatctctctaagtaagctttctattcgttctattgtgtgtcacataccttgttcaagtgtgaacttatattaccacctccagcttgtcaggcagaaccggacaggcttgttcaaagatcagggcaacaacttcaaaatggcggtgccatattgcaatggccacagaatttgaggggacttgaccagtgttcgggcttatcctagatgaggtggtacaatatcaatttcagtctgcgatgaccataatctaacaagcaattgtaattcttcctttttcaatgctccaataatttccctgttcaggcttcaatgatacatctaggaagtagtttcataattatctgtgcatgcattgatatccccaattaaatttgaactttaagagcaaaaggtttatatcccttcatctgtgaattcaagctgctagtctcctgtctagcagccagaatgtgttacaatcagggactattggatatatgcatgaaaagttaaagaagcatagttatattccaactactgtccatttacttaaactgactacactcattctatcttttaccaccagacctgaagcactatagctaaacataaaggtagagataaaataccagaacctgagacagttctaggaagagtaaagctaactccctggcacagcattgctcatagacaggcagcatgaaggaagagagagggtatcctgtgtgagaagcagacctgggttcaaattctgactctagcattttgtagctgtaggagtctgggtaagttatctagtccattgcttctcaaagtatagtttcatgagctgcagcatcagcatcagcatcacctgcaagcttattagaaatgcagatttgcaggctccattccagatgtgccaatccagaaccagagttcgaattttaactaggtccccaggtgatgtgtgtgcatgttacattttgagaagcactggactagacactctgaattttagtttcctctattgtaaaatacagaaaaattatcaatcttccgaaatatgaagtctacaaaaatgcatgtcaaacacctagcagatagtgactgtgcaaaaatgaaagctattaataacaggaataataaaaaaaacagtaagaagtttagatattgaaggtgaagagaactggaagaaaagacaatagatatagatatagatatatctttctctctgccaatctatggcaatgaagtttctagatttgtatttaacttctattatggcaatggttctcaagtggggactcttttgtcccaggagatatttggcaatgtctgggaacatatttggatgctatggctgggtggtaaaaatgtgactggcatctagtgggcagaggcctagatgccactaagcttcctacaatgcacaggacagccccctataacaaggaattatccagccccaaatgttagtagtgccaagattgaaaacccctgaaatagatgcttctagaaatgacacatgttgcaagtggaggtcttccaatagggacacaagtgaaaactatataaatgtactcaaaatatcaactatgagttggattatgcaaatggcttgggaaaggaaatgaggaatgaatcaaagactttaccaaaagaaacattttccccatctccaagctcaagctgttctattagttgtatctccaagaaagttaaattggtatagttcttgtcctctaggagattatagtaaaagctggggattgactattaaggcatttgatgatacggatgcaacacattatgatataaaatgcgagatattttataaatcaaacgctgaacaaacatttaaaatgcgggcttatctcttttagttacaaaatactcttaatgattttaatgctcaactttatcttgcctgagtacttggttggtgaatattacttggagaattctttcatttacaacaaatggtcacattagttctctgtaataaaacacagtctgggtcataaaaacacacatcaaaagaaaaatttgccttatttattacttcaatttcatgcccaagtttctcttgccatgcctctttttattaattttatgatttttatggtttatttgtaagcagagtgctgtcccaaaatggatgaacctgtttaccagtaaatcagtaaactgtaaacattgctataaaataaagaatgttgttgtgataaatcaaaaatgaagaattctaggtatcccaagagagcatttttggtaggttacatcagctaactcaactcctgcacccatgaatcagtaatgtttgctggtttatgagccttggaaagcacaaatattcccatttctcctgctcagcacatctctgtagtaataagtaggtaattggttttgtcctattacactctttctatattaccctttgcaataatcacatataaatccacaggattatggtttcctttatcataaatttttcatactctaactccttattcttcctttcttagttgtagcacatactccagaaaaatatcacaacagtcaaacaacacagatgcttttgctttttgtgttcaaattattacatttctcaccattaattattttattaatgctgtaagtgaacttaccatctaaaaatacattatttttttctctcccatatatagatctcctggaaatctccaatacagagcaaaaattccacattaaatttccatggggaaagcaaaattatcatcatattaggataccattcctttaaaaactgaaaagggccttggagaagaatttgcacagtttttctacagagaagagtaaagtttttaccctatagtacataaaacacatagatttaaaaaatccaaatacaactaattttttttaattaaggtgaaaaagaattgcagaattttaggtaaaaacacataacatttttgccagtgctcaagatatttttgacaaaatattctccctaccttaataccttaatcatcagactagcatgttttcatttatcctctctctttctctctctgtctctcttcatgagtattcctaaagtcccactcagaaaatatttttcctttagttgactctgagtcagctgatgcagacattttattattcattgactaaattccccttcaatgggacatacccttagtagcagtattgtgaagctgaggcgtccatgtttgtgtatggggagcttttcatgcccctgtatccccgtgttaggtgttagtagtattgtctggcgtcacagacttggacacttaaggggaaatgtgttcttctacaaggggacagagaagagccttgggagatccaggaggctgcttccttttcacaccatgtgtaatggtcagtgttcatagaagacagtattaaccctacctgggcagcacttgagatgtcatgattgcttacattggtctcattccatcaagtaaagaaccctcatgagtagaagagccatctacaataaagagggatttgaactaggtagtgaaggatgcaagcggaaaataccatatggagtctgtaggttctacccatatttcctgttttggtatctcacttatttacatttttaaatcaaatgccttatttccttgtcttttgccctaaaatgatagtgtatgttggctgtgatggctaaatgtaccacttactacctctattgttgaatattaacatggatccaaataaagccagagaggagatagatattcccatgatgtccaggactcaaggctgggctttcagttgtctcctttcagggagaagtcagtcaggattttattgtacatggaattgttgcaacgtgttaggtggaggataattatgaaaatgtatatatgaagaagagcctatttttgggtagtggagcagcaaggaatttcatgggagtttttgtttttgaacacatatcaatcattcatcactccccagaatagtatcttcacttctttgcgcggtttgctatgtcttcatcgtgtgcggtcttataagggactttatgataaaatggcctccaagaacatcgtgaaagggtgagcatgtaatccatgttagagaaattggattctcttttcaaggcctttgaatgttacacagggcagaaaaataattggagctcatttatcccaggagctgtacacaaagaagcaatcaagcaatcattatttcctggattctggagacacctttgtccttgttagtttctggccctaattctttctgagctatgaatgatcctattgtttaaatcatttttgtttctttccttaagttagctagcaatggtttctatcactgggactaataaataaatccacattgacattccttatgactaatttcaacatacgatagtttgttaggtgaatatgatttacttaaaatcaattatccgtctggttcaaaacactagattagtcattttcctgtttttttaatcattgagggtgcccagtgcagaatattgatattattgtaaatcttatatttattacaggaattgcattaataactgtaacagtttaaaataaaaatcagaatgcctttagtaataaagattcttccattgaaggactcaagactgtgaaagtcacaataattaaattaacacagtagggttccatttcctatggggaaatagctgcagttataaacaaccattagtattcccagtctccaagtcacaaccagtagaatgaggccaggctgggtattaagtcagaggcagattaatggacattctggtaatatgaagggtaggaatgattaaagggcaaactcattgcgacatgttgtaaatgaggctgtagtgatgtggaccaaaactgatggggccataaccactggttgaaattgaatcagaaaacccctgtgtgggcatagatcaccacaatgccaataattaagaaaagatacagatgatcgattaagtttgtaaatagcatgtgacagctgatttctatgcaaatccatttaatgacagctaagtaaatgaaattgattgataagtatgactgttttaacttgagaggtttaactagatgtcattgtcttttacaaacacttccacaccctccaatattttgaaggttaaaccttttgaaatttctcaccctaaattaaaattagaccaacagaaaacatatgcattggtgagaaaaatacctggaaaatgataattcattgaggtcatcccttctaacctggactacataccttattttgggaaaattaacaattgcccaaggaaaagctactacaatcctcatcttgtcagctcttcctctatgattaatgaccagagaagacatttctaaggattgtctggaacaccctcagaagaaacatgggcttaaatttaagacatacagaatgttaagagtttaaactactctctgagtatataggatacttgagtcatctttaagaaatcattgtccaaggaagatgaaatttcaggctgaaaatgtcaaagtgaaaagcacaatacattgcttattctgataactggatattgactaattggttgtggtacctgtcccacagaagtgatctgtattagtctgttttcacgctgctgataaagacatacccaagactgggcaatttataaaagaaagaggtttaactggactcacacttccccttggctggggaggcgtcacaatcatggtggaaggcaaagggaagcaagtcacatcttacgtggaaggcggcaggcaaaaaaagggcttgtgcagggcagctccgatttttacgaccatcagattttgtgagacccattcactatcaacagaacagcacgaggaaaacccgaccccataattcaatcatctccatcctggtccctcccacaacacgggggaattatgggagctacaagatgggatttgggtggagtcacagagacaaaccatatcatgatctaactgactttttaaaattattgttattttttattataatagtatgcaaccttagaacatatatccccttgtaatcttcagtcttctcttgcacagatgaatgagtttatatggtgctcctgtttaattattcagatacatacagtaaggaacagttaagatcaattatgaaagaaacagtaacaacaaactactacaattaagcaagtgtgtggtttacaaaactaatctagatttatatttgttattttcttacattatacagttgtttagggttaaatccaaaatttcctcagagtattgccccatgaaagctaacatctcttcatctaatatttacttctcaactatgagctatggtttgaatgtctgtcaccttcaaaactcatgttgaaacttggttcccaatgtagcagggttgagagatggggcctttaaaaggtgactggatcatgacagagccctcatggattaatttattcaacggattaatgggttaatgcactaatggcttaatgggttattatgggagggaaactggtggctttataagaaggggaagagagacctgaacgagcgggttggcacattcagccccctcaccacatactgccctgcatcgccttgggattctgcagagtctccaccagcaagagggctctcaccagatgcagcctctcaaccttagacatctcagcctctatgattgcaaaaagtaaattacttttttttaaataaattaccgaattttagctattctgttataagcaacagaaaatgaactaggacacatcgtttccatgacttatagaagttatgaatctgtttgtttgcattttctcaaacagatatcctattcttgattaatatatagcatatccattttttaaagcagtacttgtcaaattttaatgtttatataaatcacctggggatctttttaaaatacgaattataatttagcagctctggagcaggaactgggattctgcattctaccgcccagctgctaggtcatgttcatgctgcttcaggtccttggggtagtcaggcttaagtcagggatcagccaatgtgttctgtaaagcaccagataggaaacatttctggtctagatgatctgtgccatctactcagtgctcccagtttagcccaaaagcagccagagacaatgaaaaaatgaaacactgtagctgtgtttcagttgagttttatttacagacactaagttttgaattttatattattttttctttcaggcagggtctcactctgtttcccaggatggagggcagtggcatgatcatggctgaatgcagcctccacattttgggcttaagtggtcctcctgcctcagcctcccaagtaggggggactacaggcatgtgccaccatacctagttaattaaaaaaattttttttgtagagacagggccttactatgttgcccaggctggtcttgacctcctggcctcaagcagtcctcttgccttggcctcccaaaacactgcgattacaggtatgaaccaccatgccaggccaaaatattatattttaagtttttttcaaacatttaaaaatgcaaaaaacttccttagctcatggactgtatgaaaacaggtggggggccagatttgacctgggaccatagtgcactgatctctgctttaattcatcattctatagtagattgagctatctgcaagaagtggattatacttgaataaaaacaagacattctcctccatccccagatgcaagttgtttatgggagttatctgaaaaagcaaaagaagtaaagagtttcatgtgcttttaagaaaacattatcctgggagattagacactaagaccacatttgttttttcatgtttattttaatttctggaaattatatttagagaagatatcaaccatctgtttaattgttctgtatttaatattacactatggatcaatgggacatataaaatacatttagtatgatttatagagattaattattgtccaattatggtttaattggagctttaggacatgactgcaatttctttttatttaatatttccatatgtccatacagttaccactaggacaaaatttaaatatctatataaaccattacattagagttttgagcctcgggtactgtacttagcttggggaaaactgttatatccaggtaaaatctctcaccctgttcttacagaactctgacaggactgtgttactgttgatgtttgagttttactttaacttcttttggccttgactatgtaacatccttgctttctggggtggtgtagctttggaaaactcagaataagggtggcctaatcctggaagaacagaaactgtatggaaattataattctgaaatccagaacatggcatgccacttcatcaattctaagataccatagattgaaagttgtatccttattttacatgccactaaagaatgagggcatgtaaaatacacacccacacacatacacacacatctaaaacaacaagctatccctttggcaatgtcagtccatcaattttgagtcacatgctaatttcatatctgggtcttagaatcaatgaaatatggtctttaaatcttaggtgcacatttaggctggaattatctaattttgcatttatgtgagatgatgattatgataacactgcttataatactgattacagcatccaaaatatattattttcattgcttcttttccttctagatggactaatgtgattttttttatgataaaatcgagtctcagacatgtggaatatcttattcgatgttgcacagatactacattcgtcagggaattctagctgctaaaataagtgaatccgagcacatgtaatggctccaccatgctggaagttcatttatcattcctgcaaagaccaaaacaggcatccttgatggaaggcagctgttccccaagcagccaatgggaaccctgagctcttacatcctatggatctaccatcttctatgaatagtttccaagttctccgtgcttgtagtctcaagtccgtgcaagtggaaggaatacaaggaagtgcacatgggaggtttttatggtgtcgctcaacacttccgctcacattccttcctctggaagtcagtcatgtgatgcccaacctcaaggaagttggaaaatgagtctagccttggaccaggaagaagagatgaattagtattcaagctagaatcctccaggtttcttgtcctctccttctgaactgaacccctcctaacccttttaatgtctacattccaaattctacctcaaaggtagaagagagccaagatcaatgatttaagtgatcctaacagtttcctgaatttcaagttttgtctatacattagcgccttcttttaatttcagtgctccaagatgggcaattatggatttcatttcctgcaagtttactatagcactcattaaattatgcagagtagtatttcttcctatgctggggatattatctttgtgttaatctcctagcctatggtatcggcaagtggaacttgtaatattttagcaccttggaattttagtgtaatggttctgacagcaacttacatttgcatgggggtaggagattctttctgaagatctgtacacatgttcatgcatttcatccacactgcaggtttaaaaaaatccatgacagtgctagaaataaccaagctataagtagccagtgctagaagaaaattggctcattttaactagagactggtagaatagatgagactgtcaaagacacaagagtgtttttgccttcccttttccctgtggtactttctgaatacattttatgtttcttatcctggtcgtgaataagagcccatcattgccaactggaggagagtctgccaggcacaccagcagaagcagttctctttgctctacttccttattgaaatgtcccagtgataggtttgaagcctcagtcatcaaacagcttgagtttgtgataatctcatttagcctgttgttgtgatttttaaaataacgaatcaattatccagatgtctttgcagggttctgcaaagcagaaatagtgtcacttatgggaccatagggacaacttcagtaatacaaagattagagatcaaaaatgccaatgttgatttttacgtgtaaaaaaccctaaagactccacataaaaaactgttagaactaacaaataaagttgcaggagacaaaatcaacacacaaaaatcagttgcatatctgtacactaacaatgatctatcaaaaaaaggaaattaagaaaacaacctcatttgcaatagcatcaagaagaataaaatacttaggaagaaacttaaccaaagaggtgaaagatttatatactgaaaatataaaacattgctgaaagaaataaaaaagatgaaaatgaataggaagacatcctgtgttcatagattgaaagataacattgttaaaatgtccatactacacaaagagatctacagagtaaatgaaatccctatcaaaatgccaaggcatttttttttgcagaaatataaaaaagcctacaatttacatggagtcagaagggactccaaatagccaaaagattcttgaaaaagaacaaatttggagatcacatgcttcctgatttccaagcttattacaaaactacagtaatcaaaacagtgtggtacaggcataaagacaggcatgtagaccagtgggatggaatactagaaacacacgagaaataaatcctcatgtatatattcaaatgatcttttacaaggatggcagcactactcaatgggaaaaggatagtctcttcaacaaatggtattggggaaactagatatccacatgcaaaagaataaagttgagcttttaccttatgccatgtacaaaagttaattcaaaataggttcaaaacctaaacaatatctacagctataaaagtcctagaggaaaacatagagcaaaagcttcataatattggtcttgacaatgatttcttagacatgataccaaagcccagtcaaaaaaaccacaaattgacaggtgagactacatcaaacttaaaaaacttctgcacactaaaggaaacaattaacagagtgaaaaggcaacctacaggatgggaaaaaaatttgaaaatcatgtatctgaaacagggttaatatctagactataaagaaattctacaaccccaaaacagtaacaaaataaaacaaaaaaactgattaataaatgggcaaaagacttgaatagatatttctccaaaacaaacctatattaatggccaacgagcatatgaaaagctgctcaacatcactaatcactagggaaatgcaaatcaaaactacaatgatatatcaactcacatccattaggatgtctggtattaaataacaagaaaataacaagtgttggtgaggatgtggagaaattggaacccttgtgtactgttggtgaaaatggaaaagggtgcagtccttgtggaaaacaaaatggagattcctcaaaaaattaaaaatagaactgctatatgatccagcaatcccacttctaggtaacaggtaaaagaattgaaaccagaatatagaaaagatatatgcacactcatgtttattgcagcattattcacaatagccaagaagtggaagaaccattgatagatgaatggataatgtggtggacacatacaatggaatgttattcagtctttaaaaaaagaaatcatgtcacatgctacgatatgaatgaaccttgagaaaacaatgctaagtgaaagaagccagtcatgaaaacacaaatactgtatgcttccacttatatgaggtatctaaagtgatcaaactcatagaaacagaaagtagaatggtggttgccaggggctggtgggagggaaaatggggaatttttgttaatgcctacagagttttagttttgcaagatgaaaaagttctggagatcttttgctcaacaatatgcatatagttaacattactgaacagtgcacttaaaaaaaagatagtaaatttcattttgtgtgtgtgttttattaccacaattaagaataaagggttcaaggattgaggctagaggcttgctcatgatacttggcaaattgagtctaggtttctgggtccagtaatcgggtttgtaaaaaaagaaaacaaccaataaaaacaccttttactaaaaggttctcaagccataaacttgtctaaacagctgggtgaatttcaacaaaggatcagggttacagcgatattgacagactctctagaacccataaaggcttggaaattagttactagcatcagcgttagtaattagtccactcttttctgtaggcccagaactttaaaataaagacatttgccacttaggtcctatgtctaaaggccaattaagggcatcgtgtgcaaaatgatttaaaaatatgacatttagagtaagagagatctgactttacatatatatgccaccatttctttcatcgttcatagcaaacaatacaaaatgctacataatgagactgaggctgtgacacttcatatattcagaaacaattatgagtcatacccacaaggatctcacatatgtctttggaaaacactttcattatttaattcctgttagagccaactaactcttctgggtatctaattgaaatctgtagggccaagtgagagtcaattctttctggagaactggcttgctagtttctatcttacaatgtgtgattctggggattatagcactcacctgttttttaaaatcttccaacaatgcaaatggttgcaattttattggaagtattaaaaaacctcacctattgaaaattttacttttgactatatttttataattgaacacacacacgtatacactgtttttggagaaacagtttttttatacttactgtgtattacttgaaagtaaaaacataaattgttattccaactgtagggggggattttattatttgcctttgtttggcttccctatatgtatacatggaaaccggtgttcaaatgcaagtgacttattagagacataaaactaggtgaatgagaacatgagccaggaagtagaatgcaagcattaaagcaatatagtctatagaacaatactgagagctaaatccataaataattttaaaatttctaatagctacacttcttaaaatgtaggaaaaatcaggggcaatattcattttaataatatattttacttaacccaatatatccaaaacattatttcagcatgcaatcaatatactattattaaaaagatattttctatactttttctatataaagtcttcagattgtggcatgcattctgtacttaaagcacatcttagttcaggcagtctgcatttcagatgctcaattgggttgtggttagtggctaccatattgagctgcgcagtaataaatgagatgttataaggcagctatctctgtgtttgactggtgcttaatcctgctgagaaaatgctggtaactaaagtcagaaatatcctatgagagagcaagtgagttgtggtatgtattcagcaagtcctgtcacttgagggttgagagctcctcccaggggcgttaactccctcatcacttctcacctgccaatgggacagaagaaagtggagttcagtggcccgagaaatcccactgagaagtgactggggtgccctccaatagcaaaggtgagaggatattggtgggcagtgggcagcatgtgctacattattcaacactatttatacaaaggtcaaaacaagatctcactcccagaccagtcttctcttagacaattaaagcaagatacttggaaatctatctttaaatgtttctttcaggttcaaagattccacacttgctttcagaaaatactttcattacctaattactgttagagtcaaatagctcttctgggtatctaattgaagtcggtaggacaattttaaagcctttactcttgttcttttaggagaactggcttgctattttctcttaaaattcatgattctgaggactataccactgcttttaaaggctaccaacaatgcaaacttgttacagttttagtgaaagctcaaaaaaatagcctgatggaaagcttttacttttgtttgtttttttttttcataatagattgataagtccagctcacaaattactttggtatattttagtcttctattggatatgttcaagtatcacaattcctttaaacatacgtaggataacaaaatgaattgttaaacaataagactgaggctgtgatacttcacatattttaaagcaactactgagtcccacccataaatcttggttaatctatcttcatggcacctcaatttcatttcttaatatgcaggacatcgtttgtggaattttctagtttttccttactgatctccagttgagagatcaaaaccatcaaaagaacatgacgtacagagtaacgagattgaggactgcatcctgctatgtttgcttggttgagaaatgtactcaatgtcatagtttccagacatgcacaataaaatagcaaaaacttagcatgcatggatgtgagtgtaaacaaaaatttggtatttgaaggtacatacggcccatctaagagaccttcagggccagactttgaggccaaatctgcagagcgtcatctgattatctcaaggtggactctggtcttttcatagatggtgtgtgattgccatgaaaataaagataaacaaataaacaaacaaacaaaaaaaacaaggatcttagcccaaggctaaggctaaaactagggctagggctagggctggggtttggtttagggtagggtagggttaaggttagagctagggtgagtttatgttaggattgggttaggggatcttagccaattttctctagaaacaaaccttaggcaaagtgctggctggtgctttgctggaagcagcaatcccaaagccatggagagaggacctaaaaggcacagaggcagcgaaagatgggaaggaaacggaatgatgtgcactgcccgtgttttagtctgaaccacaagagatggagctggaggttgaaggcataggatgtctcattgtcaacaatatggtgcatccatgctttctgtgctttggagcaggatgagagaggacttcatctactcattcactcttgtctcctctctcctcttagcctctgttgtcccatagagagttgacattcctggacatctatgtggcttcacccgggccccttcagcacctactgaggcctgaaacttcaaccaagtttggaagtgatgggagatgctggagacttgggcgtgtgtcttgttagcttgagatggtggaggcatgcatgtctaccaaacatgtgggacattaggaaggtaagaaggtgtatgagagtccatacaatgacctatgccgcaagtaaattgatttttgtcctgcaattgtgccttgcagcttatttgctgtaggtcagaaattaagggtcttttggcatggcttcaaagtgtcatgtggtccagctctgttttaggtattttctgtatcaatacatggctatttgatgtgaaaaagtggttaacacttgaggttatgtgcaggtgaagcaagcccaatacatgaagtactgcgaagagccagcggcttttctttttagtactgtataaagaaaatatacacaaaattaaagaaatcctttagaaaacaaggtaaaatcatcatcacatacaatcctaccataaggtaaacgtttaattttagcacattatgttttactcattcagatattgtagggaaataaaattcatacacctaaagtattaaacataattttttaaatgttctaaaagagttctcaacttgcttgcaaatcttcctaataaagggaattataggggcataaaccttccagacaaggcttttgtgctgatgaaaacagtttttcaggttaattcactcttccctggtaaacactcagtctgtcaaaatatatcacccttttctctctttgactaaataggatgatatctaagattaaagggaagcttaaaattatctgacattatgaatattttattaaataatactcaatgtcagttgtcttgatcccatttttaaccataatcaataattctttcataaacatcttcatttactagttatttgttaaggcattaaattgattccttctcttgaatcaactttcttgtggaaattatctaagatattggtttgcttgttaaattatattttcctggtaaaagttacaatttttattttgttttactttctgttttctgtgcccccccccgcccccaccatttttaaattttaatttaatttaattttaagttccagggtacatgtgcaggatgtgcaggtttgttacataggtaaacatgtgccatggtggtttgctgtacctatcaacccatcacctaggtattaagcgctgcaggcattagctatttttcctaatgctctctccctgcctcgccatccccagacaggccccagtgtgtgtcgttcccctccctgtgtccacatgttctcattgttcagctcccacttataagtgagaacatgcagtgttcggctttctgtttctgccttagtttgctgaggataatggcttccaacttcatccatgtccctgcgccaccattttgatttttttaaaaaatatttactcaactatctagaataatgtcatctagcatattttttttctgctgtaaatggaatttgatttaaaaagtttcagttaccaagacactaaaagtgtctttgcctttgaatttctcctggatggcctcctaaacagtaggcagggattcacactccatttatgtgtgcaaaaaatgaagcagggttatatcatagggccaattgtatccatttatttagctcagatttccttaccattaagataggtatttgggacacttcacaatatacttcaaggcctccagggaaatctaaacaagagaccataaatgctcctaaacatgtctaacatatctacactgtcctgcggtgatgctaatgtatataccctttcaaagtgcacattccaggcagctcagagcagattatggggctctttgcagaataagcacagcccctggctatatgcctgaataataaccctaacttccatcacactttacagtttacaaagtgcttttaccatgcatatgggtgagcatatggttcagtttttctctaacaatcctgctttcaaatatattgcctaccgtcagatttggcaacagagtgcgtgagcctgttttggggcaagagaatgtatcccatcatcacatcctcacacagacaatatgaggacgtgtctgagatgaggggtctcttcactgaatcctcagaggaaccctatgagtaagcatctttgatgagaattctaagttccatggaagtaaaataattagtccaagttaagcttgcttataaatgcccatgctgggagtttaacttggatctctgccccccagtttgggcatttttacattattaatctatactagtgactatggcatatagctaaaataattattagcccaattagaaatgttgtaattaaattttatcttcaaaccagaacacctctgatgataggctaagtggaaagatggattctgaaaacagaatgttctttgaagtcatgatagtgagggatactatctagtattaggttgtcaatcaggatcaatcttaattcccaatatcctattaggattgagtctggacctgctgtcagttttgcttccagacccctggataattgaacagaacttttaaaaaatattattattatgttttttagagacagggtcttactctgtcacccaggctggagtgcagtgtcatgatcactgcagccccgatctcctaggtttaagcattcctcctgcctcaacctcctgagtagttggaaccacaggtgggtgctaccatgcccagttaattttttaaaagattttgtagagacagaggctcgctatgttgcccaagctggtcttgaactcctgacctcaagcagtcctcctgcctcagcctcccagagtgttgagattacaggcgtgagccactgcacctggcctcaacagacctttcactttaatctaaagagatgtaagagtgagctgaaaacacccccttggatgcaccgtgtgatgcttcaccctggtgcatggataccagatggtgctaacagttctgaagtgtagaattgaagtgttgaggtcaagtgtagtaatcatctgagcaagacagtgctttgagactattttccagtataaagaaacggtaatttttcagtatgcaatattatgataatgctgtgatactactggaatcatcttagcagcataatatgccataatcagatatccagctaaggatgatgcaaagtctagaagtaatgttctaaaaggggccaaacattcttcaaaatgcctgtaatcctgagccacgaggctatactcctccatgtgctgccaagtagggaaataatctcttgcctggtgttcttgagatctgcaagttctcccatacacagggatagccaagatgggttagcatctccattatttaatctgcaaagtatttccaattaaatgcagtactcttatttgatagtcaaggcactgccaatactgttttaaaagggtaatcatcacaaacttggcttacctcgtaattcacttcacggaccacccaaatcaaatattagacacaggaaataacacttccaggtctctcccttaatttaattctgaacaccaagtgacctcccattttgcacaaattgcagttattggagattaaataactgcactaaagaatcaatatcctggtgttgtaatagtatgtatctatctagtgagatgataaggagttaggtgtccatgtctgaaggcaggaatgttaagaaaatggtatttaaaggactttcctagaccctcggtctatgattaagatagaggaggaaataggaggtcataggaagcaggaactggggagtctgccaggcctggtgtggaatttctttctcaattttgctctgggctagggagtgcttacaagtgggatggctgatttgtgagtattttgcaccttccaaattattggtcatgacaaattaatgttgtcccagtgattgacacacccaccagagagtgtgggagtcccatatccttgagcctatgtatctcattggcattataatgatagtcggacatcgcagggctgttgctgacagatggaaagagaaaaatgtacagtatatgaaaccactttgcaaaatgcctaattgatagttgccgttcaacagtgttggtttccttccttgttcttttacgtgctttcacagcatgctgcacactcctttgctaaaccacttatttaatctattgatatttcattatttacaaacaaaattatgagtttctggataccaaaggctcttttattattcgttagacacctagaacttagtacatagcatttaatgtctgtcctttgaaataaaattaaaaattaatggtccaagtttatatgagtacttttcaatatcttagaacattaaccccataaaatttatctggtgataatactccttcataagagaaaaaaataaatacattaatttttaaaaataactttatcggccgggcacggtggctcacgcctgtaatcccagcactttgggaggctgaggcgggcggatcatgaggtcaggagatagagaccatcctggctaacacggtgaaaccccgtctctactagaaatacaaaaaattagccgggcgtggtggcgggcgcctgtagtcccagctactcgggaggctgtggcaggagaatggcgtgaacccaggaggcggagcttgcagtgagccgagatcgcgccaccgcactccagcctgggcgacagagcgagactccgtcaaataaataaataaaataaaaataaataaataacgttgttatgaactagtccatctaaggtacatgaggtacaaccagtagcaaacatactcatctacacatcccagcttcagcaataaaatatttaaatattattgaaataaaaggatgctctcttaaataaacaaataaatataattgaagacagtggtgtccatttccaaatttctccttcttcctcccactatctttatcattgtgcatattgctgtcttgcttttccttatagttttgatgtatatgtgtgtaatctaaacaatatgtttagttatgcatagactctgtagtttagattaatagtgttgtatcacattgatctctaacttttttcattcaatacctttgtgtaatccatccatatcaatattaaccatagtggttccttaatttgcactgattgtatatatatgtatatatttatgtaattccttatatataattatgtatattatcagtgaaaatgaaactactttgtgaaactatatatgcactcacacatatacacacacacatatatatacacacacagtgatatatatttacatggatatactatcttatgaataagcaccatcatttatatatactcttttttaagtggttatttgggtagctttcagcttttttactttttttcaatggtgtgctactataaagaatgggtctgtaaaattcttgtgcatgtccgctctatgcatatacttaagagtttctctaagaggttttaaacgggtgcttaggaagggaattactggatcacagaacataagcaacataaggttccagattatactacatttgtttccaaggtggttgtaccaacttacgctcccaccagaagcatttgagagttttcattcctctgcatcttgcatagcactagctattgttacattctaatattttctaatctggtagatgtgaagtgataaactttttaccttgtgtttttcattagcatttctctgatgactagtaatgttgaacatctttttacaggtccatttctggccacttctgcattctccctcctggcaagaatgttttcatttttacccatgttcttgaagggccccttctgtcccttagctctgcagtctctgccatttgttaagtctatgtgtgggtcagtccttgaggactccgttaggttcattaggacatttgtctactcttctgccaatcacacccagccttaactactgtagcttgagctagtccataaccacactggtccaggagtattttggttaatcttgggtctttatatttccatatccattttaaaatatcccatccagttctatgaaaaactccattttcctccctcattaatccttcctgtacttcagatatttcttttaagattattttctttttctcctaaatatttcctttagatttgagggggcttctttttatgataaattttcaccgttttgtgatctaaaaaatgtacttatttctaccttgtccttgaaagaatgttcatctgtgagtataattatgggatgtagttcttttctcttggcaacatgaaggttttttcctaccctcctctggcttttgggaagtcagttcccagtctccatgtgacaccccggtgggtaatcaatgtgtgggtgtgtgtatatgtgtatatatgtgtgagtgtgtatatatgtgtatatgtgcctgtctgcttttaagatctcttctttgacattggtattattactattcagcattttcgttattaagtatggatggatttattttcgtttatcctacttaagatttgctgtagtcgctgaatgtgatgtatcatgcgttccacaaattgcggaaaatgcctctgccaaggttgaccacctctctttccgtcatttcatccaaaaactccaattagataggtattagacctgttcactcaatcttccacatctcttaacctgatttcatttccttgcatttcttctcataatatcttcagatctgtattccagttcgctaattttccttttccttctgtctcctccgctcattaaatgcagccattaagagatgctattatgtagtggttgagaggtcgggttatggagacagactgctcgtctttgtattctagttctaagacatattagccatgtggctttagggcaattaatacctacctcataaaactgttaagaattaaatgaagtaatgtgtgaaaattcttgtaactgtgtctggcatagtagttagctataaattattttaactttagttttcagtttcaaatatatataaagttctaaatgttccttcaacccctttaacctttttctttttgataattttttcatgattttaattatttcctttttgtgtgatttctgactgggatctcatatttgtgggaactttacatagggtaaatccttgtggcctgagttatcaattcactccttcacagaagatttatgtttaaatttgtcaaagccctgaagatactaaaaatgtaaaacttgaaactataaaaaccctggaaaacaacctaggcaataccatcctggccataggcaccggcaaagatttcatggcaaagacaccataatcacaacaaaagcaataattgacaaacaggatctaattaaacttaagagcttctgcacagcaaaacaaaaacaaaaacttatcaacagagtaaatagcctacagactgagagaaaaattttgcaaactatacatctgacaaggtctaatatccagcatctataaggaacttaaacaaatttacaaaagaaaaacaatcccgttaaaaatcggcaaaagacatgaacagacacttcaaaagaagacatacatgcggccaataagcatatgaaaaaacagctcaatcatcactgctcattagagaaatgcaaatgaaaaccacaatgagataccatctcacaccagtcagaatggctattattaaaacgtcaaaaaataacagatgctggcgaggttgcagaggagaggaaatgcttgtacactgttggtgggagtataaatttgttcacccattgtggaaagcagtatgtcaattcctcaaagagctaaaaacagaatgatcatttgacccagcaatctggtatatacccagaggaatataaattatgctaccataaagacacatgcgcatgaatgttcactgcagcactattcacaataacaaagacatggaatcaacctgaatgcccatcaaagatagataggataaagaaaatgtggtacatgtacaccacagaatactatgcagccataaaaacaggacatcatgtcttttgcaggaacatggatggagctggaggctattatccttagagaactaatacagaaatagagaaccaaataccacatgtgctaacttataagtgggagccaagtgatgagaactcatgaacagaaagaagagaacaatagacactgggggtctacttgctggtggagggtgggaggaggaagaggaggagaaaaaataactattgggtactgggcttaatacctgggtgatgaaataatcatctgtacaacaaatgcctgtggcatgaatttacctatatagcaaactttcacatgtacccctgaacctgaaatataagttaaaaaagaaataaataaaaagttaaaagttaacaaataaaaccacattaaatcaaatatttcaggtcttggggtttttttaattgaattcaggctagaaacctatctgaacatttaggacttcaccttccctgatgcgtaagagccaatctcaaaaaggaaacacttcgctgttctgtgtttcagatttgttgttgttattttggtttgtagttcactttctcattgagatggtagcacttcaagaattttggggctgggtgtagtagctcacacctgtagtcctaacactttgagaggccaaggtgggagaatcatttgaggccagaagttccagacctgcctgggcaacaaagtgagacaaccaccccatctctacaaaataattttaaaaattagaaaagaagagtttggactttatccttatcttgtaagagcctataacacgcttttgattttgtgtgcaggcaggcattaaaattgaagctcctatttcctgggatgtgtagatgacccaagggcagttatgggccttagcactggtttacttctcttgattcattatttcattttacttctcagaatttgtattactgtttttgcaaactcaagtatgcattcaaagagatgttttaaaatgatttatctggcatttctgtatgctttataataagggagcatttaaaaatttctagtctgctgctttgctaaaagcaaaatatcataatgagtagatacccattcaaatatttgttgagtttttattgcatgttctcttcctcctccagcaattttctttcctgggacattttttttcctagttgtttttcctcattttcctcattgtggccactgatccctttagctggtttgctactttttctctatagactcattggcccctcctagagtatccttcatggtggattcaggtaatggcaggataatcagaattattgtaggcaactttcattaactgtatcacttctccacatgtggcagtctgctgcctatgaactggattagaacatgcttttcattatgtaatgcacatgcatatcacctagagatctccttaaaatgcagattctgcatttatactttgtagttaattattccaatatctaaagtatctgactttgctgttttctctttcttcccactctctcttgttctccttgctttgttctgtgctctgtgatttctgactgtgacctccggttcatgggaactttatgcaggctaaatctttgtggccagagttacggcttactcctccccagaagatctgtgtttacattcagtgggtttggagtggaccctgagattctaacaagcccccagttgatgctgatggactaggaatcacactttgcattgcaaggggtgttaaaacataagtatcaatcccaggaaaaggatcttcagtgaacggtggcattcctagctaaggaaatgggtgtcagaacctatctccacctccaactagaataagtagcatgatgtggtgaaaagtataaagatttggaagtcagacaaacatggactgagtatgtattacaactatttataaacatacatgctgcttctactccctggcaaaggagtgaactccactttttatcctttccaagttatgcatagccacgtgacttgttttggccacatagtgttgagctgatgtttctctttcttcagatggaatcattttcttgccagacagtacttatgacttaaagtggtcaccagaactgcagcatcaacatcacctgggagtgttagaaattcagatctcaggccaggcacggtggttcatgcctgtaatcccagcactttgggaggctgaggcgggcagatcacctgaggtcaggagatcgagaccagcctagccaacatggtgaaacactgtctctactaaaaatgcaaaaattagctgggcgtggtggcaggtgcctgtaatcccagttacttgggaggctgaagagagagaatcatttgaatccaggaggcggaggttgctgcagtgagccgagatcgcaccactgcactccagcctgggcaacagagtgagactctatcaaaaaaaagaagaaagaaagaaagaaagagagagagagagagggagggagggagggagggaggaaggaaggaaggaaattcagacctcagactccaaactcttgtatcagaagcttcatttgaaccagatcacaggtgacttacatgcatgataagtttaggaaggtctgctctagttcactcttcagttaccatggggaacttttataaaatagggatatatatttagggagtgcaaacgcagttttgttacatggatatattgcatagtggtgaaatagtgaacattgtatccaataggtaatttctcatccctcacccgccctcccaaccttctgagtcctcactgtctgtcatttcacaatctatatccatgtgttcacattgtttagttcccacttgtaagtgagaacacgcaatatttgactttctgttcctgagttagttcacttaagataatggcctccagctctatcagtgttgctgccacagatattatttcattctttcttatggctgaatagtattccattgtgtgtgtgtgtgtgtgtgtgtgtgtgtgtgtgtgtgtgtgtgtgtatcacattgtctttatcataccattcactggtggacacttaggttgattccatatctttgctattgtgatagcaaagataaatatatgaatataggtatcttttatgtataataatttgttttcctttgggtggttacccagaagtgggattattggatcaaatggtagttagttctttgagaattcttcatactacttgggaggctgaggcatgagaatcgcttgaacccgaaagttggaggttgcagtgagccaagatcgtgccactgcactccagcctgggcgacaaagtaagaattcattttaaaaaaaaaatcttgatactgttttccatagaggttgtactaatttacattcccaccaacagtgtataaaagattgcctttccttgcatactcagcaatatcgtcgtttcttgactttttatcagtagccaatctgactggtgtaagatgttatctcactgtggttttattttgcatttctctgatgattagtaatattgagcattttttcatgtttgttggctgcttgtatgccttcttttgagacatgtctgttcatgttctttgacaatacaatgttggtgggaatgtaaatattgagttgttgtaaagatgagtacatttccacaagctacatagacatataataggtagacatataagattcaacagatggcaattattgttggataaatggtcagcaccccgtgggttagtgataaaagaaaaactcacaaccatgtgtcagcaaaccacaacccatgtgccaaatctggcccactacttgtttatgtaaataaaggaaacagccacattcatttatctgtgtaccactcacacctgctttttcactacaacagcagggttggatagttgctgcagaagtcatatggcccactcagccaaaaatatttactttctgtgtcttttcagaaatgttagatgatctctgttctatagccgtgtcctagactaacatgaaaagacaaaggggatatctgtgatttagttgccacatgaatgtatggacacccttacgattgaagggaggtgaaacgtggtgtttgtcaaaggaaagatcagatgcagaactaagaggctaggacaccagtttcacaatgcccaggtctcatgttgggtcaaacttgatatggtgcttatacaaaatgaggatcggtacacagtatacttatatagttgcccagaaatgtgatacatggatttataataggagagaaaaaatccttctttagttatgtgctccttcccgtagaagtaaaaatcaagaaattgccatcaaccttatccttccagatggcaggcttctttataactgttctcttaacaaacatgattccattgttttcatactgtaaaagacacgggctctttaaaagaggcaccagcaggctgtaacagtaaaaagaacgaaaaagatatcttgaaagaactgcaagtaaaatatggcacaatttaaatggtgtagaagcaaagagcaataatcagaaacgagaaaattcatggtaagggacctgccttcgggctcatctctcccacaggcggctggacacctgctaggtcagcggagtcctccctgtgctcacagcttgtggccaaggaaagaatggcaagaatgccaaacctaacggtggataagatacagacatatgcagaaaaaaactggcagaaggggctaagttcttccctgcttcgtggactcaaatctgtctacaaggggaagcccagtgattagccaatttgtacgaacaatgcaagccaatttagatgtaatgttttctttctctctttcttttcttccttccttttcccatgctgttttctttctttctttctttctttctttctttctttctttctttctttctttctttctttcttttctttctttcttttctttctttcttttctttttttctcccttccttctttccttccttccttcttcctttcttctttctttctttcatctttcctccttcctttaattctttccttccttttcttctttacttctttccctccctccttccttccttcctcccttccttcgttcatccttccttcctttattccttacttctttcattcttttttctttcctccttccttttttctttgtccttaccttccttttttcgttctctgtttccttctttaccatcaaacacccatctctcgtttttagtgaaacattattgcaattttcttttggagaagcacacctcctatattgtgtgcagtactggtgaggatgtgactacaaatgccctttccacctcttgtcaaggaaggagcaatgaatgaccaatgctaggttagttggacgctgaactagagcactgcctcctgttatggctaagggcaggtggctggttctcactcactccagcagcggtatggatgtagcagagaaattattttttcccactgcatagattccctggagcctctgggtgccttttcaattcagtcctgaatttttaggtcttccttgaatttcatacactatgcccatttcttttgaatcatttcttttttctcttaggtcagttctgagtggttttattgcatgcaaccagtgatccctaactgatacacttaggcaccaaagtgctctgttttgctcttgatccaacaattctgtggtctctaaaatcagcgtttatagatagatggtggctgttacgctctgaattgtgccctctaaaattcatatattgaagccctaaatgccagtatatcagaatgtggctgtgtttggagttaggctctttagaggggtgactaaggtaaaatgaggcctttaggctgggccctgatctaataggactagtttctttataagaagagattaggacacagacacacccagagggacgatcatgtgaaaacagagagaagacggcatctacaagccaaggagagaggcttcaggagaagtgaactctatgaacaccttgcccttggatttttagcctctagaatggtaagaaaataaatgtgtatttttttaagctagtcagacagtggtactttgttatggcagccctagaaaacaaatacagtagccattctctttatctggtacagaagcagctttcttaatatattaagataggaattaccttgtgagaaatgctcaaaaggtaatgttactttactgcttaatgaatagtcctaactttactattgttgatgagcctatatattataatacactggaataagattgaatatatggataccatattagtgcagatgcagaaagtttcaaggctattgagaactctatgctgaaatgaaaataattcccaatgaggctgatatgttcacctttaactacttgttccttttccttaagaattttgtaatttttaaaatgcaaatgctctgggaaatggtgcatcttatcctgactacactagaaagcagaacctgaggagaggattatgtttagatgctttatgtgggaggtgcatcccagagcagaaaggctgagggaaaaaggaagtgacactaaggagaatgcaagacgatgtaatatttagtgcactggcgtctgctacacaacaaatcatataagaagatatatagcagatcaacaggtgcattcactcagccaggttagtagtctgcagacaggcagaacaaagaatccattggaagattacactgtagtgaggaaaggtgaaggaatttattggttgagttcccttctgccttctgtcttccactggtgacaacttacctcatggcacagacctctctttgtcatccagccccgttgacaactttagaagccaggaggaaccaaggactcgaggagatgaaatctcatggtcccatttccacgtgcaattgttcagcctctgcagtgattgaagtagaaggagttgatggttcaggagacagtgatgtcacaagaccctgaaaaggcacacaagatctgagagttacgtagcagtatttaaactagttatttatatttcaattgtgaatgtgattgattaaaagattttgtagtaaagcctaggagtcaggcttagaaaggttgcccatcacttttgaccatattctgtcacccagaaccttggcacacattacacagcctcggtggcttggtgcctggttggaaaaccaacagagtttggagaacacatagctgccttcctgcaacaccaaaatcacactgttattcttcttacctctgcactgtactgcacataatttgaattgtgcagaaaagagttcacagttgtgggatatattataaggtgtccaatacacaggtaatattctttcatatttatatgaaatgtgtccagtttatgccatcttatctaaaagagcttcaatggcattagaaagcatttaaaggagactactaaagatgatcaaagggatacattacaggcaggtagattaaagaactggagttgattagcccagattaaacaatgactgagcaagaagcaagagagcttttcaggtcaggatcacttgagcacctacattttaccttcctcttttcccttatttttcaattccaacaaaaaaagagcaaagaatgaacaactaaagatcgatttatttctggaaatacagcactagtgcttctcacatgcaaaatatagaaaagaaagagggaaagggacatttaaactacagttcacacttaaaaaagaaactcaccctagacataccccttatgaagcctagtccaagatatgaagtctggaatccagaggagactgagggtagacaatgcgggcggagaagaaaaaatgctcgtgtggcatcctctgtgaagtgggcaagggacaagcatcttcagagtgtgaccctagccctgaggtgcatgcacacctggtgtgtatgtcaggaggctgccaaagtcctggaaatggggcactgttgtgcaggctcctcagaaggtgtggtgttcattactgagggcactctattttccatccaactaccagcagccacaccaaacaaacaaataaacaaacatttcttcaccaaagaggctacagctgccctaaagtggatagcctccttctctgtactccccagggcccatggcattatttatagggagaagtgaagttgcaggaaacctaacgtttcttttgtttgcttgtatacatttcctatgtttctcaacccaggagccaaataagttttgcatccatgcatttcaacttccaaaacattcaaagacaaggcaaaacaaaacattaaactatgaaaggacatgaccgtgcagatgcatttaaagatccatcagaagtatcctcaagggtattgtcaataggatttgagagattatgaaacaagagtagtcatggaaaaagagcaaccacacatcacgaacatgtgagattaaatggaatggtttctgaatatttaaaattgcaattacagcagaaaagtgtggattggagactgagaaatgtgagttggaaaatgaaatgtagactaccctacaattcagttttttgaaaaataaagggaataaatggatgaacaaaaagacatgttgtagagggaagactggaaacacaacacgattataagagagcaaaggaaagtcaccagaagcagtaataaaccagagtcctctgagaaagggatttcagattttatggtcaaccaggcaaaattaaaagtatccatgtatcctggtgatttttttaaaaatcaacattaaagaaaagaaatcctataatttctctagcagaataaaagtatcacatgaagattgtacaaagtgggaagaataatcaggctgctcctttttaatagtaaattccacagcataatatagcaatcaatagaattatgagaacagatggttgtgacatagattcaatactcatttaagatactcatttataagagtgataaaaacattcttacaaaggaaggtagttataaagtttaacagccacatttttgtcctgaaggctacttaaataatctctgcaacttctggtggatccaaccactgcaacttcatggtagatccaaccactcattttttcaatcttaaacttcagtaataagatggggataaagaagatattgatccatagagattaagacacaaagacaagtcaatagctgatgaagggtgaatattaatatttttggaagctagaaagcatgtgggcatattgtaactcacatgaatggactgaagctgaaactcatcctaaagcagcatttgataacctccaaaggctcaaaatttagacataaagataactctctaagtaagcgtgcttagttggactaatggtaaggttgatcaaatgtctgtctataaagtaggtagatatctgaatcacctgatccgctctgtgattctggtgtaaatctaggaagtttgccctctggacactcagaaccaaaaatagtctggaatcaagatggtaatacaatgggacttaactgaaaatctacattttaaaaatagtgagtgcaattgtacatatatttgatcagttggagttgtctcagggctcattgatgttcttttctttattagatcccgtttttgtccatgtgtttcattttgcatagttcctattgctatattatcaaactcactgaacttttcttctgttatgtttctaattggctattagttctatctagtgtattttcatctcagacactacaatttccatctctgtaaattttatggggttgcttttatatcttctaagtctctgctttttgagcatatgaaatacatgtataataactatgtttaatgtctttttctgtgaattctaacttgtatgtcagtaagtttctatgggttagtttccattgattattctatcgttttattcttctttctggaaagtttcttctgatctatcttgtacgtgaatatgaacaaatgataaaactgacttaaagctattattgccatcattattattaatgcaaccttattttagtcatcaatattgaaataaggatttccatgatgtaagtaatagtacaagaaaatgtttgctgccataacatatatttaatttgttagaaaacatccatttctaccccaccttacatatagcaccctggaaggcatgtaacagctgaaaaataacttacgatttaattctcggcatgattatttctttgagagggatctgtttacttggatataacacagtgatcccttccattaattccctctggtctgcgtaagcattcttgtcttttaacatcttcaaagttttatttgattcacagaacaacattgctaaccttaaataatttcagcccaggacacagatctttaaaaataaatttaattttatcttgcaataaagaatatttgaacattgtaatcgaagagtattagaatttataaagccagatggtatatgtttaaattacccaaaaagtatcataagtattacatatcttttatatactttaagaggaaaagctcattcagattttttttttgcaatgaccaattccatttattttgataaactctacgaatggattctactttgaatcaatgtttgtacatatgaaaagacatcctacaggtattttatccattctcacctctcagcttacatcctgcaatgttttctttttctgagctccttcagtgacagtgtgtgtgggtttgtgtgtgtgagagacaatgctgagggcatgtcttttcatgccccagaaatacccacccattcttttatccaccgtcctgagggggacaccagtttctgctgacctcttgcggcttgcttgttccggaagctgtttattatgtttccaatctcctgccaccctttttcgttcaatctccacttcctggatcattttctccccacctcatacttcattttttctagtcctcctcttgtagcactgacaattttgatttataacgtatcttgcacgcccttctcttttccttgaactggtaatgtattttctttttcacccctattgcccatgtctctgcgtctagcttatttatttctcagtgccgaacacagccatcaaatcccttgtaatttaggctcggaggcttttcactcccaatctttaccatgactccattttttgtatttcatattttgttcttaaaactaaacgattccccagcatgcctgagcaccagccctggacaccccctccccacaacctcactcaaatttgcttctccagggttctgttacatcagtgcattcatttgggggattttcctgagtcccatttccaaccctaattaagtctgccttgctgctttcttctgttcagtctcatctccatagactgattttcagttccaagtgctccagatggagccatacacctgcactttggtggtggaaatgtaaaaatgtggcgtttgtggctctgagaatctggatgtcaaaatccaaaacgtgttttattgtaaaatgaaacagtcctctctctgccccaacccattccttgcttgtaaattctttaaagatttggacttgagattctcttttctttcctttcctacttctctgaagtgatgatgtaaataggcctcgttacacacgggagagtaacctgttatttctcctagataggttcccaggatttgctcccattttactctaattttctcccagttcatgccagctccttggttcccatcctgttctcatatctggatacactcccactactgtgtagaccagctccctgcaaacgtcatcaaactcaaatgttaaatatgaaggtgaatgaaacactgcttctcaaaactcttctagtacccactaaaatcattttgaaaaacaatgtccttctttgcttattttaaagttggcatctaaaatttttcatgtgctgaatgctggcaaaagacgtaattgcctgcatactctctctctctctctatatatataattattaattgtataatattttattatttatattttattttattaattatataatataattatttaatatatacttattgtatgttaaaatattaatataatatattaatattttaaatatatttaaatgaaaatattggacctgcagattcagatcattctatttacgaaatcctgactaattgaactcatacatatcccttaggacatttgctcttaaggtttagtgcctattcctagctacatgagtctagaaatagttgctgaattattattattattaattttgtaagtgtagccggcaatgcattattttgaaaaattattgttcaaagtccacagttgacattaacgttcactcttagtggtgtacattctatgggttttgactaatgtataatgacatgtagccatcattatagtgtcagacagagtagtttgactgccctaaacatcctctgtgctccacctattcatccactcttctctttccccaaactcctagcaagcactgatctttttattgtccccatagttttgccttttccagaatgtggtctagctggaatcatagtctgtagcctattcagactggcttctttcacttagtaatatgtgcttaatgttcctccatgtcttttcatggcttgacaactcatttattttgagcactgaatgatattccattgtattcattcacctactggatgatatcttcattgttccttaagttttggtgattatgaataaagcggtagtaaacatctgtgttcaggtttttttgtttttttttttcaattgcaagatttaatagagtgaaaacagagctcccatacaaagggagggaacccaaagagggttgccgttgccagcttgaatgcctgggtttatatcccgatcattggccctcccgctgtgctctcaggcgatagatgattggctatttctttacctcctgtttttgcctaattagcattttagtgagctctctttactacctgactggtcgggtgtgagctaagttacaagccccatgtttaaatatgaatgcagtcaccttcccagctagacttagggattcttagtcggcctaggaaatccagctagtcctgtctctcagatccccctctcaacaggaaaacccaagtgctgttggggaggttggccaactaccgctctaactgcttcctgccgaattggggcatagtaggggttgtgcagttgagatttcctcgggagggatgctttcgatgtcattaacatcggagcatgggctagcagactggtccaggggtccgcggtagatcttagtcatggactgcatctggggctccatttgaagaaccatttgtagctttacagctttgattctgaaagagacaaacttaacaaggaggttaaagatacagggtccaaagaggagtaacaatattatagctggtagaggtcctaagaagggagaatccagggcatccattggctgaggaagccccagggtccggtgttttgaagctcctctgctctatgttgtattcgatctcgaatttctttaactttctcggtgacgatttcggattgattaacataataacagcattcttcccctaaaaataaacaggttccccctctttcggaggttagcaagtctaaagctcttcgattttgaaggaccactgctgctagggagttaaattgatcttgcaaggtgaccagggagtcagcgacctgttccatgtcaccatttagttcttgagatagtttgtagtagaactgagtagaggttgtgaggccatcaatgtcagtacctagtctgcctagcactcctgctccaacaacaaaaggaagaatgggtactcttttgttgccgggcttaggtgtgacataattgtgtaaatcttgttcagtgtaaatggtcatagggacagtaagaatgagaggacgcacatagattctgaatggccattcaaacaacgatagtctgaggtaccacagacaaaaaaatattcctgagggtaggcagactatttgtgtgggaggagttacccacctgatacattgggagttggttgtgtctatagtattgttaaattgtacacaggtaaggtttgaggtatgggttatctccagattggaaacaagaggtcctactaaaacggaagtggtgtttatttttgtgctggagttgttccattgttcaggtacagggattgaatgtatggcctgaagtgcagtgggaggcacatccaacagttagtagggttttgggccgaaaccttatggagcctagtgagggtagtattaaataagcttaccagccgattatgggtatggagggtttcatgtagttttgagagatctagtcctttgtaggggctgggggtactttgtacccaggtcagttgggagattatttcctttatgtgtttttctcttgcctgatcttgaactccacccccatcagacataccattatgggtgaagtaagtccaacagactggctccaagtcctccaggacaactaggattaatcattttccctgtccaataatgagtatttgcatgcatgcaaagagttgcagagttataaccactcttgtggggcatatgggtgtgggccatgaaggtgggatttcctttagatatactcctatacgatgggacatcaatatttccgggaagccgcattcttcaggaaactcttggtaaggggagctactggttgtacagcagcatggagggggtgcagtgagagtgaaaggggatactgcctttggtagggaaaggaggcagaatcctttagtttaacttgaacaggacgggcattctttgctcatccatatgtccttctgttgcctagacttcaggattaattccttcctcaagcaggggacaacaaacgggtgttccttctcctatgttcaggtgtataatgactcctgcttttactagaatgtctctccctaacaagggaatggggctttcaggcataattagaaaagcatgtgaaaagagtaaagttccccagtcacaacttagtggctgggagaagtatctagtgactggctgccctaggaccccttggatagtgacagatctggaggacagttgtccgggacaggagagtaagactgagaagtccgcgccagtgtccaggagacagttaacctcctggccctcaatggtcaagcatacctggggctctgtgagggtgacggcatgggctggcgcttgccctgggcaccctcagtcctgctgctggatcatctggttagtggcttctgactcagaggaccttcgtcccctgaggcagttggccttccagtgattcccttgacataaggggcatggacgagggggcagcttatttccacttggagaatcttttttaaagtgtccttttagactgcactggaagcaagccctattaggcaatcgatttgcccagctattcccttttccagagcctccaaagtccgcttgcctgaggtccatgactaaagtggtggcccttttttttaaacccgtttatcccattctgcctgctcctgctgatctctattataaaaaactgaggttgccaagttcaatagggtttctaagttttgctctgggcctaaggcagacttttgaagaatacccattgtgattttttcctcaatcacctgggaggaaacatctattgtcctgtcctgaagggagttcctcctaggtctggtcagacctttatatggtaattaagatttaaatcccctgtaaggaaatctgctgggttaagggaattatcagtggttagagttaaattacctttttctaaaagaatagccccatactttaagatttttgagttagtaagctaccttttttgacttagaataattctaaactggtgaggtgtgctcacaaagaggtttcctctaaaagttatttttctactttcttccattagcaaagcagttgccgctacagattgaatgcatctgttggttactgggttaaggatttttgataggaaagctacggattgtcagtggtctccgtgttttcaggctacgcccttgtttacgctgacaacaaggtagtattggagtgttacagggtcacagagaagaccctcaattatcaattataggtttaaatttaccctggcttttaaaggaatagggcacactgtttttttactatttctctgtctttctttctctctttgactccctctctctcctctctgtctccctgtctccctgtctctcctctctgtctccctgtctctcctctctgtctccctgtctctcctctctgtctctctctctcctctctgtctacctcctctctgtctctctatctcctctctgtctctcgctctctcctctttgtctctctctctctctcctctctgtctctctctcctctgtctctctctctctcctctctgtctctctcctctctgtctctctcccctcttctcttagccattactaacgtggggccctggcaaatgtggtggggaatgggtcccacataactgccaatgtcgagagctgtatgcctaaattgggagggacaccagggacaagactccctgggtttatagcctagatgcctaaggacgcggggtagagctttcttaaatccctttggagatacaacttgctagaggaaatgaaagtctgaaccattagtacctaggaggcagggatcagaggaagtagattcagaggtaaggagaattttggggtgacactttcaagaaagtcatggtcaggatccaagaggtatgagtcagaaggaaaggtaggggcgcacgcatgggcgactattgaatagagacttctggctgcgccatgaactcaaccggctaatgccgggagtttgggatgacagctttctgcctgtagtcggccctcggcttccccgagaaaattgaaagtggaagctggttctgggcaggccaacattcccaacccacaagggttgggggttgttagaaagcccttccccggacagcctcacatctaagtcttaagtccagtggccacgctaatcgtttttaactggccgacaggtgcctggtattttcctgcaattctaaggaaggataggacggaatagcaagcgaaagtggtccaatattactcaccgctttggaggtcccttcgtggtcaccaaaatgtcaccggggggtccttgctcccagagatcccaagatggtggcgggcagcatccaagatggcggaaggccgcttccaagatggtggcaagccttgtgttctctgacctggggttcttggcctcacagattccaaggaatggaatcttgggccatgtggtgagtgttatagctctattagaagccatgggtcacggaagacaactgtggaacccagtgactagtgttcacctcaattaggacgaacctgggcacttagccatgcaagaacaatggcaagcctttagaatgatcgggagcagcaatgggtgccttgctggatcagtagcacagcagacaccctgccggatccagagggatggaagtcagcagtgggtctgcgatggcagcaaacagcagtggtggacagcgagcgaaagctcagcttgagccatagcaaacacagaccagaagagagtacagttgcaagatttaatagagtgaaaacagagctcccacacaaagggaggggacctaaagagggtagcccacaggtttttatgtgggtgtaagttttctactcatttgggtaaataccaacaaatatgtttgctggattgtatggtttactttcataaggaaatgctaaacttccaaagtgactatgccattttgcattctgtttgatgtttcgtacacttttatcttcacaacctccaatggcatctggcacacagaggatactaatcaatatttgttcattactgaatgacaagaagcacctgggcagtgtatttaaaatgtgaattccccagctaaatccctagagattctgactcagtatgtctggagtgggtcctcgggatccgcctgttcagtcagcacccggggaatgctaatgtgcatggtctggaaaccacagtttgagaaacactggaagctcattctggcaaacttctctgtgtggccatgtcagacagggtggtcttggccacttctgaaaaatggcagttcttaattctcactatttctgtgtccctgtgctctatatggttactaggttgtctttaaaataaaaaaggcttccataatgggaggtgaaattgctttttattccaaaaaagatttagttgaatgaaagtcaatgaatgtaaatgtaaattcagaacagagaacattggataagtatgcaagacaatgaggttggaagggatatatttttcaagcataacatagacacttaaactctacagaaatattcaaataccttcccgcaacaaattcaaaacttgtacagataaaagccacaggaagaataccctaaaacaaggcagtctcttacataaccacagtgcaatgatcaaaatcaggaacttcattgatacaatgctaggatgtaatctagggaccgattcagatgctaccaattgtgagactgtccaaaagcatgcttcagttgtcctgtttattgaatctcttttaatccagggcagttcttgagtcttgttatggcatgagcactacccaactcttttgtaggacgtcattaattagggcttttctgatgtcactttatgaccagtttcaagttatgttattttaaaaaatgtttaagtttaaaagcaatgtatttatcatttagcttaaggtggatggctcaaggtggtggaaagtggatggctaaaaagtgttggaaaggtttcaagatgaaattctgattttctataagatgaaagattttggtgagaaataaaagaaatctgtaggtcacgggtctttcttcacattaccactctcctaagctgagagaatagagtctgacatagttgaatctttttgttttttaactttcatcctctcttttttgctttccttttccccatgttactaagatattggggaaaccaagtgatttctcctatagaatgtccacactgtagaatttatagaatgcttgttcctgctgtagtttttaaatggaattccctgcaatataaaaaatagtactctggtgatagagatgtcaaatcctgggcccaattctagcacagttacttaagcaaatgttttgtaagcctttagcaaaaattaagaggcacttgccaaaagtcagcatgggttttctaagtacacattttgcagggttcttcacacttccttttcttgatgcaaggctggtagtcttgactaaagtgtttagtcatgttaaatctgtatttcaaaaaaatgattggcaaaacctttttatttttaaggatagaatttgccgtctttcagacacctctcctatgtcaagaacttcatgaatgccaactggaattctctcatgatcctacaaatcagaatttagaagtcaggcagatttacattcaactcttaactttccctctttctagctatgagaactcagatgtgtgaactaacctctttaagtctcagtttccttattggtaagatagtgataattataagacctgttttatataatgtgtaaaaattaaatattgtgaaaattaaatgcaggtaaaaattttaatatagtgctttgcatatagtaagttctcaatagctgtttgctattagttatcagtgcttccatggcacagataagaagactgagggtccaagaggctaactctctggaataaagtctctcagctccaaatttgggaaccatcatcatttccataatatcttgctgcctccttgtggacaagccaaaagaaaatgtgagctgaaaagccatgtaattctacagatttgtttcaagttcaataaccttcaaaggttctaaaaaaaaattaatgccaaaggtagtgtatgatgtctgtaatagactgggtctttattgccatctcatctgtgtggaaatggggctaaaatgaagagatgtttttcagatggcaaatgaaaataaacaactgcagataatgctataagtgggttagcatttttttaatgaatagattaaaataaaaacaaatttaaatgatgagatttaattcacaataaatgcaaatttctgaacttggtctcagaaataacaactttacaaatcccagataagttatttttagatcttgagcttgctgtgaaatgtaaaaagggattttggtttaactgtttgaatccctccctgtcggcccttcagtgaattatttagtccatagtaagagagatgatggattctccaagtggcgggtcccaagctcagagattccagaacagtggatgacactgaggaactctgcctttgtcactatggcacagcattgaacaaaaaccatgccccctcaaagtttgtgctgtgttgcaaccagctgaagataaatcagaaaataggatctgatgttgttttgtagagatctccttgtcctggggcttattgaggcaattccatgatcatgaagtagaacaatgcatacagcccatccagaagagaaccagaggactccaacttctccatggaagccccagaaagctgcttctgagtgctcctctccttcctccccatccggacgtcaaaagaaccagtactagacccgataagcctaccttggttgtcacgggggtggtttgtgtggtgacaaatgagactgtccgagcaactgaaggtgactgtttatggaattacatggagatgttgttatgggaacacatattcagccccttctataatgggccgaattgtgtcctcccaaattcatacgctgagtcttaaccctcaggacctcagaatgtggctatatttggatatggaacctctaaagaggtaattaaggtacaatgaggtcatatgggtggaccctagtcctatccgactggggtgttctcagaagagatcaggacacagacacacacaaagggacaaccatgtgaggacacagagggaagacagcatctacaccaaggagggaagcttcaggaggaaccagcgctgagacaccttgacctcagacttgcaaccttcagaatgtgagagaattaaatctctgtcgttgaagccctgcagcctattgtactttgttacagcatccctggccgactaatacaacttcttacaaggcagctcattttaacataaaaaatttttgtgttgaaatcccaacatactgaggcacatcgacacatgagctgatctgctgatagttcactgtgccaaatagacaaaaccagggagctgttgttgaacctatggggctagcaggaaggtgaggattacaagagtctggattctggactctcacctcctccttcttttccccacacctacaatccctgaggattctttgcaagacaaagtgtggaaatcactgagctagcacaggtacctgcaaaccagaggccactggaagccacactggcccttcattttgaagaaggcccattgcaacccactctattgatttcagggtcctctctggtttatggttcacatttggaaaacttcttgtaaaattagcttattacaagagcatacatgcctcaaaaatttccagcattctccaagacagacagcactgtgtgttttcacataccagaattttcatcatggaaggtgctcagtgatgagtggaacctctctgagaaccagttttgaggttctgggagcccaaccacatggggtattctattcatgaagctgtggcattcctcatgcagatgagttcagatacctgatcaccttttcctatacatcattaaacttggatctgtgtggcaatggactagatgcagtggtatcttcagtcatgctaggatatccttaggatagctactgccctttgctgctgggttgagatgtgcttcataactgtaccctgcccagcccctgccaccctggcccactcataaatattctcacatggggtctgtgatattctgaatatacacatatatatgatacacacacatacagaaacacacatacacatatatgtgtgtgttttatgcaagcttcattacataggcctgattgagaacaagtagaaatgtgattggacaaaacacacacacacacacacagatgcacacacacacacatataggtttttggccacggtttccaactcatatctcccataacccttattgcagtcttttgttagaatgttggggcactttaggtctcagaaaacagaacctctctctctcactgaatttctcccttcttcttttcacctgcccatggcaagattgtaatctgattgtggatcaaaagaccctcattctagacagcgttctgccccatactttagagggaggaatgctacccggagaggccaagaaaagtctgaatagactccttgctgggtttagatcatggttttttttggtccagttgcatttgtacacagttgtcaatcatgtctataaaatgaagtcttcatagaacgccaggaggactgggttcagagaacttctgggtggctgaaaatgtggaggtccctggagggtgattcccagggagggcatggaagctccacactcctttgcccataccttgccttacatgcctcttcatttgtgtcctttgtaatagtctttataataaaccataaatatgttttcatgagttctgtgagccactctagcaaattaatggaaccgaaagaggggactgtgggaaccccaacttgaagctggtcattccaaagttcaggaggcctggacttgcaactggtgtctcagggtagatccctgtaggatctgacactatatccagaaagatagtgtccaaatttaattagaggatacccagctggtgttcactgcttggtatttgatatggtttggctgcatccccacccaaatctcatcttgaattatagctcccataattcccacatgccatgggagggacccagtgcgaggtaattgaatcatgggggcaggtctttcccatgctgttttcgtgatagtgaataagtctcactagatctgatggttttataatgggcagttcccctgcacactctctcttgcctgccatcatgtaagctgtgcctttctcctcttttgccttctaccatgattgtgaggcctccccaggcatgtggaactgtgagtccattaaacctttacaaattatccagtctcgggtatgtctttattagcagtgtgggaacagactaatacactatgcatggggaaaacccccacattttgtcccagaagtcttctttgttgattgttgcagtttgagagcagagggaaaacatggtttgagagtttttgctaaacagggtcccctcactccatgatgagcagttacccactaaatatttttccctcggtcacatgaaagtaagagtgtgctgtgagtggatccctggaaatcctcccaaaactcatcctgggatcacatcctaactctctgctgtcacactggatggacaatttttatgaaagtaatggcagccctgagttcatggcaaaataacacattactgtggaaggacagaggaagctgactccataatagctattcttaggtgtggccgcttggaaagagagacaggaaatcatacagagattacggagattgcttcctggcagtggccctataattagccttgcagaagaatcccttccagtcttttgggtataacagagacatccaagtacttgcactgcatgctcactgctgaacttcatcttctatcaaggctgttcgagaatgccattttcgttttccttgctgtcaaagagctcaaatgcctgtgcccttccctcgctaggaacacgcatcgctttaaatgaaagctgcaattaactccagaagagtgcaggatggggattagggtgaagagagagggagagaaatatcagctttcagattttgcctttgtgataactatcttgtttatcttttagatgattgtgaaaaactgaaattatggaaggagacaaattactatttatgctccagggaaattcaaaaaattctggaaatgcatacttaataagaaacaaatctatacatttataagttttatctctttgaattccaatgactaaaattgttacttttaaattttgttccatttatatctagacttgagtattttttccctaggcagatagctgctgaaaaaagaaagatggttatgagacagttatttgtttaatttgcaatgttttcttaggtactgctatgttacattttataaatgacttggggatacacacacacatatacacacatctctccatatttatttaaaaatctgtctagcattaatgcaaaagataaagtatataagggaaaacaagttataaacttgttttaaattacaggaaggctgtaattcaattcactctttgaagcattttgaaaggatatcataagacgtgtcaatacattgcaattaaattgtttcactgtataattcatttgcactatgaaatctctgctgtttccttaattgatgcatcttatatccatttaaaatatacattaattacttttatttatatttgaattgccactgactgtatttggatttttatttccctaagtggaaattgagctttccattaaaacaaccaaaatcattttttttgtgccgataatttcatgcagtgatgaatcacctagacttcactttatctgtagctgtggaagattaaggtggtcacaaattcttttcagttcctctctccaagaaaggaaatctattttcctaccctttaaattggagctggcctccacatttgatttcaccaataaaatacaacaaagtaatagtgttaaagtgccaaatctggacttcaagaagccctgtagcttccacttcctctgtttaaacagtggtatgtgaacatgcctgggctagcctcctggagaaagtgaaaccacatggaacagaggtacagccatcttagctgtcccagctttcctaggtgaggccccatccacatgactgaacccagagatagcacaagcaatagagatgagctatcctagctgagctctgctgaaattagcaaactgtagtatcatgcattaaataaacaactgttgtgtaagccactgtattagtctgttttcacactgctaataaaaatatacctaagacttggtaatttataaaagaggtttaattgactcacagttcagcatgactgcagaggcctcaggaaacttacaatcatggccgaagggaagcaaacatgtccttcttcacatggcagcaacaaggagaagaatgagagctgagccaacagtgaagccccttataaaaccatcagatctcatgagaacttactcactattacaagaatagcatgggggacaccaccccagtgattcaattacctcccacagggtccctcccatgacatgtggggattatgggaactacaattcaagatgggatttgggtggagacacaaccaaaccatatcagccactatattttgacttaattacaaaatatatcagtgcaaaggctgataaaagataatacaaacctaatacaaacctaagctaatgtagaaactgcaattatgtgccaatatataccttgttctttttagacaaaaaaaaaagccaaaattataattttttatatgtgataaaagcaaaaaagtttattggacaaacagattgtctcctagagccagtttttaagagggatttgtctcataaaaagttcatatagcagctgtattaaagaaaatgcaaaagttattttttatgtctgattttggctgggcatgatagctcaggtttataatctcggcactttgggagtcgggagtgggaggattgtttgagcgcaggagtttgaaaatgtagtgagctatgatagaaccactgcactccagcctgggcaacagagaaagaccctgaaaagaagtagtcagagaaagctggagttacagaaagccagtctaatgtgaaatgggtgagtatttctggggaaatattttgataagggaaccaagctcagaaaacgtaaacagtttgtatgattactatgccacttgcactattttttcctatatatccattattcccatggtgcttttgttggagtttgtggtaataaattcagtattgcacagtttgtccataaatacctttaatagagttattctaatggtgatggtgttggtgttctgcaattgaaagaagaatcctgatttacacgtgttaagatagaaagtcattcctgactttgtacacacacacatgcacagacatactttttatcaatatttatttcatgaaacgttaaatgttcaatgctgtaagcaattattcatttgagactttttatttctgtgacttagggcaagaagatactattttggctcagacaatattgtgtgtgggttacccgttgatcattttaaatatgaaagaataactgcatagtgtttgggcagttccagttttgaacatcatggcctccctaaggacctgccaagatgaattagatgtgaactgcacctcgagtagcatgcactcatgttgaattaaacagcaaaaagcatctactctaaacaaagcttgtagtgtgtaaatagctgtcacagacctgcttttgctaatgatgatttgacatgaaattcccgtgttcctggaggaagggagattgcattagtgccctgatttctcagcctttcctgaaaccaggcccttcacaatgtgaccacattacagcttctctcaacagaaggcaggggatagttcacccctaaattttgagttcacctcattacttggtttagccaatgggtgtcaacagtggcagagattttgaaagtgcttgtgctttctcttgtgctcctgctgttggcccccatctttagatcatgcctgagctagcttgctggaagctagagacctatggtgcaattatctcagctgatagccataggagtgaagtcaacagggaaccaaaataccatctagctgaacacaacctaaatatgcaacccataatccatctcacgagttagacaactgcattttatttcaagccatcaaggtaaggtaaagagtgtttgttatgctgcattattgtagctctagataaccaatcttttcttaagcatacccttgtttgattgagaatagttgtccctcagtatctagaggggattggtttcaggacccccatggattccaaaacttgagaatactcaaggcctttatataaaacatcatagtatttgcatttaacctaaatacatcctcatatatgcagtcagccacacgttctacatctgtggattcaaccaatattggatccaaatatttggaaaaatcaagtacatctgtagtgaacgataaacacctatttttcttgtaaatagtaacaactatttatgtagcatttacattagattaggtattatgtgtataattatgtaccacctaacaatgttttggtcaacaacagatcacatatatgctgctggtctcataagattataatgccatatttttactgtaccttttctatgtttagctatgttcagagacacaaacacttaccattgtgttataataccctacagtagtgagtgcagtaacatgctgtccaggtttgaagcccaggagcaagaggctatgatgtatagcctaggtgtgtagcaggctataccatctaggtttgtgtaagtacacttactgatattcacacagtaacaaaatcatttaatgacacatttctcatgaggattaagctctgatattttatcttgcccaaattcccatctaaggagtctgggtagtcatgctttacaaaatataaattctcatcagatgggttttattttaccctatatattgtgacctacgttccaataagactctgtcataacattatgtgacaaagaagaaagttaaaatattttacccccaagcatgtttctttgctatatcttgaaatggccctgcaaatttgtcctttgtgggggaaaatttgcatctgtaaagaatgtctattaacatagctagatcttttcttccaggcactcccaattctgaagagatttactaagagtctggcaccttttaaaggtctgaataggaaacatttgtcgtctattgtctctaaaggctgccactataagacttcaaaagaaccttggtctccacgatcttttatcttaacctgaacatttcctttctatcaatcccaggtctttagacaaactcaaccaattgtcaaccagaaaatgtttaaatttacttacagcctggaagctccctgcttttctggttgacaattacaataacacattgattaacaacagggctatgttctgagtgtcgacaaaaagagtcaaactctgtaaaatatttgaagagatttattctgagccaaatatgagtgaccatggcccatgacacagccctcggaaggtcctgaggacatgtgcccaaggcgatgggggcgcaacttggttttatacattttagggaggcatgagacatcaatcaagtacgtttaagaaatacataaaggcgagacaactcaaagtgggtggggacattgcctgtaaaattaaatggcaacatggcatgcctaacttgggagccaaggagccccccagtgaaatcctagcacaattacttatcagttttagatggttgtagaagatccttaaattctataagcatcagctttctcataaaaaatggagctattaatattacttccatgagagtgttgctcggagaattattaaattcaatggtatattcagaatgcttagcagagcacctggcagatatttaactgttcaataaattatagttattattattaagactgcttactcctcatagaaacctgaaaatttgggagaagcagtttattgagaagaaaattaacttagaattttgatgagcgatgcagaaaagtaatgaattgccatatttgtgacacagagagttacctctttttgaaaatggggcagattatttttattatttcatcctgagggacccatgcccagggaatcagacgaagcacagcaaggattgaggtctctcatttgaaacaggatgtaaacacatctgtggaacaaagatcacccagggcagtttttaactatgttgattaatcatacaaattataatggatggtacaaacaaaaattgctgatgcttccaaaatcattaatgatttctgtagtcacgtaaagactttgggaactattaaaccaccaacttttgtatccttttcattccaattccaatgataaaaataattgcacattagggaaaattcggacaatatagaaaagtaaaaacaagaaaaaaaatggaaatctctcttttcagagcataaatgtttcagtgtattttctcccaatctttcttcttcttgacatttaaaggagaaccataaactacgttgaaaattattttatagaaactcaagatttttacttttctttctgcaaagaaaacgtgttatttcattgtctgtgtcagaggatcttgaacaatgaactctcagattccaaacaaaacatttcaataaaataccaaacttactgtttgcacccttagaattgctataatagacctcgacatttttgaatccttgttctactgaaaggtgagaggaaaatgcgcacagttgtctgacataaacaagattgtattaaacagccctgtattagtaggttgaaagtatgctgatgaaatgaaactaacacaatgtgttgaaataagaaagaaaagtacactttctaaagcacaactctaaaatttgctttggtttttagtttatggacactccgacatcttttcttttttagggtgttcaaaaatgacctcagaatgcttcatgtgagctcaatcatgaataattgtggtaggagtttattggatggtctgatacccattctaattaagcacgtaaaagtacactgggttcctcaaaattatatccagagccatcacaggttatggatccaacaggaggtttgatgaaatacacactgctcctagctgagaaggctgttgaaaacccacatgaacaattgcacttataggatttaagattgactcagggcaccctggtttgaagaggatgacctgagttgaagtgaattcttaagaccccataaatacaatgttttgtcgggggctgatataacccaattcatgcctgatgctcctggatctctagtctgatttccaccctgccaacccttccagtagccagctctcagtgtgcacatgtgcttaagtggttcttagcctctcaataaacagcccaggacagtaagggccaaacaaaccttcaagtatgtaaaggaaattgcaagtgaaccattcctgcagcccaagatctaagccctattaagaaaatagatgcctatttatcatcttcattcatgtgccttgcaggggcaaagaaatgactaaagacaatcttgcaatgtatgtgccaaagacatgcatttccctttggattatctgtggagttaatttccaaagatgcaacagaacataacagagcaatggatcagtgcctggcagatccataagtcttacactaaatgcatgactggtagtctgccagatgacagaggaattcttcttcataccattgccctagctctgattttcaaacagatattaaaaatacagaggggagattctcaaatcacaagctttcaaagttaacatcgaaagaagccataatcatcacatttgttactagacgatacctcattttcaccatgtattagttaagcacttaattggctccccaatgctttgctagcaacatatcacaattgtgaaacttcataacgagtgtccactcaatatatttaaatttcgttttttatgacttcagctaggtggatgactgacttgctagacaaatatataaaagcatattaaaattatgcataggtagcagtggcttaataggatttctcctacatttcagtatttcactgaaacatgctttattttcacagtatgctggctgttaagtgcaggcacatgaatgaaaaaggaatttgaccatctccctatctacaaatgttattgtttctacagctgtctcctccatttctgtgtcaggctcaacctaaaagaaaaattttaatgtgaatgaaagtctgcacccgggctctgagaaagtgtgtggaagaagatggtaggtgtgctcatggtagcatgtacgtcgtaggtcataaacaatgaagcacctgtcctttacaaatatgaaagctcacagttattcatgttactcagactctttgtccaggtttcagttcttttctttgccctgcaatgtaaaagtaatcacaactaaataggaaatatggatctccaatccacaagatgaggtgattaggaactgttgtttgggaagcattggaacaggtggagatgattagtctagaaaagacacatcttgctgttgaaatatttgaaattcacgtaagacagtaaaagaactcctgttgcattccaggggacagagctagatctcatagataaaagccacaaggagacagaggtaagaaaaacataaatatatgctaaataggagaattctacatatggcactattttcagaaagagcattaatacaatctctatttatattcagacaattatcctagaatattatagtttttttcataattgtgtgtctactgtataccacctaggaaatattaaatactatgatcagtatttttgttattgctacttttatttttattattaattgggagcttttccagacattaataaacccttagcagacataggtcatacatcagttgctcaattcattgtcacctctatgagcatatttctgatagtgaagctcagtatgtgttgtgtaataaataaaaaggaaacaatgaaagcaaattactcattattgccttatggttaaataaagattaaaaaacattggaaaccatgtagagaaagcagggtataattatattagaaaccactgtgtaaccatcactaatattaaggaatacatctagtcctgacagctccttgtaaatggaaggagacatgttgccaacttatactatctactggaaaaggtagacattggcaaagctgtcaactgtctcacaagagaagccaaggggcttctacaggtatcctccagagatattgtgggttccgttccagaccaccacaataaagaaaatatcacaataaaagcaagtcacacaatttttttttatttcccagtgagtataacagttatgttcacattgtactgtagtccgttaagtacgtaataccattgtgtctaaaaaaatatacacatacctaaattgaaatactttattactaaaaaatgttaacaatcatctgagccatcaatgatttgtaatctttttgctggtgaagggtcttgccttagtgttgatggttgcagattgactaggatggtggttgctggaggtggggatagctgtggcaatttcctaaaataagacaacaatgaaatttgctgcattggttgacacttcctttcataaaagatttctctgtagcatgagaggctgtttgtagcattttacccacaagtagaacttcttttaaaattggagtcaatcctctaaaaccctgccacttctttatcaattaagtttatgcaatattctagatttttttgttatttcaacagtgttcaccagtatattatatattatattatgttataatcttcaccagtatattccttctcaagaaataattttctttgctcattcacaaaaagcaactcctcatccattcaagtttagtcatgaggttgtagccattcagccacatcttcaggctccgcctctccttctactactcttactatttctcccacatctgcagttacttcctccgctgaagtcttgaacccctcaaagtcatccatgaggcttggaatcaacatctcccaagctcctattaatgttgatattttaacctcctcccacaaatcataaatgttcttaatggcgtctggaatggtaaatcctttccaaaaggttttcaattaactttgcccagatccatcagaggaatcactatttatggcaactgtaaattatgaaatgtatctcttaaataataagacttgaacgtcaaaatgactccttgatccaggggctgcagaatgaatcttgcgctaagaagcacaaaaagaacactaatctctttatacatctccatgagagctcttgggtgaccagattaattgtcaatgaacagtaaatgttgaaaagaatccttttcctgagcagtaggtatcaatagtggcctcaaaatattcagtaaaccatgccttaaatagatgtgctgttatccaggctttgttgttccatttctagagcacaggcagagaagatttagtatcattcttaagggccctaggatttttggaatgctaaatgagcattggcttcaacttaaagtcaccagctgcattagcctctaacaaaagttatcttgttctttgaagctttgaagccagacattgacttctcctcttcagctacgcaagtcttagatggcaacttatttcaacattaggcagtttgatttacattgaaaatatgttgtatagtgtagccaccttcattaataaccttagctaggtcttctggataacttgctgcagcttctagatcagcacttgctgcttcactttgcactcttatgttatagaggtggcttcttttcttaatcttcatgaaccaacctacactggcttccaacttttcttctgcagctttctcacctctctcagccttcatagaattgaaaagagatagggccttgctctggattaggctttagcttaagagagtattgtggctggtttgatcctttattcagaccactggaactttctgcatattagcaataaagctgtttcactttcttagcattcatgtgttcactgaagtagcacttttaatttccttcaagaatttttcctttgcattcaccacttggctaactgttttgtgcaaaagcctagcttctgccctcttggcttttgacatgccttcttcatgatcatttcttgcttgtgatttaaagggagagactctgcctttcacttgagcacttggcctttgtaggggattaattggcctaatttcaatattgctgtgtctcagggaatagggaggctcaaagagagacagagatggggaatggccagttggtggagcagtcagaacacacacaacatttatcaattaagtttgccatcttataagggtgtgatatgtggcaccccaacacaattacaatagtaataacaaacataactgatcacagatcaccaagacaagtatagcaataataagaaatacaataataatgaaaaactttgtgagaaataccaaaatatgacatagggacacaaagtgagcacatgctgttggagaaattatgtatagctttgctcaatgcagggttgccataaaccttcaattcagtaaaaaaatgcaatttctgtgaggcacaacaaagcaagataggcctgtgtttagatgagcactggaaaccaagaagttcccaaataacatttaaaacacagaggcttagggttacagatgtgtgtcattttaatcttcctttagtaaaattatttattgtatagaatgattttctttaaataattacatgccctagagaaattacaatttgataaacaaatttttggattttttttttgttataggtaagctggtctacagaccacactgggtatgggtaagctagtctataggctacactatgtatgagtaagctacactatacaatacactggatatgtgtaatctagactataggttacactggtgatgggtaagctactctacagacagcactgggtgtgggtaagctagtctatagggtatactgggtatgagtaaactagtctatagactacactgagtatgggtaagctagtctatagactactttgggtatggaaaagctagcctattggctatgctgggtatgggtaagctagtctatagactacactgagtatgggtaagctggtctataaactacactgggtttgggtaagctagtctatagactaaactggatataggcagtctattatatacgttatactttatatgggtaaactagtctatagactacagtggatatgggtaatctagtctataggctatatttgttttgggtaagtcagtctatagactacagaggatatggataatctagtctacatactaaattgggtgctagtaagcaggtctatagactccactgtgtagagatagggtaagctagtctatagactacactaggtatgggtaggccagtctatagactgcactgggtactagtaagcttgtctatggactcctatcagggatgcctccagatatggaaacatgcataatgaacatgagcaagtgtcaggtcgagccaatattcttgcatataagttctcaaaggggagaatcagcaatgcctttttgttgtccaccaagtctactggaatgagcttgagtctcacaatttccacacacaactcaaagcaaagcagcataattttacagctgggcttgctcaaatttaaataatcagagccatggcatctttctatctcttattctagtgaacaaataatggtaatcataacaaaaaaatagtaagacaaagtcattattggaagtcctttggcagatagaatcctacataaacatttttaaataatctgtggtcaggttgagcctacttcccagaacttgggatgattaatagtattggcagtttaaaaaggactaaaaaattttggcaagtcaaatgaaatggttctaactaaacatactgctcattttgctcaatcaaaattactcagtgagtataaattcagtggttttaacagaggaaaaattttgtaaattttaaaaataggctacctctttagtgtaagcactatactaatgtagacataaaaatatatagtatgttttgattcatagatttataatattaataattacaactagataaaacaatgtgtttatgcagttaaaagtcatgcattaaaattttttcttatgtgggtcaatgatgaaaaatttttgttggttggaattagctgttcattataacatgtctgtgttgcatcgtgtgtgtgtgtgtgtgcgcgcgtgcgcacacgtgagtgtgtgtttacttatctatggctaatagttttctctgaaaaactaaaatgaagaatattagacacaataaatgtgcagaaactatatttacataattgtcagggtctcgagaaacatcaggtaagtgtgaccatttatttccatcttcacaattgcttctctgtaattaagctgtgcttcttggtgaagccttcttgaaatgccaagtatttacacctgttttggatggttgtcatcggtggtattttagatttcccagtttgtttgttaggagaagcactagtgatgtaagacaccagaactgtccaatttgtaaaaataagcagggataattcagatggcagagacttgatcctgggtttgggtgagtcctttgtttacccagtgcccatcagtcacagctatgctaccaagcagcatgtttaaactttcattaatatgtctatgaccttcatgcttaatgagccttcaggggtctcagcaggcaacattttgaaataaacttcataaggaataaacaaggacattggaaacaggcagaggaactagcaagagcatttggtggtgtaaaccaaagtctaaactatcagtagaagccaaagtgattcaaagtatctcatgtattttacaaaacaaatgctcttcgttttaaggagagaaatgaaaaatctcaaaacacagtccaggaaaaatgaaacctgaattctaactcagtaaaatattattcttgactttataaaagatttttctctacatactggactctttaataacagaacttattataccatttaactgctacagaaagatggaagttatttaaaatatagtatacctattatatgttgaaattaggagacttttagggcattaaaatatcccaggaaaggagagggtccaaattgctagactagtttcatggcttcactgagccctgacagatcaatttaatatttgaacatcattaatttgaacatttctcatgtaatttaaggctcacactgcataatacagggatgcattcaggatctggacttggagaggtcgttttaaaaagccattaaggtttagaaatagaagaaattacagtagttagtaaaatactatggaatattctgcaacatgcctcagttgtaaggctaccagatcctaaagatggagtgaaaattgacaccaactagtcagagaggtttctatacatgtttcagagcacacatttgtatattttattgaatgtgtatatgaaagctagagacatgggtcattacttttcccaatcgcctttctcccaactctttttcttggaagagtcaaggttgttacaggcacacagaaatacactggaggaactcagaactgaccctacctactagacacttagtcttacagtgatcttccccttttctctcttttccttttcatttataatagaaacaaaagttatagatatttaaaacacgtatgctttccccaaaacattaaggcacaaaaggcattcattttatgcaaattgatcataatcatagccatgaagcaaacatatctcatgatggttttgatctctaatgttttctcttgcaaataataggtctcttaatcacgttaaagacctttggtcctatagcacatgtcattttaaaaaaatgcatccacaagagatttgacacaaggcactcttgattgtatctgtttttttataagaaacaaaaataacaaggtctaaattgcaaatatacttgatttcatcttactggtacctttaagaagaatcagagttgtgtttagaaaaggtgttgaggtgtgaaagctgtagataattggactctcaaaatatgaaataaacgataaagtgtggataagttaaatttggaaaagtgatttttgttggacttcattttgtctagactttctcatttcccgttacgtaatttgtgatgtgacactaaacattcttgcacacataagaaactggccatcagagaaatgcaaatcaaaaccacaatgagataccatctcacaccagttagaatggcaatcattacaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccatcactgggtatatacccaaaggattataaatcatgctgctataaagacacatgcacacgtaggtttattgtggcactattcacaatagcaaagagttggaaccaacccaaatgtccaacaatgatagactggattaagaaaatgtggcacatatacaccatggaatactatgcagccataaaaaatgatgagttcatgtcctttgtagggacatggatgaagctggaaaccatcattctcagcaaactatcgcaaggacgaaaaaccaaacactgcatgttctcactcattggtgcgaattgaacaatgagaacacatggacacaggaaggggaacatcacactccggggactgttgtggggtggggggaggggggaggggggagggatagcattaggagatatatctaatgctaaatgacgagttaatgggtgcagcacaccaacatggcacatgtatacatatgtaactaacctgcacattgtgcacatgtaccctaaaacttaaagtataataataataaaattaaaaaaaaaagaatttaagatccctcttacacaataatattattctgtatttaaagaccgctatttaaagaacattttcattgtgaggctatttttagtccttcacacttaatagtggagataatgataatatttttttttggaatgatgaggcgaatgatgagatatttttaccccctgatgcatcatttacctagctcaacaaatgtgtggagttattggattttgttatttatatgggtgtgtagaagggaaatcttgctttctgccagtcttaggggagcattttaatctgataatgtctctgtgaagagccaaatagttatttatcagttctatctcatacttaagtcacttgacctcctagtcaatattatgagagttgtgtatgaacttcgttctccaaaaacttcagaagtcaatggaatttgatgaaaaataagggaatgaatgaggaggaaactacttcaagaacaagaatcaacaggattttttagggggcctgttcacctttataacaccccacatttccaaatgacagcactttctctagtgattaattaggattccagcagagttttcataaatttggaatctagttaaaagggaactcattaaattgttaaattcaaactagttttcctaggttatgttcctttgaaagtgctcagtgaatgaagcaatgctctatacacacagtagaactacggatatatatgtatctatggctatatagatatataagattctcatagatgacatcattgtcatatatattacatatacctacatatgcatatgtgggtggagagatagatcttgaaattgaattcaactactctaataattcagttttattgtcttttatttcttatttttcttgttttctcttgtcttctttaatctctttttaatgctagcaattaaagatttgagaggctcaaagtcctaaaatgacataatatttaaatgtaagcatattttggaaattctaagatagctgtagaacttattttttacataatcctgagaaacaactatggattttttttatcacaacagttgaattacaccaagtcattgtttcattgggaatggaaataatactgacagattcacttcactctttggccttataaataacaatctgagcttctcacctcaggttctacctggtttcataagtataaatgtagactgtaacgtaaacttatccctctattcttcagtcaaaactcgggagcatgaaaagctcacaagacatctttcttaaattcatatagccatatgtattcatagttgatatatatatatatatatcccctagatagagtgttattgattttttaacatattctgttcatctttaggtatggaggaaagttttcagtccacagcagctttgcatttgacagattttcaagtaaccattatcttagcgaaatgcatccaattcaattcagcctttttttgttgattttagaaaccaagggttttctttattttccatatttatgaggagggaaaggggtatgagaaagctactgaaattctgtctaaatgggaagggctaaagatatgctcaaggtttgctttgtttggctttgtttctttgaaatgtacacagggcaagttgagccatgaagtaaaaacttctgaaacctgaggttgataagcattcccaaattacttccctttgtgagatgctaagatgaaaggtgtttcaatgaatcacctgcttgtttaggtgtgacatagggccacatcacaggggcatcattttttgtttgtttatttgtttgagacaggttcccactgtgttgcccaggctggagtgcagtggcgccatcatagctcacagcaaccttgaactcctgggctcaagccatcctcccaaggatggcagcctaggactgagcagttgtgtttattgcttaaatcgtggagcaagacccttagaagacattgtattgtgaaaatgcatgaagatgctcagagtacatccatgaaatggtcttgtttgttttacatgtgattattagcattccaaactctgtatttgaggacaaagtattcttataaagcagcgtcgtttattaaaacatttaaaagacaggcaaacgatgggaaaatcctctaagtcatatatactatacttagcccctaggtgctgtgatggaagacatataggtactggttcaatgtttatattaagagctttataatataatgtgaaaaaatgagtgtagtcaaataaagaagataactgtgcattcaagaaatttgtatcatccttttttctatgttttcttcccccaggtattaataaaagcttaggtgaatttttagaatatagattttttcccattgttactgtcatctttatttagcagtgatatttcaaactattttaagatctttagtatacatatgggagatacgaaggaacaaataacaatggtattttgtctgtgtcttctctgagaaattcaacaggttgctagtgaaagggctgtttagttgcaataacattttactatggaacgttatcagtttataccatgtgaggtgttcatttctgtcacagtgagagaacatgcatccttgctgtgttctcaatttaacttaaatctcatgatttcctgttttgaacaaacatctacttaattcctggctcctactccccacccactggcagccgctgtgcagctgccgtgattactaatccacctggcgatggtcaggggaaggtattaagtgaaattttgacttatgaagggctaaactacttacagtgcaatagcatttccccataatgcataaaacacgtagagaaataaataaataaataaataaataataaataaataaataaataaagtcagagaacaagatcactctttatccaaataacacaggttggttttattgctttaaagcataggcacaaaaatcagcctttgggggaagacgtggatttcaactcactattgccaaacacgttgatataagagatcgtgtggtatgcagctatgtatagatgtgtgcctgagatgtgtaggaatctcgagaactttttggatgtttcttcctgtgatgttggaaagacttggtagaattacataacaattcagtatgagtccttagcacgatccttttgtcttttttcctttttttttttaatacatgaccaaactgatggaaacaaaggtagcaggctgatgctgtaaggacacggtgtaggaatgtcttatgctagttagtccatcacatgctagttctatttatttatttttcctgagatggagtctcactctgttacccaggctggagtgcagtggtgcaatctccgcacactgcagcctccacctcctaggttcaagtgattatcctgcctcagcctcctgagtagctggagctacaggcacccgtcaccatgcctggttaatttttgtatttttttaaagtagagatggagtttcaccatgtttgccagactggtcttgaactcctgacctcaagtgatctgcctgccttggcctcccaaggtgctgagattacaggtgtgagccaccacacatgctggttcttaagaacaagtgagaagattctgtattgtgaagtcagcctattgcattaaacttattgtttatatttgattcaaaatctgcttatgacaaattcgatgtcatttttgtgttgcaatctggtgtctgtaggcctttgccttgcagtttcatgtgaaataacatttttaaaaatggtttgtacctatgtagagcttattctaaactcagagtgtggattggtgtcttggatgggagctgctgtgtgttttccttcctgtgccacccttcctcctccagacacttccatgtggctggctgcggctaacatcagccatcacttatacatagggtgagaagactcgggatttggtatctttaccacttgatctcacttgctcccctttcttcttggtgcatggaatttacttcctctgtaggcaagtcaagcctcctccttttcagtcttcaggcagtctgagacctttcttgccttgcaatctcagaattgcagcattttattatctcagaattcctctgaaagtgctgctgaacttgaaaagcagtatctagaactttgtattttcaagacttcgtttgactgtttgcctagaattgagtccacctactaatgtttgctcaggtaactaagtcatccacacatcctgtgcttatctttaagctgacaatcctaaaatgagagccacatcctcactgtaatgcacgagatgagagccaagggtacatacagagcctgagaattcaaagtttaaaaggcttacttagggtgtctcagtaaaggacacctacttattcctgcacaaacaatcgtgggtaaagaaagagatggaacaccttttgaaatgcatatgggtagcaaaccatttttttattaaaaaaagttattttaagctaaatgtgaccctaacacacagtgccccccaaacacacacacacacacacacacacacacacactttattatgtgacataaaaagtgcattattaaattaagcaataattaagtaattatttgacaattataaacaacgaataacctctaaaatgtttgctaaagttgcaatgtttaaaatgtatgccaataactagcttttacatagttaacattagaaaagcttatgctgaaggaattgttctttctgaagtaatttgattaataaagattgctgctctcttgcacaagattcttgcacaagttgggagaaaattctgctgagaagggagaagtcacatggtggtctggtggggagggcaggactaacagcccagaagttccagagcttgtgcaaggctccagggccagtaaatgtgactgacaagatgaaggttgagctgtcttgtttccgtgcctgaacgctttcccctgaatttcccagtctcaagaggctatgattctgcttttggtcctgtgtgtaaatcactccagttctccacccatgtctgttcgagggtacggacatccctcttagcatggaaatgtgattgaagcccaattacagccatgaatcattcccaaatctgcaggacatctcagtttagctggggctttttagaaaaattgcaattccaaagctccacccttagggtaatgcagacctgtcactgagcagaatcacaaatcagaatgggaacagggaccagtgtctgtgtttggaagccaactgtggtttaactcatcctacttctcagtgacctcttccattcacataggttgctatctcttatctgatcaccctccataatcaatacattggctgaaatgatgggaaaaatattccagctctgcagtcattttgtttattagaatgttgtgcttgggcagcaattccatcccctgggaaagactgaggaaggtccccagtagcaggaggtagcatgatatgatacaagaccctgggctttgggttcagaggcaagttccatcctgactgtgtgttcctctgcaaggcaattaacttcctacatttaaaaaattctacaaactcatacaaatacacttacctagtgcattgctatgaagacaaaatattatttacagtacctgctcaataaatataagggtcttaggaaactccttcagagggggagaaggcagaggaaaccctctactcttgaactactcctctttttcttgagacaggatctcactatatttcccaggccagagtgcagtggtgccatcgtggctcactgcagcctcgacctcctgggctcaagcaatcttcccacctcagcctccctagcagctggaactaggagtgtgtgctgctatgccaggctattttttttgttttgtttttggttttggttttttttgtacagacaggatctcactatgttgcacaggccggtcttgacctcctggccttaagtaatcctcccacctcagcctcccgaagtgctgggattacaggtgtgagccactgtgcccagccttgaactactcttatgttcatgtcaaaaaccttacctgacctttacatccacaaatctgtcctgcaagatgtatgtgtatatgcacacacacacatcaagagttgaggatcatttatatattcacatatttttttactcatatagaactatggataaagagtttgaaccaacataaaaagctcttttattttaaaaatgagattaatgaaacatcctgataattattgttttctagtcttttgatggtagctcatataattttgaatgacaaatatgctctctctttatttgttttatatgtatacatggtttctgtgccttagtaaaaatgccaaccaagtttatttttttccttctttgaagaatttttgcagagctatgaaggaaatatagaaaataaaagataagctactacatggaataaaattcataaaaagcccttccctagtatttctccaagtagcatcagctgcatatttctgcagagtgctaagttgatatttttgataattcaaggattcgagccaccatccagtttcattctgcagatgtaggatagtttaactgctcaagtaggtcataaaatacaccatttataaagcacttaggtacactgtaccatgcaaaggataacatgctaaaacaaaagccttttttaaggagtttgatattaaaagcatcacaatgcaattattcatcctcaaaggtctgtgttgcagaattcatggcttagattagagaatatcaaggggcagcactccgaagtgtggcaaattgggggaacttctcctagcatattgcacctcatgataactgaaaccaagtgcagggctggctatttgctattctatgtagcagttagacaaagctaattagcaatattgtgcttagtaaatatgtttcaacatacattaaccgattatccatcggtgaaatattgcacaattaattttataatataactgtcaactgcagagatgatgggcatgattcggagcaagagcctaccagaggctgtttctcagccttggtactgttgacatttggggccagatgatgctccgtggggctgtcctatgcattgcaggctgttttgcaacgtccctagcctctatattctgaatgccagtaactcccccactctctgtcccacccacgttgcaacaactcagaatgtctccagacattgccacacgtccactgcggaacaaaattgccctggttagagttactgtaattctcaaattgccgatttttacgttagtattttaaagcaccccaggtcattggaatttgcagcctagcttgacaatcagtgggctattcttttgcaacttaaagtcagacctaccaacccggaacatcagcaccatctgagagcttgtcagaaatgcagattcccagacctacagacccagagtctgcattttaccaagacccccaggggatttctctgcacatggacttttagaagccattctctggcttgtacagcctcctcttctcagagaagtctccataattcccaggtcccgttgagcagacagtccaagcaagcagatacaatggttgcacctcgtcaccctcacaacctcacagcagactggattggggaagatgcctgacacggtggatgcagtgggtggatgcagcatctatcagttaccaggtaaagaactaattaaattctctctagagagtttttgttactgacaagggctctagagactgtgttggtttttgttgggagacaacgagattgtgttggttcttgctggaacacaacaagaagtaaatacttggggcaaagctgaatgacctgaatggcagatattgacggaggaacctctcctgctcaggtcttggctatctctgctctcatcttttttcctttggttgtttcctctccctggttcagagattttcctttgcctccaggttgcccttggtgcccagctgtgggcgtgcagtgcatcagctattcttgggttggcccaacccttgggttgggttggcatcagctattcttgagttggccttttcctggcaagaaattatacctgtgacaaaaatgaaaatgtgttttactttaataaagttggaggatggggatgtaaaataatggtaccatactgtatcattaagtttataatgcagattctataattgcacattgtctagtggttgaactcttatgaagagccatttgatgtttaaagaggcataaaaataaatacctactttgctgtctaatattgttgtaaaagatacatattgggaaataatccaaaataaagaaaaggagaattaaaaacaacttgagtgttagtaagtaaatgagtaaaaaacttatattttgtcaactgatagaaatatcatacagccattaaaatgataatccctaaatttgtataacaacattgaaactgtttgtgtcaattcagcgacaaaggcaaaaacaaaattttatccatggcaggcaagattggagctgtaaaacgtgtggatgcataaggagaagattggaatgaaacacaaagagtaaaatgtgttgatttaacatgagatggtgcacatttttagatttttgctttcataaagttagatgattggtaaagatgtgcatgtgtttctgtcacctctatcatgtctatcacctcttgtcatgtctcttgaagtgtagtgcttcttaaactttccctctatgtaggttgaaaaatccaggagaccatagatacactttaatgttaaatgagcacgagatggcacgatttttagttgctatcttcttagctagttatttttcattccactgtaacagaggtgttttcaggtatacctaagtgcaagaatgataactactttgtctataaaatttgaagtgtacttgtctataaaattttaagctttattttaattaagaaaagagcagctatgaggagcttggctggggctgcattcagaaccttgctgcagttattgtgaactgttgtggacgcttacatgaactctgtaagtcttgctttgttgtccataaaatggggatggccacagtagaactggcgccaaggtatttgttaaaattaaaggggccatttaaataaaaagcacagtgtaatgcctggcaaattattactatggaaagcatattaattgtctttgttgtttctatcttatgtcaaacagtagatctgtgtaaggcagataattatatggtcaatgacttacattttactatattttcaatcttaatattttattatgatctataatcattcctatttgactatcacttatttttattaagcatcaatgcattcctaataaacttcaatattatcaagatgatttaatggaaatcatggaagactgttcgtttatacttaaattagtgtctacaaggcacgcagacaaaactattagttaagaaggcctgattgaaaagtacaacccattttttattacttttgactataatacttttttcttaatttttctattatgacatttatatgacctaacctattgaaattacttcctgacaccagcaattcacatctttcataacttttggatgctattgtttctccccctgaagtgtgctactgtcaagatgaagccactacagtagtattcagtatgatggcacattcttatctctggtcaaatagaattttacaatctgtactctggcagtaactgcaccatctcaatctaaatctatttgggttattcttaatatattctcagtaaagagaataagatagttatgtattttccttcaaataattaactttaagcaaagctttcaccaaagaggatttcattagataacagtgttaactctgcttactattagaacgcatccctgagcttataattgaagtcatcaaggaaacaatgttcagctaactgaaattttatgtagtaacacccagtggaagtgccatcacattcattaatgaaaacatcttgtgctacttcttgggcaacagctcccattgagtctgtcttgcttcactgtgtcttgactgtgtcttgaagggaagtgttatctactgtttgcttcagaccatcttttcaaggatgtttgtgtagcaaacagttttggaaagataggctatactatcttcttccagagcaaagggccagaatgtccaccactgcattagtctgttcttgcactgctataaagaaatacctgagactgggtaatttataaagaaaagaggtttaattggctcacagttcttcaggctgtacaagaagcatggtgttgaccacctgctctgcttctggagaggcgtcaagaagcttacgatcatggcagaaggcagagggcattcaggcatgtcttacatggccagagcaggaggaagagagaggggggaagtgctacacacatttaaacgaccagatctcgtaagaactgtatcacaggaacagcactatagggatggtgctaaagcattagaaattgcccctgtgatccaatcactccctcgaggctcctcctctaacactggggattacatttcaacatgagatttgggcagggacacagatccaaaccctatccactaggatccttaagcatgggatgcctcttctgtaacatatccactgtatttgtaggagtccatttcagcctatctgcttcagactggtgggacctcgatgcaaacagagctaatgaaaatgtgatgcttctgcttctttttgtgccatgaataataatctgttctttatctctgacccaggagtctcatgtctttggctaacccctgtaaccttgtggcaggctaactagtaagcttgcatgtagagtaaaatctcaggcccttcacagttcttgatgtgtgtaggtgtgagcatccttaggcataagttgctaggatggctcttgtgaggaaaaaaaatccatagaatttaaatttagaatggtttcttgtcagaatagtgtttgtgctctttttgcaaagattttcaaatccactcaatccatgtagttttacactagctggaattttagttctaaccattgagaattattttttgggttctgtcttagtccgttttgtgttgctataactaagtactgagaatgggtaattaataaagagcagaaatgtattttctcacagttctggaagctgggaagtcccaggtcaaggcaccagcaggttcagttgtctggtgagggctgcatcttccagaagggaggatcactgtgttttcacatggcaaaaggcagaagggcaattgagctgaatgctacctgcagcttcttatatgagggccttaatcgcattcatgagggaggatccctcaaggcacagccaccttttaaaagccctactatctacattggtagtgtcgcattggttacacctgaattttggaggaaacacattccaaccatagcaaattccctgcaaaaagttacgtgtgtatgtgtgtgtaggggtgtgtgtgtatatgtgtatatgcatacatttgtgtatatatatatacacactcatatatataatttttatattttatatcttataaaatataaggatccattttattttcttctggatgctaacagaaacattcttaatcctggctgcacattagcctgggagaggaggacttctgaacaatcccgtggcaccaggcgtggtgactcatgcctgtaatcccagcactttgggaggccgaggcaggcagatcacaaggtcaagagatagagaccatcctgggcaacacggtgaaaccccgtctctactaaaaatagaaaaattagctgggcgtggtcacgtgtgcctgtagtcccagctgctcaggaggctgaggcaggaggatcacttgaacccgggagacggagattgcagtgagctgtgattgcaccactgcactccagcctgggcgacaagagcaaaactccatctcagaaaaaaaatcggtagaccaacccaccaaaatctcttattaaatcccataagaccattttaaatatgttgccaaatttaagaaccattggcagaaattcacaaaatgtgacagttttccttcttgtcatgtctcttgaagtgtagtgcttcttaaacttttcgatgtggccaaatcacttggggatcttgtaaaagttcaggttctcatctggtgggtctgcaatgggtacccaataatctgcatttgtaacaagctctcaggtgaggccacggcttctgattcaaggtctgaattttgaatagcaatgtcgtagttgttattttcataaagcaaaagcaaaacaatacagaacaaaagaaaatgtaacccaagcgtcaagtgtttcagctgttgagatgcagtacatgctctttgctttttcctttttttttttttttttttttttttttgtgacagagccttgttctgttgcccaggctggagtgcagaggtgcattcattgctcactgcagcctcgacctcatggactcaggagatcctcccacctcagcttcctgagtagctgggactatagggcacaccaccatgcctggctagtatttttggtatttgctgtagagatgcacaggttgatctcaaattcctagactcaagtgaccctcccaccttggtctctgaaaatgctgggattacaagtgtgagccactgcaccctgccatggtacatgctgttaaaacaatcatttttttgataatactagtgatctgaaaactaaggtatggaaaaataaagaaatactgctgtcaggaaatcagcaaactgtctctttataaaatacactgatttttgccactgaaatcagcatttgctacagaatgaagcccatacaattagaattttttaagcatctgaagcccccctgcctggccttggcatttatgtagctgaaagggagcattactctaaaaaatgctttctttctgtagcacatttttcattaagaccacgttgtcacttaactcatattgcttaagaataccatcctggagacaaaaacatttcaaaggaattgtaccatgacattcctaccatgtgggtcattacaaattgccttgctgtggtttaaaagcagaataatttaaacagaagcacaagtacaagctctagaactatcttcccagtagggttttaccctgcagggtacaagcaataaaaacattgagcacagagatggaaataggctgtggctcaaatcacacacacacacacacacacacacacacacacacacacacacacccctcacattcacacctgtttccctttcttgctggaggtgaaaattggaatgctattataagcttgtgcagatgactataactgagaaatcaggcacatcacagggaaatcattgcacctacagcctcattctttttttgaaagctggcagggcacatgcaatataaaatgaagggtgagacagcatgtctccagcaggacagaaaaggttatggggcactgaggaagtatgggaaatgctcagttgctctcagaaacaaacaatgaaataaataaaaatactggaaagagagacagaagcatagttgtagccttaggtatgggtatgccaaaacacagggagtaaataataaaataaacatgtgaacataaaggcatctatgtgtccccatgtgtgaggtgtgactcaagattggactatagcaatggcagaggatgttttgttcaaaagctagatagatatgctgtcagatggtagtgtcagactatacactcggccagcataaaaattgcataaatctatgaacctgtaatggaaaccacaacacaatcgatcagcattgaaatactttgagaggaggacagtttggcataataggaacctacactgcaggtcaacatccagggaggatatttggaaagtgttttccaaacaggtaattacaagacatcttcaccacaatcatgagcaatagaaagctatttcttgtgactaatgtagcataagacaaattctattttgatgaaaatttgacaaaagacaatgaaatgaagtaatattacctgagcatatacgtatatgtaccaggggtatttaaatgtgctgcttcctaatttttacaaagccttatggaaagtcttcattttatagttcgagcaacggagactctgagagcttaaataatttataaggtgcgtccagatggacaaagctgggaaacaacctcaaggttgattttttttttcttctttgaagtatcaagtgaatttacccgtacacacccactgcttgactagactaagatgttcaaaggagaactatcattggaaaaaggaaagaaaaagaatagcaaatgaaagttttatagcaaatgaaagcagccatcctcactgagaatctacctcttttccggagctatgttttatgatgagaatttgtcactaatcctccagaccatggtgagatttaggaatcactgttctgagtttgcacatgaggaaactgaggataggagtggaccaggtgccctggtcacacagctagaaaatggccaagccccctcctctgctgccacctagagaggttgtccactgccttccttctcactctactgtttgagctccatgaaaccatctctttcctcttcaccttgacccttttcctccagagaacacacctcactctaagtagtcaagcatccataggccatgcctctgtgttacttcatcatccatccccatcacccctcaccagctctgcagaggaattcaaatgtgtgtgtttcgccatgagcagctactgcttttcttttctctttaggtgccctctctcattttgcaagaaacaaaacaatttaacaaagcaattgttaattactttgggaccctgcactcatccatcctctggtcctctggcagatttggagactcagttgtaataagagtgagatggccaggctctgcttcttcttttttttttttttgtccaacatcatggtgccgctcacaggtgttatcaacaagaaggtagatgtgatgcctgtggcagattggagtctttaaatcctttagatgtcatcaagtggactgctcatctggctaggagtcacagaattcaatgcaccatcctctgcttgatggactcatagagggtccctgcctttctatcaggcagctttctgcttcatttttctttttatcacactgtaatatcgggctgactctgaaagtggtctataattctgttagcgatccttctgtgtttctatacaaaacattcatgtccagaagcccctgaattgagatattgtggctgatcagaatagaagaagccctagggccctgaacatggagcaaataatctgctcccaagcttggtcctgaatcaaatcctttgacttgaactaacctgcgatgcaagcttatttgactgttgtcatcagaagggtttcttcggcaggtgtgaggaacagcatggaatatcattctaccctaccaattggagcaaattgttatcacatgactcagttattaaatataaaagaaagaggggagagaagataaaattggttacaaggttgagagttgttatttcatgcagtgactctctttggactcttgctaagtaaaatatgagtaacaagtacaatatttttgttttcaataacctccagttctctgaaggctgagctggctttctggtgccatcttgaaggaggatggaatgtagctgaaatctatgccagagagtaaatgaagtggaaaacctgtgccttcagtcctggtgcaccttgaaacaaaaatggagagagagtgtggtgatcacagagcaggatcctcatttcccccacttattttgggatggagctacataaacattggaatggcataaagatgctgtggaaaattagcacctgtgtctctcatctctgctggggagatgatgaggctctcagagaaagccaagtcttgcaaaggctcatgatctctcatggtttgagaggagtggggagatgttatctgagggcttgatggtctgggggttgggaattgtagctcacctgagccattctgtgacatgtagtggattgggaactttatgtatatgtgaatgtggagacacaggagtgatgactaggaggtcaatacgggagggaaagttgctatatgcaaacttggaaactagtgaaacatgactggggctgtgagcttcagggtaggatgctggcacattcccccagcaggatagattggaaagatctaacccagtccaggaaccaaactctacaggttcctctatggcacagaagagtgaggattcatggcacccacaaggttttaagactcccttcttcccagcaccctaaggtcatggtagattgcctatatacatagatagtatcatggggagaagtatagggcaataacaaaattagcaactgggtattgacccaggagtcaagtcattcaagagactaaacagaagaaattgtcacactctgaattggtgggttgaaagtttgtgattatcccacactctcattgaggtgagaaagattagccaggtgtggtggctactcaggaggctgaggcaggagaatcacttgagcccaggaggtcaaggcttcagcgagccatgatcatgccactgcactccagcctgggcaagagagcaagaccccagcactaaaaaaaaaaaaaaaaaaaagattagatctacttttaaacgcataaaaagcacatgttttctttgtgcatctgagtgtagaatgagagcattttcaactgaagactactaaaacagaaggcaggaaggcaggttcctcatctcactttctgacattttatgcaaaatataaacccactaattgttttttcaataaagctttcaaaataacattgacatttggatcattttcagtgagaggttgaagagaatttaagttttattcatacactgcagtcccaggggaagaagggtgaccctcaagataaccacaggaatcatttttttctaggctgagaagagagtggtgaggcttcctgagctatttgtactagtttacccttaggtctttcagctagctctggacaatgaggttcccgcacggtctgatagaaacaccaccatgctaagtatcagagaacaaacttaagagttgcattattaaaaacatattttttctggagagttttaccaaaatgaaatgtcttgcttctattggtcttaggagagatctgactcatgtaaaaacatagggttacagaactttggaaatacagccatttatctatgcatatcatgcttgcacacagatttctttcctaggatgccattttaaaaatgcacattttgggtaaaaaaataagctgtcacatatatagacttctcctagtattcggcttaaacatgtgatgatttgggagggtcgttcatgtccctagtggtttaattgctaagagaatctttcccgtcctccacattaacagttagaaacaaaagccctttgtttcaccagatatgtgcttgggaaatggtccattttaaccacatcccatctgtagggccatgtgcaattttaagctttaataattttagatgaacacaggactgatgcaaatgccttattaatgttcactcatcagaactcaattctttgaaggaactcagggtcgagtttggaaactcaatttactaaattgcttagcaacacccagaaggcattttcaccaagttagaaacttataaacctgaaacttggaaatttcagaagaatgagtaaggcattcactcttaatagaacttgcttccacgggtcacccatctaccaaataaataccacagacaaaacaatctacctatataatatttggggagttttttgacatattgtgtccaaaaggcatgtgacaggtatttttgattgcaggagaataaagagaggctcactcacataaagttttgagtatcaaagttatatgttgtcagtccatagtgataaaaataaataattgaataaatagacaaatggagggagagagaagggcaaatcttctttgcagaagaattccaataattgatatagatactccatcctcagaaaggtgcaacatcattttccacaccttaagcgtgggctgtgcttagtaacttccagtgagtaaagtaggggaaggtgggaaaagtaacttcagagtggagaaacctgacaaacactacccgaggttgattaaggtcaacctccagagtgataagtcatgttgacagcatgtacctttaatgagatatgatgaaaatggcattttacttctatggtcttcatgcccaaaacctatagcctttgttgaatcataattaaaacatcagacaaactcaaattaacagacgttctacaaaatactcacccagtacttcttaaaactgtcaagatctgaaaaataaagagagggagaaaccgtcacagccaaggagacataaaaactaaatctaatatgaaattctgaatgtggcattagataaaaataaggaaatctggataaactatggacttttgttaataataatgtatctaccttggtttactaattttaacaaatgtgctacactaatataagatgttaataatagggggaattgaatgtgggaaacatggaaactctctgtactatttttgtaatttttttgtaaatctaaagctattggaaaattattttaaaatgtattaaaactatttggaaatttataaaaaagatttaagaagttgtatgctgtctaatatggtttggctgtgtccccacccaaatctgatcttgaattgtagctcccataattcccatgtgttgtaggggggacccggtgggagatacttgaatcatgggggcagtttcccccatacagttcttgtggtagtgaatacgtctcatgatatctgatggttttataaggggtttctccttttgcttgactctcattttctctcttgcctgcccacatgtaagacatgactttcaccttctgccatgattgtgaggcctccccagccatgtggaactgtgagtctctttttctttataaattaccctgtctcaggtatgtcttaattagcagcatgaaaatggactaatacactgccaatgtgatttttaaaataataagtgttttctgcaaacagcagctcccatctgatgtccttcatctcagaatgtcctcttgttccagagtggatctcatacatcccgcaccatctcttgtaggattgccaagagcttttgcttatttaactgtcgtattgttcactgggttggcacgcgtaattcctgtgtttgctactatatgggatactacgctagtacatctcgtataaacactacttcttcacttgacttttgttggcacttctgttttggtactctatgccttctgccttaaatgaccccttcttatgtacataaatctctctcccacctgttttataacgtccaagagagatatattaatagttacccatccttcctccttccatggtgtctagtgcaattcataactagcagcacagtgggcatggcacgtacttcaaaaatacttatgagtctgcacaattaatttgaggatcttaaaacatttccagaaaggaatggcagttctgaatccttggagatttcctatttcactttcattattccagctttttacttttagaactctttcagggagatagaaaattgtcagcttattcttaaagatattcagagaaggcagttctaccagcttcagcaggagtctgtttcagaatattaaaactaactgtatcaaaagaaacttttcttcctctttcacctagttggtgtcttaggccacttcccttccctcagcccacgcacattgttttcagctgagataaaaatatagctgagcacagtcctatgtggatttgaagatcattaagtttcttcacagctttctttttgccagaacatgatcatcttaatccattttctatgcaggtggggttttttggtgataatttgtttttggtgattaagaagttgtatgctgtttggtatggcctttttttggtcattaattttttgaattttaaaaatttatcaacatctccattgtctttgatgtctaaggtaaaaatctgagaatactactacttgattaaaaaaattaaaataatattaggaagaagaaggaggaggaggaagataaggggatggagaacgacaagaaggaggacaaggagaaagaagggaaggagaaggaggaggaggaggagagagaagagaggaagggagatggggaggagaatgaactactaaagctatgtggtaaaaaagacattacttacattaaacatttattatttgtaactgaaaatttactaagttacttaaaaaaattatgatctgcagtgatcttcttgatcttagccatgccacctaatcttccaaagccttgtttcactcatcactcaagtgaccttgcaccactcaagtgaccttgcgccaatatttgtcgagtttgaatgacaccactaaaggtctcggccctccaggagaaaggtattgtgggcaaggatggaatgctgcatgtggctttgagtatatttcttcatacaggggagtcagtcttaatatttcatggaagcgttgagtaagtagagaatagggatgaagctgtatgtcctctgagctatgccagctctaggagagatagcagcacatcaaggggtggaagtgagaaaaatacttacagattttcatcgtcagctttcaggcaacactagcggcaaaggtaaccaacaactctgcccaaagtcagttctcctaaaaccagattttctaaaatttaatccatttttaaaaagttaacctaaaatccaactcccttatgagttttttttgtctctgaagcaaggtggtcattataaaattgaacttcaatgtattttgatcttctggtgaggaagacattgggcttaacactgcccaacctacacttggttgatattttaggcagagcgtttcaaaagctttatggtccagatattgagaaatggctatcaagagagagaatgttgcaattggcttttgagcatgaccacatatttttacaaagatgtagagctaccctgaaggcaatagatatatccactctcaatcattctgagaagagattcctcctgaaccatgaattaagactcagggtaggccaggtgcaatggctcatgcctgtaatccaagcactctgggaggccgaggcaggtggatcactcgaggtcaggagttcgagacctgcctggccaaaatggtgatttcccatctctactaaaaatacaaaaattacccaggtgtggtggcacatgcctgtaatcccagctactcaggaggctgtggcaggagaattgcttgaccttgggcagtgaaaattgaagtgagctgagattgtgccactgcactccagcctgggcaacagagtgagactctgccaaaaacaaacaaacaaaaaaagactcaaggaaacggtctgagatgaggcaaaggaaaacatttttcttcgggacaagagttcagtctgactcagactctgagaaatgcacaatgcataaaatattttcagttgttggaagatgaggaacatcttgctactggggtgcaggcaaggttattggcagggcgttgagccagcaaggggcctttggctttggataggcgaggttaacacagtcagtagttataagatgttttctattatgtaaattccttccattatttctgaaaacttcattcacttcctgctaatgatttcagcctgatctcagtggctccgtgttgaacttagaaagggtccatcccctgccagagtgacacacaagacaatctttccccctacctgggacaaggtgacaggagcaggagggtataaggaacaaaccatattttagttagcaataccctattgtttcaaatattttattatccataatattgcaaaaaacatccttacaatcaagtctttcttcacgtcattgactatctcctgaagatgcacatgacttttcatgtcaaagggtatacacagttttgaggcttttggttcttgtcccgatagaggcagcagaaacaaaatggtaaataagaaaccaattgatctgttcttgagcacacctgagccagcacctgggcgcctcttagaaatagctgtgggacaccttgagagaggttaatcttgagtaactggactgatggaaaataatctatcacaatgatatcatgaaatagaattagctttgttgttgtagtctgtagcacttttattaagatgtagtcttagtcatgccatctttttagcatttcaataatatttgtttattttgtataatattcaatgtgtgtatatatttgtgtgggtgtatgtgtgtgtgtggttgaaacacaataataaaatgaatgtgtgtgaacctactactcagttcatcaatgaggacattaccacaactaagcaatctattgagtattttgctcttgagttttatgaaaatatcatataacatgtactcttctttaattttctttttgcatttggcagtcttaagatagtctgttttgttaatgtaaggatagttcacttattttcattgctgtaaaatattccaccccacgcatatatgttttatttatcttattcctgttgataaccatttggatttttccaaattttatctactataagcaatgctgatttgacattctttttcatatcccccactgcacctgtgcaagcattaacgtgaggtatattcctcttaggagtgaaatcgtggagtcatttgtttgtgactattcaactttacaagttagagacacattgttgttcaaatagctgtgtcagtatacaccctgattgccccaatggtatgtaagagttccagtggaaacacatcttccctactattcagcattttcagtcttaagttttacccatccagtgggcatgcatgagatctttttaaaaattaccctgaacgccttttcacatattaatgagcattttatttcctgatctgtgaaaagtctgttatgtgtttgtccatttttattctaaattgcttgtctttttatttttgatttaaaggaactctttatatgtctcggacacttacctattataaattattagatttgcaaatatctgtccttcctcctccccacacacactttatgatatctctgatgaagaggagttcttaagatcaatgtggttatatttatgaatcctcttattcatggtctgtgcttattgtgtctttaaaaagtattttccctacccagggaaagatcatagtatgttttttaataaaactttcttacagtcttgtctctcactttcatgtctttcatctatcaataatgaatatttgaaaagacataagaagggaagtcttgggccctttattttttctattgattaccaattgttacaacacattaattgatgagaccattctttagttgagaatctgcaatgctgcctttgtaatatatcaagtttctatacatgaaatggtgtgtgtctggatcaatatacttgtctgttacaacggtaaattcgcccttctgtgaatcaacactttttactggccataaaatgcatttaatgtttcattaatgtgtttcactgtatagttcttgcatgttttttaaaaattttatttactactggataccatgtatctcataacagtaattttaaaatatattttgtttgtttctaataagtttaagtgcaatataatttttatattgatcttgtgataggccaacttgttaaattctcatgtttgttcagtaattgggctgtggattatttggcgttttctatgtagcaatcattttatctataattcatgacatttggggttttgttcaatacttatcctccttttcatttatgcataaatttatttctttatggcatagattatggccttcagtgcagaatagaaatagaattgtcttacacttgctatgaactgtagatttgtagcagtttattaaggaaagatgtttactgggcaacatagcaagaccccatatcagaaaaaaagcaagcaagaaagaaagaaagaaaaagaaagaaggaagaaaaaagaaggaagaaaggaaggaggaaggaacgaaggaaggaaagaaggaaggaacgaaggaaggaaagaaggaaggaaagaaggaaggaaaagattagcttgatagacagaagatacttctgaaaatatagaaaagcaatttggcaataaatctttataaaatatggtgcattttatactttattagggcatattattaatgatttaatgctgaattatgaagcagactgtttccacattatagttcctaatattgaaatcaactggctgttagcagtaggattgagatacagcacacacaacaatttatttatctaataccttggatgccattggtaaatatcagttgctagaatcacaaaatttcaaaaaatgttttttaatataaatttgctaaaatgtaatgttagcttgaagttcatacaagcaacacagctttccagggagtaacttgctccataaggtgagtgagagcccaaggtgttgctccaggtagctgtcggtggagagctgtggggtaaaataggcttgaaattgaagacagcaaccagacacagcctggggttgagcctgctggatgttatctactttaccttggggctacgttgtgtgtgtttattgtctggctttcccagctctgctacaataagctttgttagcttctgtgacacttacacaataatctctatgtgtgaagcccccaaagtgactttctgaaaagagttcacacagattgagatcggatgcagagcatccctccccagcatggcctctgctgcaccctgatgtattcacactcaccatgaagggcacaagtgccttttgatcttcaggaggagaatatgatcgccgaacaggttttcagttgtcacaccctacaatactctaattaaatggtcagcatgtgcctcatcagggtatccactcaagtaatctatttattggattattttaatatgtcagagttttgttcaactcgaaaatggccaatggttctccagaaaggcataagagctttgaatgatgcccccctttgtgtaatacatctcttcatgtaatatataattagcaataagaactctgtttatttataacagtaaattatttatttccaagaatcgagttcatgtgatttctaattcacgtcatcttgctatgaggaatggaagtctaatatttagatgggggtaaggcacccagtattctcatgcctttttgcatcctgaaagatatcaccatagtgtgcatttcagggtgaaggtgaccaccacgaccattcccttggcaaagagaaatgtccatttattttgtacaaagagaggctgaaatgtagagtccatgaactttcttctctttgtcaatgcaaggctcttgtttcataataaaataacatattcaagaaaagaattgtattgaaatgtcactctcatgtggatttcatgaggttctgaacttaaagtcttcaaaggaacagtggtactgtcaggtactcaggctttgcctttagatcacatggtttaaaagagaaaaaaaataaactgccagtgaacataggctctgacctctcttcacttttcatttttaacgcctttaaaaatgaaattatttgggtttaatacatgcataatttggaaatcccataatttggaaataacagaagtcatgtgctatagacttaatgtttgtgtctcctcaaaactggtatgctgaaatcctcacccacaaagggatggtatttggaggtggggtctttgggaggcgatgaggtcgtgagggtggagcctcatgaatgggattagtgcccttataaaagaggccgcagagagtgccctcaccccttccaacatgtaagggcacaataagaaggaattgactttgaaccagaaagcaggttctcaccagccactgaatctaccatgccttgattttccagcttccagaaccgtgagccataaatgtctgtttataagccaccccatctgtggtgttctgttatagcagccttaatgggctaagacaccatggatggaaaactaatcctattgatcatgatacaattttttttagagtaaattagggttttgaggctaatactttttcaggacctattactgattatttaatattgatgattaaattaggaagtaggctgtttccacattgtagttcataatactgaattgatcatttctgccaagcattttcctaaggaaaaacagtaaaagacagaaaacattataggtttctgtcctaagagctttaaaccagagaaagtcttattcctattaattagcacccccccacgcacacatttttttgactatgatcccaagtttccgggctatttgaatgtatacaattttctattaaacaaaggtctaatttaacttctcactaggcacagagtttttcctcattcttataggttaataagaagtggtgatagaaactaacatgagaaattattatcagatgtgagacaaacagacagaatgatagagagagagagagagagagtgattctgtttttccttttcttctttttctattttttttttttttttggccaggaactcagagctcagtccttagcttaaaattttaaaatataaatattcttcccccttatttttacttcttacttaattcctagtggtatgggatttcctttattcgaatcatttgatagcgagcattttcaaatatttgtattataaaatattaaagaatacaatgatatcactttacctgatatatcttacttaaaaaaaaaaaaaagcgactgaatctaaccttcaaacactcaagaattccggaccaaacatcagcaatccttttctgtaaagggccagagagtaaacatattttggctttgcaggccatatcgtctctgctttgcctactcagccctgctactgaagcatgagaacagctgtaaacaacactgaaaccaatggatatggatgtgatccaatgaagcttgatgcatagacattaaaatttagaattttatatataaaaaagagcagtggtgagggagatgcaacttctgaccctcgttgtagaccacaaccagtgtctaagttgaacaggtgccctcagaaaactgcatccagccactctagtgttggagggctctggacaattagaagaactgtgtatcctgtgtatgtcctgtgtatttacctcctgtgttgttctgtgtatttagactgtaagaatacctttgtctgtgcttggggttgggagcataggggttatatgtactgagactcaggtttgggaaataaatctcatatggaataacacagataagctcattatatcaagttgggaatccctaaacttgtattcaagaatgctgaagggacagctcaatgattcattaaggtgatgatttttctcataaaaccaaaagattgtttaggtttacttaatgagatactcattctgccttatttattttttaacatatgttttatcaaaaatacattgtttttatgtattttttgagaaatgttttttaacagtctttggccagaagttgttgaattccaccagacccaaaatgctaaagctctccaattcatgtttactctgccaccctcagacatctgctttcttctcctagcccaagaaactcttcccaagtgtcaccagcaactgcctgatgactaaattcaatgatctcgcctcaattctcaacatgtataatggaataacagcgacaggtccatgtttggaatggagagaggagactataattattatcattttacatcttgattggaagggttggtataatgtttttcaaataattgcctctgatcatcaaatacattgtttaaagattacacataagccttttttctctacttcacaatcatgtatcgattattcactgtgtatgctacacattgtggctgggccctgcagaaacaaatatgtcttctgttctctcacacataagtaattaacattgaatatactcttttcatttatttgagctgcattaaaatgcatttgataagctactatatccagttttattattataccaagagttttaaaatcattaaccattcatgtctgccgtgttcagaagccacggtgaacactttgatttaaatgtcagagttttgaaaatctccaaattatatgttcaacattgctttagcaaaatgcattttagagttataaattaacatacgtatcaaattgtcaaatacgttaactgcacacactttcaattaactcaccacttaaagtgtggatatgatatgaaataaatgaaagttgataattttaggattcattttgcaatgtgattataactctggcatttagacccaggtaatagataattaaataccaaaacatgactaccacatacatttaatcttgcaaattaactcacagaagatagcttcaaacgatgattgcatcatctgtaaatgactgtaatccaatttcataaatattgatgatgtttcaaaatttgaaatcattactagtgttgaattttactacattcatttgcatttccaaaattaaaattcttctctggaatttgggaaagttccattattaaagtgccccaaaataggtcacatgcaataatctaggtgataagaaaaaacaggcttatgcacagaatattcttacatgcattcaacttgatttgtctctcaagtttgcctgaaaaatctgtcttttgacagcctgcagacatagcctgagacaattatttgctgcaagcacacattcagcaatccaaacaaacttttggttatattaaaatagcaatcctcttatcacaaacatcagaactgctccctcgaaaaagtttgtacagagagataatggggccacaaattctgggagcataaagaggatggactttaatcaacctggcacctaactcaaagctaatatgatgctgttttcataggctgtaaagctatttgaagaaggtaactttcctctcacttaactttaaaagcacatgatttttgtgctgtaaagggtttcatttggttggtgtgtgttgtaagaagtttacgtttttattcgttgcacatgggatgcgacatctgatggagactgcaatccttttacggctttattgcaaagctggagaactatcagtcaagcgttgcctaaagctttttggctctagagttaagaaagtgtcattggataatgtctttagttctgtcgatattagacaattaccatgtattgacatttttctagggagagtcaagggagaggggtagtgaactgaatacattttattttgcaaatttaatgaaaagacttagggatccttactgctgttctttggtagaactctcatatgcatccatttatgtatgtagatatgtcatgaatttatatagccctaaaagaaaagaatatcagacttagatcacttccatttgagctttaaagctatgatagattttgtacaaacttgagcaaagactaagcattcccatctaagttggaagaatccagctgtgtggatgtacacgcatcagttgctgccaatttgaggacctgctcccacccaatcattttacccagacttgcaccagaaagaacaatgagtgactgcaaggaattttatccaacgaaagatgtaacatatgaaactcaagctggtttgcagcaaacatttcatactaggagaaataatgtagtacttgacactctgggtccaattgtgcccagatttggaaggatatgacctgattgtgtaagctcccctaataatgttggaggtgggaggatcacctgagcccaggaggtggaggctgcagtgagctatgatcacaccactgcactccagcctcggtgacagactgagaccttgtctaaaaaaaaaaaaagagtgtagcagttattagtattgcctatttcataatgtcataattctttgtgggcattttcttttttattttattttattattatactttaagttttagggtacatgtgcacaatgtgcaggttagttacctatgtatacatgtgccatgctggtgtgctgcacccattaactcgtcatttagcattaggtatatctcctaatgctatccctcaccccttcccccaccccacaacagtccccagagtgtgatgttccccttcctgtgtccatgtgttctcattgttcaattcccatctatgagtgagaatatgcggtgtttggttttttgttcttgtgatagtttactgagaatgatgatttccaatttcatccatgtccctacaaaggacatgaactcatcattttttatggctgcgtagtattccatggtgtatatgtgccacattttattaatccagtctatcattgttggacatttgggttggttccaagtctttgctattgtgaatagtgccgcaataagcatacgtgtgcatgtgtctttatagcagcatgatttataatcctttgggtatatacccagtgatgggatggctgggtcaaatggtatttctagttctagatccctgaggaatcgccacactgacttccacaatggttgaactagtttacagtcccaccaacagtgtaaaagtgttcctatttctttgcatcctctccagcacctgttgtttcctgactttgtaatgattgccattctaactgttgtgagatggtatctcattgtggttttgatttgcatttctctgatggccagtgatggtgagcattttttcatgtgttttttggcagcataaatgtcttcttttgagaagtgtctgttaaatggtgctgggaaaaatggctagccatctgcagaaagctgaaactggatcccttcctttcaccttatacaaaacttaattcaagatggattaaagacttaaacgttagacctaaaaccataaaaaccctagaagaaaacctaggcattaccattcaggacataggcatgggcaaggacttcatgtctaaaacacctaaaagcaatggcaacaaaagccaaaattgacaaattggatctaattaaactaaagagcttctgcacagcaaaagaaactaccattagagtgaacaggcaacctacaaaatgggagaaaattttcacaacctactcatctgacaaagggctaatatccagaatctacaatgaactcaaacaaatttacaagaaaaaaacaaacaaccccatcaaaaagtgggcgaaggacatgaacagacacttctccttgtgggcattttctgactccaggaggcacagattggcaacaccaggcagtgagtttgccagtgaacctcaaccagtgactgctggagttggcataacatatcccagctccgtagtccctcagcttggtcaactttgaggcatgttccagtctcttgggacactggacccttgtcctctgcaagggtgcccgcttttgaacataccatttactgatttacaggcttttctcccttccctgtgtcatctctccaagttctccttgggaagaatcacctctcacataaatgatgtgcattctaagccttgcctcagagtcaggggtaagggcttcattcagggaagttaaaacaaacacattgtgccctcgatggaaaattaagaccttctggattcagtgaaccacgtgaagacatccagcaagtgctaaaactgccacctagcaactttcaaattaacacctggctaagaaatgcatttgattaattgagaccccgtgtactgtccacttaactacacaattctattaaatgaagtagaatgatgatatcactttgatcctgcattttgtatgaggaagtattgattcaagcctctgcattgttgcctaaaacacacatacaaatacatattatctatatatagatatacatagctactttgctccatggagcagcacctgtgttatctaacttcaggtgtcacatatttgttgagaaaatagtgggctgaaaacttaatctgggctgcagtattaattgttctgattctatgaaccaagcaaaggtgatccatgttctgagtttcaaagaaacttctttggaccacagctcctaaaagtagactgtgcttaggtacttcaccaagaaaactcacaaaacccactgggattctgctttcctatgtgcatctagctgtttccagacttggggaagatgttcacagcatctcttagcctccatgagtcagctagctggaccagtgcaaggataccactcattcttctaaccctgtactgtgagtgctacacagccaaagttcaggatctcccataggtcttcagctgaagttcttggtaagatgagatttacaaatagggaacacgtgaacatcagcaattatggcaccaaaaacaatggcttggaaattgaaagaataagaaaaaaatctgcctcccagactcaatttcctgcagagtccagcaggagatattcaatatatggcatgaccctgaacgtagattgggaaaagccattttgtgagtacagacatttagagaacatagtccatgccacagtgaagacttgtcaggaaacatgacacactcaaattgggccagtgtaccacaaagccaggctacatgtctggatttttaacatcaaactgaacttccgttatttatctattacttattgttttaaattgacaaataaaaattgaatatatttgtggtatccattatgatgtttcagtatatgtatagacattgtggaatggctaaatcaaggtaattaacacatccattacctcacatacacatcactttttaaaataatgagaacacttaaaatctactcttttaacagttttcaagcagacagtacattgttattaactagtcaacctgactacaatagatctcttgaacttattcctgttgtctaactgaaattttttattatttgaccagcatctcttcaacacctcctcatccccaggccctggtaactaccattctactctttgctttaacgagttcaacttttagattccacatatagatgagaacatgcagtatttgtcctctgtgtctggtttattccactcaacgaatatcctctaggattatacatattgctgcaagtgacagaatttccttcttttttaagattaaatagtattgcattgtgagtatatgccacattttaaaaagtctattcatccactgatagacacttgtgttttcacgtctaggctatggtgaataatgttgcaatgaacatgggagtgcagctatcttttaccccatttttctagcaacaattatagtagcaacaacaaaacttaaaacataatgaacatttgcttttgtactctatttaattggggagcattatttaaaaggcattgccatctaggaaatcacgaatctgatttcccttcctttggatatatatccagaagtgggattgctgatttaatttcagattagtatttctatttttaatatttttgagaaacctccatactgttttccataatggctgtgctaatttacattcccaccagcggcatgcaagggtttccttttcttcacatcctcaccaacaccagttattttaattgtgtgtttgtttgtagttgtgacttgcaaagccccttacacgcaggtggcagtcaatgaataatagatggttcccctgagtgagagaatggagtgtgtttgtgtgtgtgtgtgttgtattccatatggtacctttttactaatccccaattactccattgtacatacactttgttttacttggttctaatgatataacacaaaagaacttatcccattttcctagcaacaataatagcagcaacaacaggacacaaaaaataatgaacatgtactattgtactgtgcttaattggggagcattattttaaaacattgccatgtagagatctctatgtaaagaacacaatttggaaactgatgaatttattctgacaacaccaatgctgccttatcaccatgtttcactctattttaatttatactagtccaataaccaataaaagatggtattccatagagtgtcccctttgaaaatgaatttttactaaataaactaaaattaacaactgatgaccataaaggtttatgagtgatagggatttaaaaatggatacctattgctttcatgaaaacagtttgataatgataaactgaaaaatttgaatacttaagcacaagcattttatgttctgtcattactaatacatggccagtacatgataatacttcattcagttttactttttctttagtttccattaagaacttctcatatttcctgttctctaaagcttgcatgagtgctttaatttctacagctgattggtagaaatacaaatgcctttctagtaaatgttaatgagcactctgatgacaatgttgctgttggtatttgaaactggcagaatcaatattcagggccctctggtaaagaggcaagcatatcggacttgaaattcctccaagtgatttcaacaacccaggacattccattaagagggctttcttatctaggggcagtcccatgacatagactccaagacataaagtgataaactttagtgaagttcattatctttcaactctattaaaaagtagctgacttaaagctaatcttatcaattatttatcattctttgcacactgtgagattgcctaattcccaagctctcaaatatgattgtaaaaattgtttgttttccatccaaatgccttcttataacaatcaattttatataaaaagaaatggtgacttaagtgatttttaaaatgaagtattgaatctcttttcccaccatttatgaccaagaatcctcagttaatgcttaataacttttattgtcaagacatcctttttaatttctaacctaaccttcccttgttgacatttaaatccatttattcttgctctaggaagattaagaaaagttggccagagttctcttcataataacccttcacttacttgatgacaattactgaatcacccttcatggtaaatgtctccaaccttctttgtgttccctcatttcctctcttactattgctcatatatgttattttagatgcagtaatagtataaaaacggggtcgattgagtgcaaatatctctctcttatcaccctctttacattaagaagttctcacatttccaattctctaagcttacgtgaatgctttaatttctacagctgattggaagaaatacaaatgcctttcttgtaaatgttaatgagcactctgatgaccatgttgctgttggtatctgaaactggcagaaacaatattcagggtcactgggtttagtctcctcctttcctcttctctggacatggcttcttagaaaggttggccccagtggctacactcgaattgtatgagcacttggtctcttggctatagctgatagactcaaggctgcacaggtcattcaggtcggaccactgtcacatgtgttcaggaaattgacatttgggattgagattccaaggctgggatttttggaagctgagttgtgtttgtggctactttttaggaggtgcccaatctcttcaggtgaggtctctggagttgtccttgttcctgagactcctggttgctgatttttggttttcttttccttcaaatttttcagtttctagtgagaaatctaataatccttccaataagttcctacttggggcttcagagagcaaaaactgatgtctacttcttgaagccaaaagtattctaactcatgttttgatgacccacctgtcaaaaaagaaaaataaaagtgcttcctggggttcccatggagtgattacatgaccacacaaacacctcacattacgtgaccctgttattctgagttaaaaggtgggactatccacatcccttcatgttatacagacatcagaggtggtacagataacagtttagtgaagtaacttgtttgtacattggtctcccatttcttgtgaggtttctgagggaatggagaggggtttatgagcttttgatttgtggtatccttcactggggcgaggctatggtagatttccaacacatttattaaatgaaacttttaacaagtcaaattagccccttgctagatccatgtattagtccattctcacgctgctataaggacatacctgagactgggtaatttataaaggaaagacgtttaattgactcacagttcagcatggctggggaggcctcaggaaacttgcaatcatggcagaaggggaggcaaacatgtccttctcacatggcagtaggaatagaagtataagagctaaatgaaaggggaagcccattatgaaactgtcagatcacgtgagaacttaactcactagagttaagtcactagaatagcatgagggaaactatccccatggttcaattacctcccgtcaggtccctctcagaacatgtggggagtatgggaactacaactcaagatgagatttgggtagggacacagccaaaccatatcaatccatgtaggtgatctggtcctttacaaagaaaagagcatttcaggcactttgactgcaatgttataaccaaaagaagaaataacttagtgcatataccatgaaaaatatttagggtggaggtatgatactatattgcaaacctatcatgagaaatgaactatgatggatgcattttacgcattatcactacagtaaggaggtttgtttggggaggttgagatagaactttttaaaaagtaataacttaaaataataaaagccttcacgagatagcatttgcacacataagttgtaattaagttgtgatcagaccagtaataaataataaaaagatattggaacattcactgctttgaaggttagaaggaagtagaaatagaaagcaaaccagcttctgttcctgggggagaagaatgcaacagaagctttgggagccatggagtgcgtcttacagatgtcaaccacatggtgatgaatggaactgtgcaatgaatggagaattacaatgaggcactgctgttaggttaaggtgcatataggtatctctgtcccatataattgacaaagattttttttcagacaactgaatcttattcatacctttattcccaaaggaagattaattgaattctctttttactcaaaggggatgatgtttaggactttatcacacgtgggtcacaataagttttcactgatgaagatataattcagatgagagtgtgagcagagaatgaggggaaattgggtgtatactatcaaggggtactgatatttaaaaaatgacattgttcaacataatcctttccattcaggcaaaatgtgtttcttgtgcaaaatagggtacaggaatgaaaaatattttattttctgcatctttggagagctaaggatggaatagaaagaaaagatgtgaaaaacagagaaattgtgtgggagaagaaaatattgatggaatgagtacaggaatgaagatgagggaaaagaagacagacgcagaatggagaccattcagatacaacaattgcagacaggcagacggacgatgctcatgtccactaagagaagatggtcatagacacagcgacctccgagaaggaaactttaagaatatgcaggcacaaattagcttaattcacatagggttagggaatatttctgtagcctggtggttaagcatttcagctgtgaggtaaaatagaccttagttcaagtcctgggtgacatcctggctgggcattgagtgacactgagcaagtttcatcggactgcctcaaatctcagtcttctcacctataaaatatatatttaaaaagcatctactcataggatgttgtgaattaagtgaaataatgaatgtgaagcccttcatttaatggctgacacagcctaactcagcagacagtatttcaagtgcttacaagtcagactgcagagagcaaaactagatgaagttttgctgaagtataaagggaacatgcttttcaaaggggagattctctcacctccaaacactgatacaccgtgcaggagacctctaggtgttggcaaattgtcacgtttttaagagatgctgcatcacaatctgactgttacgttgatttttaaatgtttacaatttatttgatttttacaaacatgttgcaggacaaatgaatacatcgggggctgtgaatatctacctgagcacagctggtgacctctgtattaaaaattatttttctcttatagtcactgctataatgcagaccactatgattactaatataactgtgattattttacttttctttttggggcaagtcactatcttggtgctttggagctaccaagactataaaaaaggaaatataatataaaccatcagagaagctttaacctagaaaataagttaatatgcacaaatatgtacaattaaatgatccacaaggtatacatattttataaatttctatgacagagggagatttctttttcgtttcaaacaaccatgattgtgttttcaaaaaagcagcccctttgtggtggtcccattttaaatggattttacattaaattaagtagtgcctctagaaagcttgacatatgctagttatttatcaatgtcattattggcatcattattttacatacaaccagacagccagcatatttgtgtacctcaggacttaaaactagcttgaaatatgttacatttcatcaaggttaacgagcttgacaccaaatatgctaatttaaaggtggcaggcatgtgaacaaaggaacaaagatactgtgtccaagaagtttgttgcaatgagggaataaaggaaaggttctaaatgttagtcaagagggccgttgttaagtgacttctagacagtagagtgctgttgttaaaaagagtaagggaataatagttactagttatatagcatttgttatgtgggtaacattcttctacttccttaggtgctttgatgtaaataatccttatacttagcctaaaaggccagtgatatttcatgcccattttacacaagaggaaactcagacctaggaaagctatcagtaattcacccaaaatctcacaggttggaagtgggggaggcagaatctgaattcaagcagtcaaaatttggggtcaatgcttctaaatgctatcataaactaatttcctagagctttttatactggtatacctgactcctctaatagtagtgagagttgcaaaatgaagaatgatatgtatgatgcaattcaacttacttaaataaggtagtaatacctaatacatacttatctgcgggttctgtgcctagaaggatacccagtaaactcttcactgaaagcactgtattccgagtctcaacttttcacttttgatgttcatttccttttgtcctgttataagaatggatttctgcaaggttcttcaattctcaagaattaccatgctctttctgagtttacttgtttatttatttaggaactcattgttttacacccaggcagcctatgttgttctccaattataacttccttaaaattcttgtaactcttgtgaaatttttcttctgtccttcccgttatttcgacttaaacaggaactgttggctgtagacatgagcctcagccttagtcctgtggactacacagtctccttcagtgaaatgcgttttccttttgccagcttgtaagaggtcatgtctggacccctattgggggcagcctgttggtaacccaggtagcagttgatggccaggaaggctactcttcctatggtctggctctcagcaaagtgaaagctgtggccaaattccccttttcatgtcttgggagacctcttccatggttccttggacataaaatggtgcaggatctattcagactcacatccactggcttgagtggcttctcaggtctccagtctataacagagagggtgcagaaaatcctaccagagaagagacttggatgcttttgccccaagttttaaggatgtattatcattcttctaaatcctaggttactgtttttgtttgtttgtttgtttgtttgcctggcagcacagacaataaatgctagattttcccactctgtcccctgaaaatctcaggccaattcaagatctaggacatacttttatacttttccaacataccgtggatgtgatattaccaaagaggaatagataggaaaggcagtgtccaagctaccttccttccataaggctacacaaaatattatccatggctacactgtcttaaaaatattccagcaaataaatgtatcctagtttgtttagtgtttctactcttgctagatgtatgataagctggtaattttcaccatatgaacatccttacccaaacgtttttattctgctttaaatagtttttagcatgcattcatataaatttggattctgagtcaaaaagcataggagtttctttcatttggatacatagttcaaaactggtttcccagagagttgtacttatttataggattgcctgcaatgttcagttcctgtagccattaatctcacccatgacagcatgagattccttgtaagcctcaattaagaaaagaattacagctggtggggccttcctctttcattttgtaaaatcccaatttttcctcataaagttcaaaggatctttttaataacaaacaaacaaacaaaaagcttaaagcaggaggtgggaaatatatgaacaattctcttaaaccaaagccttcccttttgtcttctttcttttgcctcaagatctttaaacagtttgcctcccatgggcttctccaggttttcctcttccctggagatttctagataccttaggggagagttgtttttcgagtggtacaacccatcggcaactgatttgtacagggaactggctgattctctagtacatttcagaaatgtgaaattgcttagggtcttgaggctgcattttaacttttagcagagtttcataatgaactaaacagcgatgttttgttctaggcacttttcattcacagctgagtttacagctaaaagatatttgcctaggcattgtggtgcatgcctgtagtcccagctactcaggaagctgaggtgggaggatttctagatcccaggagtttgaggctaccgtgagcttcagttgcgccaccgcatgccacctgggatgacatagtgaaaccctgtctctaaaaattttaaaaatataaaaaataaaaaagtgattaaattcaacctgaagaaatcgaagaatcttcgtccctacatttgagggctctaatcatatttaggatcaccgtgctgttgaaaaggaaaacctacccaggtgactaataagtgaaaatgtgttctctttgaaaatatttaaccacctttgtgacttaaattctattcgtagcttattttagtttccaggaaactaaatttcattaataagaaagaatttgacactaatttgggccccatgtaaattttgtttctgagattccctagtggtatgaataaacacccctccccatataaaatggagatccactgtaagactataagattcctctagcagaaacccaaccttctgtataatcactttcctttctgtgatatttcttctattacttttcatgaaatattttatgccatgcatggctcacagtgacaaagcttatagcacaaaaacaaaatagagatccagacactaacagaattgttgcaaaatggtctttgtaatttaatccactccactgtattatgatctccaggttttgctttactactccaggagatcttagaccccttttttctatgcctttaagatttctctcggtcgggagtgcaaatatttgtgaacttgccctatcacatttccacagttagcctcatcagacgcctagctgaagaaagtagatttttcatgcatagcctcagaaagtttcttaccagttctcgtcttctgagcccattctccaaactggcataaaaataatattcatgatatttttaatctgaaaccaagctgaatagacttctgacactccttccagcttcaagagagctattgttgcaccttaatttgagaggcaagcattgaagattttcagaaacacacagtcattgtatcagctgtttttttcatactctaagggaaatggaaagtaaacattctatccaaagtattatttgtattcttgcttgacagaactccaaaaagtctcaagaggcagatttaatatacaccttggttgagcgttgcagctccaatatatttttaaagataatgacaagaggccaggttctcagccccgttgcttgccaaaatggaagggaatgtctggagaggcttaaattccaagctttgggttcagctagactatcttcaccactgcagagtttctcagtcttgaactgttgggactgcagctgaataattctgtgcaggaattattattgagatccctggcttttctactcactggatacggttggtacctgaagcacctcctcccactgcgacaagccaaaatgtcttcaggagttgccagatatccccagggtggagggagtggggaacaaagatggccttggttgaaaaccatgactgtagtctgtgcctttccaggaatcacactagctacccatagggattttacagaggactcttcttcatatacttatatttaatcattttcttccttaaccctctagaactgtgctgtccaatgtggtagcatctagccatatatgaatgtttaaatcaatcaaaattaaatacaatttaaaaacccattctctagccatatgtggctaatgggtattgcatattagagaatatttccacatcccagcaaattttattggacagtactgatctaaagaaagcattcttagagggagacaaatcatccccaagggacaaagaaagggttctttcttgagaagggcaaatctccctctatttataaagcacaaatatacataatatgtgttttacttacacagtgtaaaatgtgtatacaacatgtctgtggtgttaaagttatctgtaacaggaatgagtttagaaaacagaagactaaaacccaccttacctggggcttatgaagaaacactggttatggatttattttcctcttttgagatataatttggaacttgaagtgctagatttgcaaatgcatcattgcggctttaagatcctttaatgccataatgaaacctctattcttattttcccttttacttatagctttcaaacaatgtaactgaagatacacattttcatttaacaacaactaaagaagcttgtggaattttgcaattgaaattttaagttactggaagctcctctaactagcttaatgatttctaaacaaaaggatcctattcaaaaatattagattcattttatatgataacatgtgtattagtctgttctcacactgctatgaagaaatactcaagactgtgtaatttataaaggaaagaggtttaattgactcacagttccgcatggctgggaaggcctcaggaaacttataatcatggcagagggcaaaggagaagcaggcatcttcttcacggggcgtcaggacagagtgagtgcaagcaggggaaatgccagacgcttacaaaacaatgagatcttgtgagactcactcactatcaggagaacagcatgggggaaactgcccccatgattcagttacctccacctggtcccgcccttgacatgtggggattatggggattccaatttgaggtgagatttgggtgggcagacagaggaatccatatcaacaggaatacaatgttttgatatttttaatttaattagaaaagaaagttataaataatattttgatgatgaattaattcatatatttggtttaaacaagaaagtacccaactcattgctggagtgatgggttatttgtaatggacatctgtcattattttctggctggatatctgaggtcctttttgggtttggggagattgttagtgatgagtcttaagggaaggtaaagctctgctttttgttaccaaagcaacaaggttagattctggttgtccctgacctagataatcataggcccatgacctagtattggtcatttggatattctgatccaggactttatagtgggggcagatgacacagagtgtgtcagtagcagtttgaaattttggtcagctgcataatgaccttgagtaaatcttcttgcttcttatgttagcaagtattgacacctatattttgcatccaaggatattatccgtaaaagtattttccataaggtacagctctggtaggagttccagggatgattttatgcagattttggtcaggctaccatagaaactcctagccccctctccaaattagtgcaagcgcaaatcagcctgagataattacatgaaagcataccatggtgagtagggcagaggaggtaaaaacttacaaataagaagctatttttctgccaaatggtccttaatccaaggaataatttctccaagagaaatatccaaatctgtgttagacaatcaacattactgaagctagattccaagtaatttccaaaggaattatacagtttcactttcccaccacaaatgtatctgagttccagttccttcacactctcaccatcacttgatattatcagtctttctattttagctattctgatggatgtatagtgttatgtacttccaggttttagcccttaatgctaatcatgttgagtatttcttagtatgcttatttgccatttgtggatattgtgtggcgaaatgtctgctcacatacgttgatgattttaattggatttttgcattattataagttgtaagagttcttgatgcattttgaattaagattttgttgaatttctgtctcttacagtctttttttccattttcttaatgatgtctctagaagagcagaagatttaaaatttgaaattcactctatcatcttttttatgatttgtgcttttcaagtcacacttaaaaactcattatataacttgaggtcacagctttctccttataattttagctttggggtttaggactgtctatgacacatttagagtcaatttttgcataagttgttaagttgaaacttagatttattaccttgtttataccaatgaatatgtttcaaaatttacccatatacattgttatactatgactagcagtcctcattcccttatttgattccacatatccatcttccatctgatgccatttttttgatgcttggagaaattctttttatattctttgtaaaagatttctattggccataaattttctctggttttgtttgtctaaaaaattcttatatttacattcattttagaataatttttgtgctagataaaaaattccaagttaattttttttcttttaatgtttcaaacatgctaatctactgtcttctgacttggatgatttctgacaagatatcttaagtgatgattatctttattcctctgcataaaatgtgcttttttcctctaactcactttaagatttttcactatattgctaggtttagccaatttgctaaggatttgacttgatgtaatttcattatattttgttcaatttggagtttgttgaccttatctaatcttaaatttgtaatttttatcaaacgtaggaaaccgtcaatcattatttcccaaatatttttctgtcccatttcaccattttctacttctaggattacaattgaacttttatcaggccatgtgatattgttccacatttaattactcctttctttcatggttttgtctctatgactcagcttaataatttcaattactgtgtcttctaattcacatgccttttcttctgcatcttgcaattaatcctgtgcaatgaatttttatttcagatatgttatttttcatctcaagtatttatattcagttcttaggcttccaattttttccttatttataatgatgctttcttttaaatccttgaccattttgaatataacaactgttttaaaatctttttctgctaatcccgtcactttaatttctgaatctgattctattatttttatcatggaaaatattttacattgtcttgatgtttggcctttctatacaatttttaattggttgtgaaacataatgcatgttatttattttagagtctaaatgttatcttcctttaggagtaaattctcacctgaggtaaattgaagttacttctagataggatggatgctttaaagggttgtttttaagctttgtcagggcattgctagagtaaccattagcctaggtttagtttaaccttaatactaagacgtggtcctaccgcagccgataataaggccctagttcttaattctatactctgaacaatttaaacttccacaccttattaccctgtgtacgctctggaaattgttccgcttacagatccctggagatttctgcccagactgatagagtttcatcaactatatgtatgtccttatttgtagaaaacacttaaaagaacctctatacagatttttagaggtctttcttcatgaagttttatgctttctagaactctgtcctgcaactcttgccacctcagcttccctgaactttgatctctgttttatcaactcagtgattgccttcctctgtttttaaagcctcgaatgtttgtccaggtgcaaagggcaattgtcagactcatacacataagagatcccatttctgtcttgatcgttgtacaacatctgaaagcaattgtttcatatattttgtctagtggtctgtttattgcttatccctttttttttgtctaaagcataaatcccactaatcctcacatgtttcttatataaacatatcctcagtatcagcattgatgtctctgagaatcttctcatttttcctatcttatttaaagtagccaccatgcaaattactctctaactctttgtctcattcaaattttcttataaaatttcacaaaatataaaaaacatatttcttacttattggttcaactctttattacattccttccccttaaggcactttgctttgcacatagtaggtgctctaaaaatgtgggaattataataagtacttaatgcttgatttgtggaatgggcattctaccaattaaatttgtaaacctaatcttatatattctttagtataagatcacctctttaaggctttttcttatctctgattttggcaagaggataattccatatgttttaactaaaaattacaaagtacaaaaataaagttcactggatgacatttatgcctcaggaaatatgtagaagattatattgtagtcattgtattaatcccacaggtagccaactgactttaatcaacaaatattacatgtcttttcctgtgtgcacagtgctatatagctgtttagtggaagtggatttgaacatattagacctatttcctcacaatgagcaaatgattcagaagcatggaatattataggtaaagaatccatggagattgctttttttttttggtcaaaaaatgggaatggtggttgattcgactagatggataaagatatcgtaaagataggctgatcatagtgtcttttattgtcttactagggaattttagttattttaattacagagaatttcttggtattattaagtaggaaaagagttagataagacaaatttcttttggaactgaattaagaaaaaaacaggtaagaggaaataagttaggaggctataatggtagcatgcacgacaagtaacaatggcttggttttggttggtgttggtagaatggtaattaatagaggcaaagctgaaaaaataaaatgaaaaagaaaaataaattcacttggaatcctatcagatataagggcctagagaaaagatctttaagattcctgatccaagagtttggaaatcaatgatgtcattagaggaaataggaaagtcacacccagggagcgtttggggaaaagagagtttagcaatgggcacactgagatgtcaacagcagtaagacattcaggtgtaactccccagcagacaggtggggatacatttctgattcacatgggagtttggttagggctagaatactagatctgagagtgatctgtagaggccacacagatcacttttataagttcctcccctttcataacatagtaagccaatcctcagtagcatggaagagctaaaaagcagacattcatggcataatacttataaaagtgaattaaaatgtatatgtctgaaattgcagactccctaaactaccaccttttcaggctttataatcagggtgtgatcattaagttccatctccttgcttacttgttcattggcacatagccatgtttatcttgtccggaggcacatcaacatgctgcttgcccagcatcgtatcttataacaatgattgcacattttcacttctgaccatgatccttgatgtctgttcttactcttattcagtagccacagcccaacctcataaagtagtggattatcaagaggggatagacagagtaggctgtttatcaagatttgatcccaaatataaccgaagtatatccttaaatgacttttaaaacctacctgaagtttggggccataaaacatatttatattcaatgtagttcaaaacaagaaagcctgtagaaaatgaaaagattactgtagttatttttcaaatcctaaaactttagattatcccataaattttgggttcaagaaaaagctgggaaataggttacaaaaataagtctcatacccagaattgccttttgaaatactgtgctaagaaaatattatggatgtaattgtcatttctttttcatgggcatgctgctgttttagatatattctttttttgaaatgcatgaagtctttctgaaataggtacagcacatcagaaagaaagatctatctaaaacttgaggttttaccatttgggcacaggatgatgccgggcacaggatgatgccagccacatttctttttggaaaattagactgagaggaaggggaagctcttttcctgctccttatctgggtcacagtaagctttagcaaggagcgggcaacaggctgctctttcagaattcatggtgggaagacactgggaccaacatactagaagtgttgggaataggggtggacaatagaaaaggggaacaaaggctcagacactactgatggggaattcttgaggatatgatacctaaaacttaccttagctcccatgactagtgcttaaggtattgacaacactcactttgtatgaactcctttccctttcacaaactaagatccagcaacttcctgcattgctgagactggctcttcagcaacttaagcaccatcaccataggcaatatctcctcctggtaggtcttttcatcaccgctggcacagaacagtaagtttccatacccaatgagtcttgtcaataattctctaccagcacggaagattgagagaataatttgaataaaataatttcacaactccatagctgtaactaattggactgactaaacagaatgtacagacaatagaatttactgtattttaacgtagttaatttagtcatttgatgaattgctggtggcttgtaaatacagctcatggttagacaccagaatcagaaagaaagatccaaaaaggtgtagtctctgaacatattttttaagggttggcaagcatttgttttagactaccaagacagacattaatcagagcaactcttctcaactggaggcaagtcttcctccaggggacatttggcaacatagggagacatttttggttgtcacagctgggagaaggatgctactggcatctaatgggtaaaagccagggatgtggctaaacatcccaggtgcacaggactccctgtgcattagatgcctgccaattagataattcagttgattagataatttggtgggaggaaaacaaaactagaaaatggccctttcagtaggccagtacttcccactttgtacatttgcacaagtgtagaatttaccaatgtccctttctaaaatatcatggtttttaattctagttgccaattaaagcgtaactaagatagaaaagctgagtatattcaagtattcttcatatttagtcttgattctctctacatttacctctcacctcttataattaattagttaatttcattatcagtgtgttctgtgaaccacaacttcttgaaaagccttttattctaagggaatcatattttttttttaactcgacatcttgagctaaaaaaaatcccattaatttctagtagtaagataaatgtttatggtttccatttgttgtcatcgaacatagcatagctcccaacatctgcttctcagtggaaatgttgattccttcttcatctcttcttaagaattgcataaaaactcaaatctttttatttcttgaacttccaagtgtttttcactttgtgtgatcattaacatgtcttgttttgcaccttggaatgttcaacttgttacctcttacatacctccttaagtgttatatatcgtcaccacctttcattctgtggtggagttgctgccacccatgagtcatggagcgtggagaggaggcatcacaaatggtaatcatttgcatctccagtaggaactagcacactcacaggctcatagtagaagtcttagttaagacatgcttgccggcaagtaaaagatattcctctaagcattctttggccaaacttttcctctatgatatttagggatttgaggacaggaagaacaacagaacctcatgggaggatgaagtcttgaacccgtaaggtgtcaaggatagtggagcaggtagttatgttccatgaccccctcttgactctctttaagaggcccatgaagttttacctttttttctctcttcacttttgcttcccttttctctctctgtggatgttgtctgcttctgcattctcccagtctatacatggctgtcaagatcctatatatgtcctgggacttctgaccaactaagtatctctgctgagctaatgtacctggtgctgtcctttttgagtacttggcattcattcatacatacatgcatacatacatacataaaatgagaaggaactaatgtgggctgatggcatgttaaaggagtatattgaaaagatagtgagcatctcacatcatcaccaggaaaactggagaaacaagcttggagtgtgggtggaaataatgggaacatttggaagacaggtccagcaggcatgaccatgaagaaaattataaccatggtgttcagcacaggaggctgggtgaagctgctgtacttccatccaagcaacatggatacatggcccactggcccctggaaactgagcgttgcaatcatcacttccttagctagcaggaattctctgtctttcctgattctttggatcaccattgacaatctcaatgtcctcttgggagatgtctggccacagagtcccatgccatttggcatgtcaaacatggtgatttgttttctgtaataagaggttacttgttttctgttaccatgaaaacaagaatggctggtgtgtcccaaatatgggacagggttttcaatgccaagtgataacagtgggcccatgcatacaattcgaggtaatcttatctcaaagtcattcttaattccagacttaatacaaaccttaatcccaagtgcaattttaatttccctttgtcatttcatagaatacatttgcaggttctgttgattaggatatcaacatctttgcggaccatgattctgcctacaacagtgatttatctagacagtgtggacataaaattatattttgtttaagagctctagatttggagtcagaagaataatcttgcatactgactccaatatctactagtgataaccctggacaatgattaaccttctccattaatttctttaattataaaatgagaattgcagcactaatccaatctgtttgctaatgtgaagctaggtagtttctataaaaggaatgaaaagcttccatggatattatacatgatgccattggaaccagctatatcttgctgtgaatggtgggtgtcttgttttttttagctaatgtgaataggtcactgaacttactgttcttcaatttctcatctcaaaaatgggcacaacttcacaagaaagttgtgaaaatcaaatgagacaatttaaataaagattcaaagcatcatgccagataaatacagtgaatacctaacatcagaactgaaaatacctattttcagtttatttacaccagaaattctcaacctttgcactactgatatttgaggctgtgcgtttttgggttgtgggggagctatgctatgcacagaagagtgtttcgcagcatccctgctctcttcccactagacattagctgcttccctcttcccctccccacccagttgtggaaaccaaaatatctctagatgttgtcaaatgtctcctgttgaggaccaaatcactccctctgttgagaatcacttacctaggcaaatacttatttaagtactgtctgttctttataacatttaatcggaagttatatatttagctaatatataaaatataagcatttatatacttacatcctgtcatatatttgtaataggtagcaatttcttttttctccctaccgtagggaaaaagagtaagtgtgacttctctaactttgttgttggcagcagataaatatctgatttgttcacgaccaaagagcccatgtttaacatcctgtttactttgggatattctttcttttttaacttatctacattcattttgaggcaattaccacaacatacttatcagtttaacttaatcaaatgtgtgtgtattcccattttgttagaacacaaatccaaaataacaagtgaatggagaaagcttatctttttctctaaaacctattacttctgctatcataaagatgcttcatgctgtgtctatctaaatgcaaaatgcacaggaaaactaaagcaagctcgatattttaattagagttaggcttggggagtgggatgataatgaccctagttttcacttttgacctgagagaacatgcgaattatatattctagtaggtgaaaaagggtcagcatgggaagtttctcaattaaatttcacaagattgtatagattgttgattagatttgcagcatgaaacactccagaaaatttacccaccagtgggcttaacacatggggaaatattttcagcagtgaggtagccattgcagtgatcacttggaccaagaaattgtttccacataaaccagagtccaagggattaaactgtagaggtgagaatggcactaaaccctgtggcacaaccatcaaaattaaagaaatggttagctgtctatgtggtgtccaagtattggcatcctatccaagcaaaattaactaggccaattaactgtaggacgggaagctcccagctaatgccatactctccagagtttctccagaagtttgtgtgatggctagaccatggtcagagagcaacacaaaatggaccaagctgagcagggagcttcaaggacatataatctggagtctaagaggttagatccaacgggtcggtaaatggtgtgcccagtaactgagggataggtgataattgatagagcaaatttagagccttcacaattggtaaagagtcttaacaaccatgtcgtcatccaagaaaattacatcagtcctggaaactgtgatcagaagcctcggagaggaaggctgtattcatcagggttctccagagaaacaaaaccaatagaaaatctatagctatatcgaaatctgtattgacgtctatctctatatctatacctatattgatacatatatatactgatctgtatctatacctatatctatatatccatattcacatctatacctatatttatatatctatatccatatctatacctatatctatatccatatctatatatctatatccatatctatacctatatctatatatctatatccatgtctatatatctatatccatatctatagctatatctatattcatatctaaacctatatatctatataactatatccatatttatatctagctatctactgtgggaattggctcatgaagttttggaggccaaaaagcccgactatctgctgtctgcaagctgcagacttgctccagctgaagcaagtcagctgaagtccaaaggtctgagaacaagagtcactgttgtccaactgcaagagaatatggatgtcccagctcaaacagagagtgaattctccctccctcgaccttttgttccattcagaccctcaactgattagatgatgcctgcctgcactgatgaaggtgatctttactcagtctatgaattcaaatgctaattccttctggaaataccctcaaagatacacccagagataatattttaccagttctctgagcatctcttcagcccgtcaagttgacgtgtgaaagtaaccgtcacaaagaccatgtcttcaatataaaaggactaaaccttggaaaagttaccaaagagggacacaagtcaagaggaagagtaagaaccacaaagagggaagctagtatcaggaagaaggtgaaatctagttttcagatttgaatcacaagatcagagatggaccagtgtccagtattcaggaaagtgctcaggtgatcttcaagatggcctgtcagacttgcagaatgtgaacttgggagctgctctagggtcagaatcccactgtggacaatatggactggttgtgcgttttgatcacaacctagagacttaaaagtgagtttgctaaaaatactagcctgccattggtcccatgcttaacactagcctgctaatggtcccatccaatgagaatacttcggagacaggtctagcaagcatgaccatgaaaaaaatcataaccactgtgttcagcacaggaggctagatgaggtcactgtacttccatccaagcagcatggacacatggtccacggtctcctggaaactgaacattgtgatcattacttccatagctagcaggaattctctgtcattcctgattctttggatcacgattgacaaactcaatgttcctcttgggagatgtctggccactattattgaatagttctatatttgacaaacatatttcaggagaagaaatcattacttttctacttaattttaatgtatatttgttttccaaagcatgaatagacttgggtaatattttacttgcagtaccatgtagacccgagataaaacatctctctccatataaatataaaaatagagaaagctgtatcaatgcaggactttttgtcagtgaaattattagtatcattctcatctcttgaataggaaattcagagactgtaagtaggccagagtcactgaaccacaaaatgcactctgaacgaaaataaccttgattatctttccaaaggaaagtaatgatgattagtatatgggtatgtgtcaggtatcgtctataagggtctccagaccagcctaataataataatatagaaaattagaaatgaagaggttaaaatgataatcaacagaggaggagaagagtgaaaatccattagctttgaacaaaggaagataactatatgtagtcccaaatgtatttacttggggggataaccctgcattatatccactgaagattattttgtgactcagcatctccaagcttcacaccagcagctgtggccttcgaagaggaaagaacaatggctctaaatcatcagcttttcctagtggctaaataaaagtgaagactgtgcagctaatgggacgggttgaaagaaaatatacagatgcaacatttgcaagagaaaatgagatcagattccatatctgacagacccttgacaaagtcttggtgggtaaattactggacgatgaagctagagacttgtggaagatataattcccccaaatcatcctttctcactgccatggtgccaggaattgtattcattagagtattttctttattttttgtttctttttatttttttagagacagggtcttgctctgttgcccaggctggagtgcagtggtgtgataatagctcactgcagcctggaactcctgggatcaagacatcctcctgcctcagcctaccctcacatggctgggactacagatgtgcaccaccatgccctgccaatttttaaatttttttgtagagatggggtctcactatgttgcccagtctggtcttgaactcctgggttcaagtgatccaccgacctcagcctcccaaagcactggcattacaggcacaagccaccttccccaaccactggagtattttcttaaggtcagtgtagcatttccagaaaggcaattttttttcgtaaacctatgtacatagcaccatcaagtcaacagtcttcttggtcaattgaaaaccaaccgggttttatattgacactcagaaaagtaccttgaatgcagatggctcagtgagagagggcagccaaggttagcttgcctgcttctgtgcaactgtgtaccaactatggcagaacttcccagactttgtgagctcatagtttctttagtgtctgagtaatttttttcctacttcccctaggccaaaagaaagacctaaaatttctgtttattagcccaaataagttacaagaaatttatgtgctaatattttagtagaacaattttaaaatcatgtctattaatttgaaagcaaagaagtatatttatatttcattcttgaatagccataactattgacaaatgaatgggatgtgcatgcctgttggtaccatacaatttcacaaaacttgaaattagattagactcacctgctgtattagtttgttctcatgctgctaataaagtcatacctgagactgggtaatttatgaaggaaagaggtttagttgactcacagtttcgcagagctggggaggcctcaggaaacttacaatcctcgcagaaggggaaggaaacatgcccttcttcacatggcagcagcaagaagtgcagagcaaagtaagggaaaagccccttttaaaactgtcagatctcatgagaacttactcactatcatgagaacagaatggaggtaattgtccccatgattcaattacctcccctccaccacacgtccctcccatgacacatggggattgtgggaactacaattcaagatgagatttgggtggggacacagccaaatcatatcacccatcctcattccctattacccactgatttgttaaaacagtatgtgattttttttatcccaccaagaggccaaaactcagttttgcaaagatgtggcactactgaaaaggatggagcatgatttaatgttgcatctcagaacaatctctatcatggtgtttgctgatatctgacagacatcaagtatttcagtgttttccccccaatttaaaataccttctgatgcctctttgggccatacattttctgtactattatggcaggaagacactataaatggtacaaaagccaaatgggtgtagttgtgtcccccacataattgttatttgtaaatatgcccacattttgttaaaacaggtattatgagtgatttggctcacaagtcttagtctgtacacccttgggcaaaagctttccatccagtatcgtatttgaatatctcaatggtggacagagcaattaatcttcattatttcatttaatttccataaaagcccaggtgctataatacagatatatgtgtgttctagatgaaggacccaagtcagtccttcatgtagaccctaagaaatgtaatttgctgaaggtcacatgtgattattcatgtggtgaggatggatattgtcttcaaatcaattcctgccaacctaccaagcccctgtgcttccactccaccatattgaaataagggctgtatccagttcccaataatttgatcttaaatttttgtcaagaacattagcttcctcagaataagttgaattaataatttaaggagagtgagccatttccccctatccctcccaggcactgtcaaatctacaaaaacatcctggaaatgaatgattctaggaaaacatgggatatcgaatttgcaggtttcattttcttaagaattgtgccttcattcgggaattacataatggtaaagggaacaatgcaacaagaagagctaactattctaaatatatatgcatccaatacaggagcacccagattcataaaatgagttcttagagacctacaaagagacttagactcccacgcaataatagtgggtgattttaacaccccactttcagtattagacaggtcaatgagacagaaaattaacaaggatattcaggacctgaacttagctctgcatcaagtggacctagtagatgtttacagaactatccaccccaaatcaacagaatatacatcttctcagtgccacatggcacttattctaaaatcgaccacgtaattggaagtaaaacactccttagcaaatgcaaaagatctgaagtcataacaaatagtctctcagactacagtacaatcaaattagaactcaggattaagaaactcactcaaaaccacacaatttcatggaaattgaacaacctgctcctgaatgactcctacgtaataatgaaaataatgaaattaaggcaaaaatcaagaagttatttgaaagcaatgagaacaaggagacaacataccagaatctctgggacgtagctgaagtagtattaagcagaaaatttatagcactaaatgcccacattagaaagtgggaaagatctgaaattgacaccctaacctaacaccacaattaaaagggcttgagaggcaagagcaaattaatccaaaagctagcagaagacaagaagtaattaagaaaattattttcttttcttaaagaaatgaattttcaacccagaatttcatatccagccaaactaagcttcatacatgaaggagaaataaaatcctttacagacaagcaaatgctgaggtactttgtaaccagcagttacaaagtaactgcatctttgtatgatttcacttatatgaggcacctagagtagtcaaatccatagagacagaaagtggatggccattgccagggacttgggggagagaggaatgaagagttattgtttaacagatacagagtttcagttttgcaagatgagaaaagttctggaaaaggatggtggtgatgcttgcacaataatgcgaatatccttagtgccactgaactcacttaaaaatgcttaagatggttatgttatgtgcattttactacaataaaaaaataaggtagaggatatgaagtcaaaaagcatgaaagagttttctaccaaagcagttttggatatgattggagttctcaaccaagctactccaaagaagggaaggttatttgctgatgaagttaacatatggctttttgtattagtctgttctcatgctactaataaagacataacagagactgggtaatttataaagaaaaagaggtttcgtggactcagttccatatggttggggaggcctcaaaattatgtcagaaggcaaagcaggagaaaggcacgtcttacatggtggcaggcaagagcttctgcaggagaactcccatttataaaaccaccagatattgtgagactaccccaagaacagtatgggagaaactactctcataattcaattatctccactttgccccacccttgacacatagggattattacaattcaaggtgagatttgagtggggacacagccaaaccatatcacttttaaacataatcttaattaaataatcaattacaaattcattcaaaacataaggcagtgatcccataataacactgctgaaggagacccataaagttttaattacactcaattatcatttctattgagccaacagattcaaataaaagggtatgggcgtgcaagagacacttgatctgaggaaccatgcattattttatacatattgcgcaaaataggttaaaatcaggatgatgaggtaatttgcaaactttttgaaatcaatctgtgtatgattgtctttttaaatgtctccttggatcattatactctttgagatattttcctctctgagaagagaaaggtatttccaacactgtaaatgctgtatttcactgatgaactgtcccttccaatactttgaatcttcaattgccctgaaatccatatttggtagataactgggcaacatgagttttcccattgctgtctttacatgactcccaggcatgccacgaatggcttccatgttagtaccagcatctagatgaggcaaacacagtggcacctgaaaactcagagatgccagcaatcacggagcccctagaggtgttatagctcttgctcagggagccccgaggtccaagccctgaagaaatgtggcagctcttcacccctgtagcctggcaagcaagagcatgctacagctctctttctcctgtcgtctggcaagcaggagcgtgttacagctcttttattcccattgctcgcagctcggtgagctggccaggagcatcacagctctttcattcccaccacctgcttctcagtgagtttcaggttcttgtcccgtgactgagaggaataaggtacatggacactagcgagtgaataaggcagagaagaattttatcaagtgacagaaggaaagctttcacctgtgagaggagaacctgaaagcaggttgccatctgtgaggctcagtctggggtttttatggacctagaatgggggagagtgtgctgattgatccatcggtgggcttggcaaaagcaccattcaattggtaaaaaggcattatccagaaggaaacaattgagagagagagggtaacatggggatagaagttctcgctccagtcgtggactctatccggaaccagataagctcagttttcaggtttaaaccatctttggcttgaaggtcgggtctcacctctccttgtctgcctaggaatttgtctgtctcctgtcactatcatcatcacactatccccactccatatgtacacttttacccttcagtgtgactaaacaaaaggattcaaagaaaatataaatacatttctccaaaagtctcttccttttacctatacatacaatgttatctgtagcagataaaatacaccatctgataagaacatagaatggtggcagaattgattttagatttcttctgcacaccctttgttttctcactggggaagacgaggccatagagctgaatcaactggccaagttagtcaagattctgtgaatccccacattaaattctgtgcacattgctataatggtttccattgtggatttcatgcatgcatgtcctataatataacaagttcattgagtatgtgacttacttggtttgtgccatagtagtgtcttatttaaagaagtacaatccaatcacaaaaacttactaaaaacgacttctattctttaactgtgtctctctaagaatatttaaaataattcaatttgtggtgtttcggaacacttttatttctttgtctcatcccatattctgagacctttctttcaccatgcctcccaatcatcccttctgtctcccatagcatttaaatgctattctctcttcccagctcacacatctactgaagcagaacacacatttttattgaagtcatactggaacatttttggcttagttttactcttattgggtcgctgttttcccgtctaaagcttaaaataggtttccctggctttactgatcttctcctgctttgaaattatgaattatacaaggtaaggtgagaaaagatgggctaaattaagcaaactaacagctctctaaacgattggtctaaaggatgtccagaatggaccaacacactagtgctggaagttttagatttcaggctcttttgccctgacatgattatcaatgagttgcgtgcaaggacatgagatatcaggagctttcatgtcatctgagacttagatcacaagcatctcagcagaatgaggtaggttttaaatagcttcctgacagctagaataacgacaaagtcataaggtccactaggaaaggattgaagacatatccaaaaccaaatacaagatagcctgaaaccaggaaagaaaactttgcagtgcaatgagaagtatcttttgacctctgggaccttagggactgaataccagaagccaagcaggaaatgctgtgcagggattgtcctccagttgccgggaggacagcaagccaggctggaaggggtaaagcttgaacaaacataagcagtggcaatctgagttcatctcagaaaagaagggttatgtctttgtttagaggcaaagcaaaagcacccggggcctagatgctcacaaatatcaccgaccaaagtatattttagctcaatgtcagttgaagttaggatcagaaacaaccactgctactctgtaaatttttttttctttctcgctctttggggagaatttcatgtttacccttagttgtctgataaaaactctgtttgaacatttacaatcttgtctcatatcaactcgtcaggatccaaaagatatcgacagatgggaattatgaatccactctcccaagaagaatgatgattgtatgaaagttgcaggctttgctcaggtggcttgaaaataactttgaaaaaaacagattgtgaatctttagcacagaataaggaaaaataaaaaacagctcaagtatgttattatttaataaatggaaaattaaaagtatctaaaaaaatagctgagataagatttcaggcttcattcctagaggttggtgttgaccaagttccattctgtgcaggttggaacgcatctgggagtattggaattaatcacttggacaagagcccaggcatacttgaacacatttaagagaggatgaccatagtgtgttgaagtagctgaatatgatgatatcaaagcatctgagaattttgatcttggagaaaaaagactggggaaaatatagagaagcctgtaggagatgtgattttgtatctgaagatcaaccatgtagaaaaaaagttagatggtgctatgatttggatatttgactcctccaatcctcatgttaaaatttgatccccagtgttggaggtggggcctcatgggaggtatttagaacatgggaacagatccttcatgaatagattaataccctagttgagggaagagataagtgaggtctcactctctttgtttccagaagagctggttgttaaaaaagcctggcacctcttgcctctcttgctctcttgcttcctctcccaccatgtgatgcctgcacacaccagctcccttttaccttctaccatgagtataagcagtccatggcccttgccagatgcagatgccaaaactcgaactattccagacatcagaattgtgagccaaataaacatttttctttatatattacccagcctcagatacttcatagcaacacaaaatggactaagacagatggcttgatgaggtggaaaagatcttccccactaggctttgagataacagggcagcctcttagaaggaagacggatgtgtcagtggtccccaagaccatgcccacattcaatgatttggtaagactcacaggactcagaagttgttatactactcatacttacggtttgtgatagtgaaaggacacaaacaaaatcagcacagggaaaaagatggatgggcaaagtgcaaaggtgcaagggaaagtagacacaagcttccaatgtgcaagggaaaccaggcacacttccaagtgtgtcctcccagtgggtgcacttaatacctctggcaatgagttgtaataatatatccaaagtattgtcaattgggaaagttcactcaaaccttggagtacagagtttttattggagggcagacacaaaggcacataatcaaacatgatttttgaatctctagactcttagaaggaaacaaaaagtgtttaccacaatgcacaccgcttgcatgcactatatacacaatcttgtttgtatggttcaagacactcctcccactcaaagcatgaaaagccctctaatcaatgggaacattctaagcgcttaaatcacaggaaactaaccaaggcccatcactaaagtgggactttcttgggaatgtgcagggtttgagcaacccaggcctgctgtgttaagtctttcctgtataggggacaagggtggtgagtccatggtgggggtgttgtgaaaactggctcctcttgcctgcagccacttttttttgtttgttttgttttttgtttctgtttgagatggagtctcgctctgtctcccaggctggagttcagtggcacagtctcgactcactgcaacctcagcctcccaggttcaagcgattctcctacctcagcctcccaagtagctgggattacaggtgtgcaccaccacacccagctaatttttgtatttttagtagagatggttttcgccatgttggtgaggctggtctccaactcctgacctcaggctatctgctcacctcagcctcccaaagtgctgggattaccagcttgagccactgcgcctggactgcctgtagccttcttttgtctggttctttgtgcaaaagccaggggaactggagagagattcattttgatttaaaaatccttgctctgtccttgctctatgaatttgaaataagatactttactttggtgaatctttatttttaattagagagagagaggagaaaaaaaaccacgcacgggggccagatgcctccagccaaagaaggtgaggcatagagatctcttaccactaaggaaggtatctgaatcatgtggcaccaaatatgtcactggtggaagttatccaagttactggcggcaaatccatatggatctgcagcaacctcaattcttgccttctcggaagaaagaattcaacggggggcataaggcaggaaaaagatggaggaatgtttcagagcaggagtggaaggttattaaaaagctttagaacagtaaggaaaggaaggaaagaaaagaaaggaagggaagtacacttggaagagggccaagcagctgactcgagaaaccaagtgcactacactttagtgaatcatgaaagaaataattaacattgtttataaagtgtgcctggcagatgttatgtgaatatttgttttcttttcccctgagttggggaaggtgagattcctggtaaatcatcatatttattccctcacccgttctaaaactccaatgtgtacatgaaatatctggggatcgcattaaaatacagattatgatttggttgatttggagatgggccccaaactctgtgattttaacaagctcctgggtgatgttggtgctattggttcatggaccacatgatgcccagggtgggcagcactatgtcatgggggaaaccagggagcaggtttagtacagactccttatatttctaccccctgacatcttctcttgttccattcccctcacctcaacctagtacaacttagagtgttccagggcagtagttttcaagcattgctgtttgaaactatcaagaattacctggctttccagttaaaagtgcagattctgggtccccactgcactgtggtccaattctgagatgaagcttgggaacatactttttttgttgtgtttctaaagtggaaccctctgtgatctgatttaggtagtggagaccccagaatctctatatgaaggaggttgggatcatcaatgtgatggaagggagggcaaggatgctgcttagaagctgtgtttacacagcaagcacctggtttctgatggctcagtgtatttgtctgttctcacactgctaataaagacatacctgagactgggtaatttataaagaaaaagaggctaaatggactcacagttccacatgactggggagaactcacaggcctggcagaaggcaaaggagaagaaaggcacatcttacatggtggcaggcaagagagcatgtgcaggggaactcccatttataaacccatcagaacttgtgagacttattcactaccatgagaacagtatgaggggaaccacccccatgattcaattatctccacatggccccacccttgacacctggggattattataattcaaggtgagatttgggtggggacacagccaaaccatatcactgagattgtgtatttgtttgggtgactcagagggatgtgatggagatttttgtgtggtctaaatccttttcaagccacccctcagtgcagccactggaggcaggccatctgggaaccacacttctcctcactccagggaggagcaggggaccaagggaccctagacaagctattttactcttttaagcctagtttgttttatcagttgtaagagagtaataatgcttacctggaattggattttatttcattttacttttatttatttattttttagagacagggtcttgctctgtcacccagagtggggttcagtagtgcaatcacagctcactacagcattaaactcctgggctgaagtgatcctcccatctcagcctcccaaggagctgggactacagacatgtaccaccacacctggctgcttttaatttttttttctttttttttttttttgtagagacaggggtcttgctatattgctcagtctagtctcaaattcctgggctaacacagtccttctgcctcagcctccaaacgtgctgggattgaagacttgagccatagtgtccagcaaaaatggaatgggattttataatcaaagagctcagaggagacacccaggaaattatatttgctctttttattggttctcttatacctgactggagtagggacttcacattgaaactaatgtaagtgtgtttgacatattactctgtctgttctctttctctccttcaagaatgatgccaggaggattaataggtggaagtaatcagagctctggtttcatggtcatgtcattcgttcttccagcagcttgtatagtgcagccatcaaaagtggtgaggaggctgctctggagctgtgcacacctagggtggaaaagctctgtctagatttctcattccaaggttacctgcccctccaacattaaagggagaattggcacggaatcctgagatggaaagggccttggaagttccaaccccagatcttcctttgcttgtacagagaaagagactgagatcaggaaaggtttgatgatgacgtctggcagtattaggaatacaaacttatcccctttgctctcacacaattgttttatgcactgcaccattctgcttccctacaaataggagcaaattagctcccaccaaaagagtacaccctgtggggaaatgactggaaggtcaataatacgtatttgtattgacttaaggaatagtcaagctgctaaaagggttgatgctagttttcttcccttgacgtatttattaataatttaggatatggggaaaataagatgccttctggaattgatattagttgtaaagcatcatatatcagaggaaaagcgaagtaaggccaggagaccaaaatgttagattgtgagattaaaataatgctagatcttcaaatgggcaaatgatgcacagtgtgagaataaataaatacctgtatgttgttttgctttttattgtggtttatgtttatggttggattgcagtggttatgttttaattatctaaaaaaaatgataccagttgtcctctatccaaatgaacattgtctatcaaagtggtcaacttctaaggctacgtgcttaatccaatgatgttggcactacttaaaacatttttaaatgcctaaggcattttctttaaatattcctattaatggcagatttttgtagagaatcaactatgtttggtatgatgcaaaaaaatctttaggagaaaatgtgtgtccctataaaggttgtggaaggttgggaaaatcatttggagtaaaacaaaagaggagtagattactgaaaacatgacgatgttttcgaaagcgatccatatgttctaaaggaacagtgggatgatgtgatgtgagagaagtgctcatcttccaaatctctcccagtgactctaccttagtttgaatgtgaaacagttttaaaggcagatgtgctctggactgcattcatcaaacatttagccagcactcttggtgcaatgatgcctccattgtctccactggtgaaagacgtgtgtgggcagaagctgagctattgcaaagttcagtgattgctacctgtggaaggtggtgatagaagtgtcaggctgatgtgaagacaggcatggcatggcctaagatctgcccatttaatctggtgctcccctctcttcttgatgcaaagaggaaaaggagatactttagtctcaaagtcaaatcagagtgatgcatggagacagttaaatgctgtttgcctctgtgatgccaatgagctgcaaccctggttttctattctttgctcaacaccagaagttaaggctatgggaagggatgcatcacggcagctgtacactgagaatgagcccagaggagagctttttagaagcatctgctcgtctttatttgagaaactcagccctttcgagtcgcttggatcaagtatagctttctaaggtgagaagaaacttgaaaggcagttctgatatctaatatggaattcttattattgcataggttcatttcacgtcattctagaaagttataggtgcatttcacggttcaaaagtagaaatgtcaggagaaaacatcaaaaagagaaatcccattttacactgatcggagatcacagggtgtaagatgaaggaactgagaagtagaaaaacataacctcactcacctgcccagagttgctgcttcctgctggctggggtgccttggtttgcattgtatatgacctctctccaagagtctacacttgtcttcctcagtgtatggtggcctcagagttcctttaccaggggacaagagtgaaagctgcaaggtctcttaagattgaattcccagacttcgcacagcatttactctgccacattctgtgtgtcaaagtacataacaagcctattctcagatcaagggcatggaaatagactctgtgtctttatggtggacacaggaaggtgtcattcatcaggcattattaggaaggcaatctgcaacatttctttctgaattgcctcaaagagaacatgactggcatcttgatttctgaagtccatgtcttaaatcctcacatggttccttttgtgacacagtttctatttattgaaaagctaaatctggaagaaggaaatcataaaggaagatctatagaaacatttattcttgaatatatatgtatgtatatatcacaaaaactacgggttttgatattctgcagttaaatttgttcatatggttgttcatttaatttacttatttaacatatttcaataagtaatacatgcacatggcagaaaattcaaaggtacgaaagggcatacatggattgaaaagtaagccttttttccatatcatttctctctaccactcagtttcaccataagaaaccatattgctctatttgtagaaaatttggatttatatcattttattctattcaaatcaaatactcaagattaaataagaaggagacccatagagatggggaaaggggtatatttatttgattacaacaaactatgaagtcatcaactgactgtaccactttctgctgcctcacagattaaaaacataaataacagaaggagaaagaaaaaattgtggagatgtatacaggtaagaatctaggaagccccaccacaacccatcctcctgacttgcaaaatgcccggcaaggtgacagtgtggaggatgattaattatcactctggtatccccagccatcagaaagtgccctttttaaaggacctataaaatattaataaggtccacaagtttatttagctaatgtgtgacaccaatacattgtatcaccattagtttttgtctgcgatgctacaatgtgacttataaggcaaacatgactactgttaagatttaggaaataggtatgagcttggtggcaggcaggagaaattactgagaagatgacagtattttcaattcatttcagtagcatacttggtgcagaagccaggttgtggagaattgagcagtaatagctcaaggacaagtaatagacaaccctgttaataagtttatctgtgaaggaaagaataatagctacagcaagtcattcaatcacataagtgatgttttcatgggaaagacttgaacatcagccttacctattgctacaggccaacttactcttggagtaaagcaagctttatggagagtcacatatatatgccaccccatctttagtagacaccgcaggctcccatgatctgagtcagagatgacaggggagaagctaagaattgtagctcgcatttactgaatgtttgctacacgctagaccctgtcttgtttaatttacacaaattatgccattacaacttcacagcaatccagttgggtaccattgttgtacctgtcctacaagcgaagaaactgaggtctacagaggttaaaaaatttcctgaaagccactcaactaatctgtgacaaggctaatatcagaccctgagtagcctgatgacagaagtcaccatgctatacaccacccctgactgagcctcacacaaaagaatgtcaaaacgtgcagggatatttgaacatatcaaccaatcttgttgtagccataaagtccatgaatgtagaggttgggcccaagtgttctcctttgtctctccggttccctctcacttacatatttcattgtagatacaattaaccttcttatgatcagacaaagctcttaaagattccagagattactcaatggtgcaacttactctgaacacaacacaaacttatccactccatgatgactgaaaagactaaacaagagaactctgttctcttcaatgtgagagggatgtctggagcagagagaagtcaggttggtgtgatgattaaattttacaagtcaatcatggccaaacaccaatttagatattgctgcaaaagtatgttgtagatgggattaacattccctatcacttgacatcaaggagttgaccctcaatacatggtggcctacatccaatcccttgaagaccttaagagctgaaacagatttcctagagtaaagaaattcagcctcaggaaattcaagacagtaacatagaaatcctgagtttccggcatactgcttcctctacttattttagacttgccagtcctcatcatcaggtgaaccaattccttacaagtaaatgtcatcgatggatacatatagaaagacaaaaacgtacatctgcatgtgtatttgtctatctatctatctatctatctatcatctacctgtcaatcatttctcatctatctcttgctatttatatctacttatccatgtctatctatctatctatctatctatcatctacttatctgtcaatcatttctcatctatctcttgctatttatatctacttatccatgtctatctatctatctatctatcatctatctattgatctatctataatctacctatcatttacgtgtcaattgtttgtcatctatcacttgctatttatcatctacctatccatgtctatctatctatctatctatcatctacttatcatctacctgtcaatcatttgttatctatctcttgctatttatcatctacctatccatgtctgtctatctattgatctctctataatatacctatcatctgcctatctgtcaatcatttgtcatctctctttagctatttatcatctacttagccctatctatctatctatctatctgtcatctatctttcaatcatctatatatctatctgtctacctcattatctatctatcctattggttttgtttctctggaaaactctgaccaatgcagtcagtgtgaagggacagatcaatatgactgataactcacaggtaaaacttatatttatgaaaccagctttctttcacattgactgttacttgattactcacacccagggcttctatctggatttgttcacagtgtttcctttatcttcagtcgctcttctcttttttcagtgtttttcatcttcatcaacgtagatttctttttgtctcctggtgggttttctttctccctgatatggtttggctgtgtccccacccaattcttatcttgaattgtaactcccataattcccacatgttgttggagagacccagtggggggtaattgaatcgtgggggcaggtctttcccatgctgttctggtgatagtgaataagtcttacgagatctgatggttttataaaggggagttcccctccacatgctctcttgcctgctgccatgtaagatgtgactttgctcctcattcaccttccgccatgattgtgaggccgccccagccatgtggaactgtggaactttataaattatgtagtctctagtatgtctttattagcagcatgaggacagaataatacactttcctaatgtttcattggcactttcatgttcttttaagtattttatcaggcttatccaaatttatatagttcctagaattttaacttttgattaaggaaatacatggtcagaaatataacattcttataaaaatcactacttaccagtcactttaatatatcaatcaagaagcattatttcctgtgattcaggaggtgaacacttgttttggctacaatgaattcatgtgaaaacatgtacaatccagtgaaacgaattattacgcaattaatatctgaatgcatttgtatgttttttggcttaccacctgtctctcaaccatctagccatgcatgaatactatcaggcttgtcttatttataataggaacacctaatcattgtgttattctaaatttttatttgtatttccagattatcaacccacctgctaatttagattattgtttagaaaagcagcatagctcttttattttatcaaaggtcattcagtaaatttaatatatttgatgccagaaaaagaaatctctttacacaaacataccctctacaagttacaagttaaaagcaatatttatttaaaatagcaaacaataaacttttaatcgctaccactgtcttacattattttatgcaatatgccatagctaagaaaatcttctctacttttttcctatccagttagtgaatacattttaagtattaaatggaagaattagattcttaggcgagacagaatacatataaaaagatgttaatatttaataataaaagttgaaaatatattacaaaataaagtaagaaattttattatctccaagagtatcctttttataaattatttttcttggtttcttgtgctgtttaaattttcttgatttctttgcaatgatattgctttgcagatacctgaattatgtcgtgtctacagatcccatgagtatgtagccatagcaatgaacaacacaggtaatggttctgattttatatggattcatgaaccctcgaaattagacctttcccattttaagaaaaaagaaagaaacatctctacctataagaattaggtatatatagccgggcgcggtggcgggcgcctgtagtcccagctactcgggaggctgaggcaggagaatggcgtgaacccgggaagcagagcttgcagtgagccgagattgcgccactgcagtccgcagtccggcctgggcgacagagcgagactccgtctcaaaaaaaaaaaaaaaaaaaaaaaaaaaaaaaaagaattaggtatatagaatattttacatactatgctcatatgtacaaaatgagtagttggaagtaaatgtgagaataaacagtatgcagtggatgaaacatatattctagtttgaaaactcagaagtgcacatttaaagagaaaatctataaacctgactgctttacattagtggaaaaagtagtctgaattatgttacaatttgcaggtatatacatatttattactttaagaacttgcacaatatgtaaagaagagctttgctttacatgagtaacattttactaagtgatgtctaaatcatcatgaattctcagttagctagagcagcaataatgacattttattgtaggagaggaatatcctaatgaatgtagcttaatctggtattttcagaagtggcttttcatcaggtgtagaacctggattaacagctgattttgcctacatcatatttgattctcagaaaactttccagtatgatagataaaaattataaggatctgatgtaaactcctgaggccataacttatgcccattttctaaggcaatacttaaaacaaaaatttttaacagcaataaactctgttcttgtgaccacctcattttcctcctcaaaattcacaacctatctccattactgcgtgactttttgttttgttttgttttttagcgacagggtcttcctctatcacccaggctggagtgcagtggagcgatcatagctcactgaaggctcaaactactgggctcaagtgatccccctacctcagcctcccgagtaactgaaactaccggtgcgtggcaccctgcctggctaattttttcttttttttcttttttttttcttttgtacaaacaggttctcactacgttgctcaagttgatctcaaactcattgcctcaagcgatccactcacctcagcctccatgctaggattacaggcatgagccaccacacccagccctaaatgacatttaattttggaaatctcccaccaattcaatccagcctaaattatttgtaccactctttccttttgatcatccattatttttaagtatcaacattcaactctctatgtttcctcatagttttgtatattacatcccacttcgtttatccctaggtcttctcaaacaaattaccagggaatctcctcaaacctttttgcagatgtctcctcttgctcctttccttcctgtttctatatttgtcatttagaatttgagacctgctaaagacaaaccacacatttcttccagttcctgtgtgggaaggtcaaaggtctatgtgtgtgtcttactgacatgtcctttcctgtaaacgctgtacctggtgttcccataaaatctggcttcttgaaaatggcaataatgactgcattcatgtgttgagtgtgttctctggatcagtcatttcattgggttcttggaaagtgcgttttatctaattgtcacagatacatgacaaggacagtgtttttttcatcatccccattttatagatgattgagctgaggtttctttgagttaggtactggacccacagtggaaaaattagttcttcattccagataatgtcttagaatttttccagctctgatgttcaaaatttaaattttgtcatggaaataaagtaacatgaatctccactacagaagtggcgaatagcttagcttggttgaagaaaagtttgcattctaagctgacttcacagattgtagaatccactgaccttctatagaagaagtgaagaaagtctgagaaaattccccacaatctctccttgatttcttccccatgagtttgcactgaggaccaagttccacctctaaagacaaatcttatggtgttgaaacagccttttcccaagggaaaattgagtctcattttcatgggatgctaattttgatgctctgaaaaaaaaaaaaatcctatttggtggtcaaataaatttgagagtcctggactaaataaaactgaaatgagttttattttttgttatttggggttttttgtttgttttttttaaagccatgtgttcatagagtatctggtgtattcactcctgtctctgagagggtgacatgatatacatgcattgacaaatttatcagactgtagaactccaaattttttttgatgcacccaatacctattaataaatctcaaaagtgtttatctaagggactgttatgttaagatttttttttagtatgccctgattaatgtacaaataccccaaaatgactcatagaataagccaatggcctcccctcagcccaggattcattggctgcacactagaatcacaggaggcctcataggagctttagaaaacattgttgccagaatctgttgaaatttttggaagctgcccaggttattctaatgtgcagccaaggttgagaagcactggcttaggctgagcacaaaattgggttatcggagtgctgtgcaggtgtgcttgggacttgtgggtggactctccggaggcaagaattgggaggaagaaattaatagagatgaggtaatgggtgaaggagatccagagtctgaggaagcatctatgagggaaaagttaaaaccctgcatggactttagagaacaaaaagggttttgagattggcataggaagtattgaaaaagagaaactttaaaaaaatgaagggaatacactttcttcctacatattatacttttgctgtctgcctgccagtcccagctacttggagacaggtagtgaggtggatatttaactcgaagtatacacagttagcaagcattacaatggttctatctttgtgtgacttacactgtgcctatcacatgtcggtatcaataaacattcatggaagtaaacagggagccctgatttttaaactctaaattaacacttgacgttaacacacattcattaagaatcagcagcatgctagtcatgataactgttaaaccaattccaaattatagattttactcctatgaaattgcatatctctagcagtgtgtgcaagccacaaataatatgctttctctctgcctgggcactgttatattcattaaaatgcattcgatttctctttaatttgtaaactgaagcaagcattcaataagattctctgcaacctatttattcacctgcctttgcagttgctgtgcaatgtcattcctctacaagaaatggatatttcttttccaatctttaataattaagcaagtgtgattttcccctcttttagttgccttagcaccctctaattgggagggtctattttgtattctattatttcacttccatcccctatttcctcatgaaataaaaatcatgtgttcaagtaccttgcaaaaagtacatggtaagctttcttttaaaaccatgtctactttcagagaagaagctttggactataaatatatttgagtgagggtgaaaatgcaaaaccgatttggtttttgcttccatgcttcagatctacaggtcattaattatttattttcatcctgaaagcattttttttctatctatacaatgcccaagcctctcaaggaattttaagcaataaaggtaaaaaggttttctgtttttgataaataatattgagtttaaaataactggttgaagaaaggcattgggaatgcttccgtgatgtactgtgagcatggatctgctggtcatgcattatttagtatattctatatggggaaatacactttgcatttgggttttgaaagaggagttttgaaaatggtgttttgcatctgaattctgctttttcactagactgcatttgcaacgatgcatgtctgcaagaccccatggacaactttcatctgatgcacgcactcattcttgctttgacactccaagccaagtcacatttgtttccaccaagtcagacaacttcgatggctctctgcatctcactatatctctgtcctgctgatgccaccaaatgaccagagatggtccagacaatttacaagaaaggacgtgggcaagcctcatgcaaagtaagaaatagctagcttgtctttggtatttagcaatgtttaaattgatttgctctttcctcacttcactcctggctagctcctcgggatttagagtgctgatgcccaagtattgaattgtaattgttccggatctgagctgccatccctgagctccctacctccagtgtacattttttttttccagaattacatctccctccttttcctcttttattttttgcattgtaatgcttctatcaggcaaacccgtaacaaattaagatgcctgaaacagttaacgtaaaaaaagattgtttatttttcaaattgaaataaaagcatgtagcataaacattgatttaatttttagtgtaatttcaggctgttttctttacaacttgaatatgtcttcctcttccaaggtttggtttcaaggccatctccctcataccacctgctgccatgcaccccgtcctcatgccccactctttcggaaaggattctttcttatttagaggtatcacaactttttttcttagcttctattatgcattttattctgccttggagagtgagttgctgacatgcccttattgatataagctacatgatggcagcagtgaggtgtcacattaccttatcattttcagtagaaacaatgattcttccatggccaggttttaaaacctcttgccatagaagtcattgtttttactgaaacattctgttttaaaaccagctggatgtagtggctcacgcctataatcccaacatttttggaggcggaggcgggaggatcgcttgagtccaggagtttgacgccaccctgggcaacatagggtgacccaattgctacaaaaaaaaaaaaaaaaaaaaaaaaaattaacaattagccaggcttggtggcgcatgtctgtggtcccagctacttgagaggctgatgtgagaggattgcttgagaccaggagatagaggctacagtgggctgtgatcgtgccactctgcactctggcctgggtgacagagcaagaccctgtctcaatcaatcaatacagtttcctctctccccaaccacagtgctaacgtttgctccctctaccccaaggtgaaaggctggaaggctggtttaagattttcatccccagatacatagatctgaatttaaaaatacattggtgttttgaattatttgtgtggacattgacttttttaaaatgcggtttttaaatttgcagtttaataaaactgttaagttttatccatctggtggaatataatacttaaagcagaaaaaaatgtgtgctcataacttatgtttatctaaaatttgtatttgaggccactatgtaaaataaatagactgaaaaataagagcgtctctgcaaaaacaagtatttgtggtcttttcagcagcttgaatagttagatttctcttagtaagttgaatgatttaccctgttttctttttttggctaaataaatcatatttgtctatttttaacttcttttaagtttatgcagaaactctaaagttgcggaggaaaagcactgtattaacaaggcctattttcccagaatgaagggaaacttttgcttgtacaaggttaatttgcaaagcacaatttataacactatagagacgtctctcttgaaaccaagggccctatcatttctttttcatttgacatctgcagagtaagagtaaatatttcttaatttagaggaaggtaaggctatttttcaagtgaatccactaaattaatccactggagtaggcgttatttccttcatcacccgtctgccttaaatatagtacctgcacattcaaggcaaatgcaaaaatagcttcagatttaaataggtgatattgtctcacatataaaagatgagtcttgtctgtgatataaaagtagctgtttaatacttttagcaattttcagtggctttattttttcatatagttcctgtatttggaatgtaattaatggaaaggtttagctttgtccttgaaaaggtttccatttttctagcaggcttgagtcactcactaataataaacatgctgtatttttagctacatatccatctattttccatctaattcatttatttatttacagcttgtcctgtccctaagcttctaatgtggtagcacattagaaaatgttatccttattgcgtattcatctcaatttgaagatatcagaactccgtcaagacaaggctgggtacggtggctcatgcttattatcctagcacattgggaggccaaggcaggtggatcacttgaggtcaggagtttgggaccagcctggccaacatggcgaaaccccatctctattaaaaatacaaaaattagcctggtgtggtggcacatgcctgtaatcccagctacttgggaggctgaggctcgagaatcacttgaacccgggaggcagaggttgcggtgagccgagatagcaccactgcactccagcctaagtgacagagtgagattctgactcaaaataaataaataaataaataaataaatagtcaagaaatggttcaggttagaaatctgattctggtaatgtatttaagaaaatatccagtatccaaaatatttcaactgcatttacatattattattatatataccaacatgtccacacacaacatacatttacactggtctccagcttaaattgactcactcaggtacactcccctggcctgtttaatagagggggtcatgtctcttgttgtaccttattgtagacaaaattataagctcatacttgaggtctcttctttgtttctaacatataggaccgagagttgaaacataatacataaaaatggaacagtgatagtcagatttccaaatgaggaaattgtcttcttaggaatagaaaccagatgggaactcaacacagtagtggccaggaactgctggactctaggcccaagagccaggagacacccggagtgtaattcctgggaaattatgaaaggtgccccaggagtctgggagacagagccctttctttccagaaataagagagtttgaagacagctactgaccattactcagagctggcatttctatgaaattgatatcctagggaggagaaagggagctgacaaaacgtcaccaccaagaaccaactgagcaggctacagattcagtgaatggactcatgactatgccactcacgtctctgggtgggagctccaaccactgaggataagaccatagagaagggtaaggggataaggaaatagacacatgaagacagatgtgtgtgcaaagaagaaagagagacagagacagagtgagagagacgcatcttactcacctgaagatccaaatcccaaaacacatgcaaaaagaatcaagaagtggaaaatgcagtcttccaaattaaccacaagtttagattttaaaatagacattaagtgaaattctttagaatggggcaagcattctctagaggagcagttgccttcagcacaggacctataatgcctccagggaacggtacctctaatgcctctggagaccacaagggagaaacaaaggaaggcacatgcaagaaaaaacagcaatcatgaaaagagcaaaaaaatcatgaaacagagacaggcaggcaccagataaaagcaagtgggtatagaaattgcaaaatcacaactacagaaacaaaaaagatacagtaaataatatggtttggctgtgtgtccgcacccaaatctcaccttgaattgtaataatcccaacgtgttgtgggaggaacctggtgggaggtaattgaatcatgcgggatgggtttttcccatgctgttctcatggtagtgaataagtctcatgagatctgatggctttgtaaatggcagttcccctgcgcacactctcttgcctgccaccatgtaagacatccctttgctcttcatcttctgccatgattgtgaggccttcccagccatgtggaactgtgagtccattaaacctctttcttttataaattactcagtctcggctatgtctttattagcagcatgagaacagactaatatagtaatggaaataaaatataatactgtaaagtgtagactctacaatcaaagaggacactgaaacatagtacagaggatgcacaaagaaataaaaaataatatgaatacgtaaagagctgttaggagatatgtttatggacatgggttagtaaaaggagatgagagtaaaccacggcaacaatgattgggtagataaaggatggaaatattcctaaattaaagaaacatatgagctctcacattgaaatacatcacttgagtaccaaataaaatgatcagtaaatccacaggttgatgtaaaactaaagaatattgagaatgaagataaagttaagtaccttcccaagatattaataaaaagcagattgcatagaaaaactgttagtctgttaggagattcacataaacctcaggagaagtgaaagcgtcttggagaagtagcctaagtattgaaaaataatcgtcaattgaaaatccaatatccaggtagcctcagatcaagatgaagctatggaaaccactttcagatatacaaagactaggaatttaccacccatatatccttaatgaacaaattaacaaggacagttcttcagcaagaataaaggggaaacaggacagttcttcagaggaataaagggaaacaattgggcagaaaataatggggatttcagatactgttaaacattgataaatttcgtgagccatccactaagaccaaatgataaagattgcaattattatttcaggtaaacccaattctagaaggaggatggttatgggatgtggttttcaaatatcataaacatgctaaattttaaataactaaaacttatactttattgaaaacgtaagtgtattgaaattgtaaacatacaatattctgaatttatagttccctctgcctaaaatgcttttaacagcagatttgtatgtcaactctgtagtccatagctgtgaaaatttggcaaaagcacccagattctgttgtgtctgtaaaaactgacttcctctaacgtctagggctgtgctacttaaagtaaatgtggatataaatcccccaggaatccagttaaaagcaaaagcacccagattctgttgtgtctgtaaaaactgacttcctctaacgtctagagctgtgctagttaaactaaatgtgggtataaatcccccaggaagccagttaaatgcagattctggttcagtagggctgtagcagggcctgagagtatgcatttctaacaagcccccaggtggtgcaggtctaaagggtgcatattgactggggagatgcatgaataacaccacttctctccagctatttctaaaataaggaaactttccttcagcatttaccttaagtgtttagacaatgcattaagtacaacaaaaactatcatgaggaaccagatgtcacctacgacctataccacacttttccattttcatctctaataaggcggccttataacctcctctaggtcaaaagcaggagatggcaatctttttttctgcaaaggacaagatagtaaatattttcagctttgaggccagatggtctctatcaccactattccactctgccttcattacattgtagcaggaaggcagctatagacattatgtaaatagagggatgtgtgtggctttgttccaataaaacttcttctgcaaaaacaggtggcagagaagatgtatttcatgggccctagcttgcagacccctggacgataggttaacccaagtcactagtcccactagtccttctgagtaattttgagcagaaaaatcctcaaatattccttgatacttgacattttctatgcatctcagtaattaatcaagtgctatttaacattattctgttgttttgttttgttttgttttgttttgagatggagtctcgctctgtcacccaggctggagtgcagtggtgctatctcggctcactgcaacctccacctcctgggttcagtcaattctcctgcctcagcctcctgagtagctggaactacaggaacgtgccaccatgcccggctagtttttgtatttttagtagagatggagtttcaccatgttgcccaggctggtctagaactcctgacttcaggtgatccacccgcctcggcctcccagagtgctgggattccaggcatgagccactgtgcctggcctaacattattcttaaaagaacctaccactgaagtcctcagatcttgtgtatgaacacactcatggtgatctgttgcagctgggtaactggaagactttaaacaggggatcttggtttttccacgttcctccttgattgattgatatctgtctctgggcagcctaagtcacctgacctttcatgtaagacacaaccaaattcaatcccaggaaggttaagcctgttacccaaggacataaatcttgttcacaacagggttgaggctggattccagctttctgatttccttgtccaattattttcttaccatgcaaacagtagtctctgtttcctgttgaatatgtctacttccagcccttttggaagttcaccctctcccttaatgttttatggtacttgtctgtgtaccaatgtgtttttgcctttttctacatggcttttgctcaacataagaagttgcaggaaaaatgtaaatggcattaaatattcaatactctttttcccttaaagagaagttgtctacataaacagaattagagtgtgatttcctacaataatagtcttcctttactaggaaggaaatctaatgggccttttctccagctcttactgctgttttcagacaagtatacagctagcagctatccttgataatgcaggcatgacaaagggaaggacaaagaaagcccttctttttgtattggatttaaaaggtcttcactgatatagatatttttgttttataacccattctgtgatgtctgacagcaatttctttctgtgacctccccttccagtggcaggcatggttatctgtttcccagtggcagtgcatggagtgtctgtccgcagagcatctgtgtggcgatcaggagcggcggttcaggccacttcatcttttgcaccatgcctctcacccggatgcatcttattcttttatgtttccctgtacacttgctcttgaactgaatattacttcttataaccaagtactctattgttgaggttaaaatgcttagagatatctgattctaatttttcacagaaaatgccacctcacacattcagttaataaataaaacaactgggccatagagaggctattgaggaagagtggaaagggatgaagtgggtttgagtctccgatcccgaagctcaaaaacagtgatcgcttttttattatttttccagcataccctcttttcagacatacaaatatgttcactgaatgtgcgtagtcacaagagacaaggatgatatgcattttaaaatatgtatattacaagggtctttcttagcaaaattcatgcataccctgcattttgagagctgcttctagctgttagcctggctgaataatacacaaatttataattcatgatacgcaagagggaaaatgagcaaaataatatcataggatatgaaccttgccttccaaagatgcaaatccacccatgctctttttatgacttggaaggagtcacttagtcaaaataacttagagtggagaatgcccaaatgctttggcaccagcaaagctgtgcgaggttgccagaatatgttccaaatgcatagagatgggagttagcattaaaagccattagctcatgcccaaaatctggcacgtccattcactgacagtcctctgatattacctttcagtctggattcccttaaacttggagttgaagagatgctactgaatcttgggtactcttatagaatgacatgtataattattaatccagtgacctcccttagtccttcaaataaatgttattgtcacatgctactttatttgaagcaccatacgtattaggtggtgcaacagtaattgcagtttttgccattgaaagtaatggcaaaacccataattacctttgcaccaacctagtagttaaaagaattcatcataaaacagaaaacatactaaccagtgttttacttattcacagttatataaagaatggcactgcctaaaaatgtttctattttgctttgaaattcatagcaatgcccatttctagaagaaacaaagggtgcctattctagcagctcatggtcctaacatgagattagaagtttattcttactcctactagcccagtggtatacaccactctatacagcaatgcacacctgtagcacagcatgttacgatcctaaaagagcaaagaaaatgggagctagaccatacctcagaccctctcatccctttcctttcccgcttactgaggccagtgacatttggaagaccagtgtgtaattttccacattggacagacctgattttattcttggtcaacattgacaattttctcctttctaaaatggatgtattggtatctagctcacagggaaggtgtggagattcacctgaggatacacataaacagcaaagcagaatgtctagcctttaaaaggtctttatgtaaccagaacttttttttctccttgtatctcccatgaaggcctggacattatcaagccttccctgacacacatgaacaaggtaggtcaatcccaccccaaactcaacataatctggaatcagtactttgttgcaaagcatatagctatggcactgactctgcattttatgcgcagaggagatcagagacataacatggttttgaaccataggatgtactttcttttcatggtacttcaaagtctcccactgctactagcaccaaagtctcaatttcatgaattgcccatatagatagacagtgatcagcctctcgcccccttcatcccaaaagcttttcttcagtggaaaatcttcctgcaagggaattgtacctgtagaatggggaagaaaaagcagaaagcatgaatctgtatagatatgagaagcaagggtggctccctgcttggatgaactaggtctctgtgcatgagggtcttcagtgttttcctgcactagaccgacaattgtctatctatatgggcaattcttgacattcagactttggtgctagtgtcagtgggagactttgaagtaccatgaaaagaaagtacatctggtttaaaacaatgttatgtctccaagctcctctgcgcataaaatgtagagtcagtgccatagctatatgctttgcaacacagtactgattccagattatcttgagtctgggaggggggcattgacttatcttgttcatgtgtgtcagggaaggcttgataatgtccatgccttcatgggagatacaaggagaacaaacagttctgattatataagatcttttaaaggctggtgcattagctgcttattttggttcaaaatcttacaaaaatatgagaggaatcaggtattactttgagcatttgaaacacctgtggcagaggaacttgaaaagaatgtgtcacttttcattgtctggttttctagccctttgtcacaaggtgattttattcttgtgcatctaatgaccaggagacatcatgatggtttcattagcacctgtggccccatatggtgtcttaagtgtgaccagtataagcgtgctaattttcttaaaggaagcaaaattaaactgtgtttcttgttagagatggaaaacaggtggtcagccttatcattctcgctaaaccttatggtttccagatttaaacaaccttgtgaggtctgttaaaggtggtgtaatgtggactctgtttagtcaacatgtaattcactatcctatttcctcttcagtgattaaagtgaaagtcaggctcttccaggagttttccagtggagcataaaagaaagagacagtggaagagaaattgtacttattgaaaggaatattagccagatgactctttgagtgactgcagatgactgttccctaagtctagctatttcttttcttgtaaactttttttttcccatttccattccctaagtcaggatccagaacgttttgtggttcttctatgtgtttgattttcaaactttgactccatcaggatgaaatttcctaatctatgcaggaggaatagctttattcaacaaacatccatggtcctttctgactgtcaggtgttatacaacaacaaggtttgattgcctgttgcatgataacaggcaccaatgcaccaatgcatcaaaacagcaggagttgcagtagagaaagagtttaatcatcatagggcaactaaatgaggagatgggagagaacctcaaacccacctttctgaggagttttggactggagtttttaagggaattttggtgggtagggggctgaggagctgggggttgtttatagggtgtgattagggatgaaaccataaagatatagaaactgcattttttcattgagtcagttccttggaggggatcttaagacagactggcatcactggacccattggaatgcagaatctggaaaatatctccaatggagaacttgaagtttcttaatgttaagatgttatctatagaaacaattagggaaagttaggaccttgtgacaggagccacgtgactttttgacagtaagcagctataaggaagtgggctgttgggcaagctggttaatgcttagctttgcttctgctcaaagcttaggcttttacttaaaaactaccaattcagttgcattaatttaatggtgatggcttcacaggcactgtattaagtgctcaccctgcattaattctttccatctgtatgacaaccatgtgatgtaggtgctcataatgtctccatctacagatgaagaagtggaggtacagggaaggtaagtaatttttcagatatacagttgggatggtcaaagccaagtctggactagactctacatgctttctccatccctatatctgcataaacatgttcagacaatgaaacaaaacaatgcttgtaaagtatcccacccaatgacaggtgcaagaaggcaaccacaaaatggaaattatctttttccctgaaatagtcttattcctgggactcagggttcttgcctttagtctgtgtcccctgtgattcattcctttcactatataagttttgtgctctttatactcacttagataatcacattactattacctggagtgaagtgcaaagccgtgttcttcagccaggaggctccatctttcctcaggcaagccttattcttaatcattttctacctcaaaacctgtaagctgcttgcagaggttgctcaatgcctcccagagcctgtattttccttacatatggcaagcattcaatcaataattgctgtttgatcaatatgccaaatgtaactcttcatgtggataagtttacagagtcttttccattgagtcttttccattctttcctgttataaaatcaactatgaacagttgatgaacagacttggctttgaccatcccatctgtatatctgaaaaatacttaacttccctgtacttctattccttcatctatagatggagatattatgagtacctacatcacatggttgtcatacagatggaaagaattcatgcagtgtgagcacttaaaacagtgcctgtgaagccatcatcatgaaattaatgcaactgaattggttagtttttaagcaaaagcctaagctttgagcagaagcaaagctaagcattaaccagcttgtccaacagcccacttccttatagctacttcctgtctaaaagtcatgtggcccctgtcacgaggtcctaactttcgttggaaaatagtttattttataacaggaaagaatgccatagagacagatcacaggaaggaaaagagacaaaatcttcacaaatgggagtggagacttgcacttgaagaaaaatgttgcctttctcagaatttgttaggtgagatttcagtctctaacttagtgcctcactgtctgtgttcctcacagcatgggttaatctggtatgagatacaaacctatttcaaggcagggacaaatataggccttcaatttttttttttctaatttggtatgggttatctatagaagtgtaaatggttcacagcaagagattgcttttcagagaagtacatgtaagatacagaaatctctagatgtgtctgtaccttaactttgaaaaagagaaacttttaaaaggtaagagctgtttttcctaaagagtcattttagaaaatgttctagatcttcctgtacataataaggcttctaagcatttggggttattttaaaaattggattttaaatattttaaacatttggatttcagaatattcagatttattttattctcccagtattgcaaatacaaaggcaaccatgcagtataagaagagaacaggataaaatgaacatggacatgactttaaaaagaattcaaagttcaatgaccaaatttaaattcgcattggaatttgtaaagaatgtaactgacactaaaaattttctggcatgtaaaacatggggcacattcccagaatgcagacaaataggacaaatagaataaatttaaaaagaaattaaaaatacaaatgacaaacaaaagaatcaacttataattagtgttcttgaagatgattcacaagcaaatggagcagaaataatattcaaggttgtaacaaaagaaaacttttctacagaaaaaaaaagcagagttgcagattaattgggttcactttggtttgaggaaaacttaataaaaatagaaccaaaccaaaatgtgttgtatcatcatagtttaaataaaagtgaaatatcaactataatcaccctggcaaacaaagtatgtggcatgggatggaagtattcctgggctgggtccaacttctctgtaataccaaacaatgaaagatcaagtaatatctacagagtgttgacgggttaggattcagggcccaagaattcaaccccaaaaaagattttcctcaagtgtaatggcaagagaaagagacactaaggtatgctatggtttacgatatataccacacaaatagcttttctgaaaaaaattacttggatatatattccagtttaccaacatgtagattaaaataatgaccctgcttaaaatcccctgattgaattatttatttaatcaacttactagacaattattgaaaacttgattgtaatggaaagaatgagctcaacataattattgaaaaggaataatactaaaaattatagctattttagtaaccaccattttgttatagatgccattcactgtattttgaaattcacatcatctatttaagtctcatgagttaagccttatagcccgaactcatagagaaaaacagagttggatgaagtcatatacccaagatgatgtgaaaattttctgagggatgcaacagaggcatcctatttccaatatcatggctcatccgcagatttggccaaaatccagaccagcagtttgcaaatgtttctatgctttagaatcagctgaggaactgcaaagacagtcatgcctgtgtggccccccacctctgagattctgaattgattttctggggtgccacctggtgtttggagttttaaacaaaaccttggatgattctaaggtgcatacaaagttaagaaccatgaatttaaacaataatatccgatctcttctacaaagacttggaaatggtgtgagaggagcagaaagaagtttaaatctgtcactactcatagggaataatcaacggtaattgctgggtttttcgttttgacaattagatcaagattgttgcacagctcttaatacactggtaggaaatatggaagagtttcgaggggacattgcaatgaaatgggattgagctagggcagtggtgcacacctggggcaattgtatccccagtagacatttggtaatatttggagacatttttggctgtcatcactgggaagcatggagattgactattggcatctcctgagatactgataaaaatttgggaaaaaggcatggattcctccaggtagagagtgtatgataagattaatgacatatttcctaaacatttatttttccctaaatcaaaatgactgtctatccatgtgtgcgtgcatgtatgtgtacatgtatgcatgcatacatattcattttcactatatttctattcttcatttaattttattcctttcaagtttgaccaaaagaccttacaaccagtctgttggtattttgaaagaaaatttatatttgtccccattttctttataatctttcaactttgaccacaaacctatattgttttcttcaactgatacattttgggtagcatcaaaattatattcagtatcgtgctttggagaggaaaaacgtgctgttcccattttcaagcatgccgcaatcctgaatctactccttacaaaatttctgtgtcagcttggatacatgatgtttttttctctatgtgtttgggttataatacataactaattctgtttaattctgtttttttctctacgtgtttgggttataatacataactcatgtcaccattatgagacttaaaaaagataacttatgcaaatttcaaaatatagtgtaaaatagagacagtggcatataacaaaatcgtaagtacataacaaaacagtggtattgcactatgatatcttcagtaaatacatataagtgttgtacccagtgtcacgtctcagttgctgtcatatcaccaacattatttttgctttctcctcttagttgtatcttacgagagccacatacgatcatttaagtcagagatgaaaattcaaatgcctgcaggagacaggcagctatcacatgggcatgattcaggctgagtgtgaacagcggggaactagggatgtctgcaattggagagtgcttgcccactgcaagaaggaggagaaggagggcggggagggggaagaggaggaaaaggaggagaagaagaagaaggaggaggagaaaaggaagggagggagggaagaggagggggagggagggaagaggaggaggggagggaagaggagagaaggagtaggagggagggaagaggaggaaggggagggaggaaagaggaagagtgaggaggagagggagaagggaaaagagaaggaaaaggagaaggagaaaaagaaggaaaaggagaaggggaaagaaggaaaggagaaggggaaggagtagggggagaaggaagaggaagaggatgaggaggaggagaagaaaaccaaagaggaggaggaagaagagaaggtggaggagacagtaaacatgaggtctaggctgaccaaacaaagcgcttctgcaggttagcatagccccttgtgcctctcctgcccttggtcctagccatgcattgaagagaaaggggtagaatccgaatctgtgagtctctaaaagaaatttagacacatcagattattttgagtaaaatatatagaaaataaatattgctgtattgagtgcttttcagagcatatatgtgacgcatcttattttcctctattaaagaccatgtgcaataaagggtaatgggtggaagtgaggaaagacaaacccatcctgccccacctagaggacaagttactggtaacttgctgttttaaggaaacgacacagggagatcacaacgacctcaaaaggacttttctgcaaacaaatgtaagttatgttgcattcataagtaactgaagccaaaaccctactcaaaagggttatacaaaaaaggataattattggctcataccaactcagtggtcgaccattagccttgtgtaggaactgtattctttaccaagaattgtaagtattcaagaattgttggtgacaaccgtgcaagttttccctgttgtaaaattgtaacataatttattccaatgaaagaaacccatagacattatccttaacattgacagaccaactgcctagagaaattcttttctgaaactgtttcctaaaacaattagttattttacacacaccagcaataggactaagagaaaatagtatcagagatctttcagagaccgtatcaacagaaaaaaatgtaagttgaaagtacaaattagttttcagaataaatgttcagaataaatcattagccacctgctacttttaattagcaaagctttaaaagctcactcattgacttagcataatgtcctccaggttcatccatattgtcacaagtggcaggattttcgtagcagaataatattccattgggtgtatagattacattttttaaatccctttatccattgttggacacttgggctgtttttacattgtggctattatgaataatactgctatgaagatgggactgcagatagctcttcaagatcctggtttcagttattttagatatatactcagaagtgggattcctagatcatatgttagttccatttttgattttttgaggaacctccatatggttttccataatggccataccatcttacattcccaccaacagtgcacaagggtttcagttttttcatatcctcaccaacacttgctatcattttttttataatagccaacctaacaagtgtgaggtgatatctctttatagtttgatttgcatttgtctaaggattagtgatgtggagcatattttaatgtgcctgttggccatttgtatatctgctttggaagtgaaataagcctgtcacagaaggacaaataattcatgattccacttagatgaggcatctaaaatagtgacactgatggaagctactcaggggttgctaggagctggagtgggaaacatgttcaatgggtataaagtttcagttatgctagataataaggtctagagatctgcacatcaatgatgcctatagttaacaatgtggtattctacacttcaaaattcgtttagaggggagatctcatgttaagtgctcttaccacaaaattaatcaatctgtcaatcaacagaaggaaactttggaacatgttcaatttgtctatgtattagtccgttttcatgctgctgaaaaagacatacctgagactgggtaatttataaagaaaaagaggtttaatggactcagttccacatggctggagaggcctcataatcacgttggaaggtgaaaggcatgtcttacatggtggcatgcaagtgagaatgagaaccaagggaaaggggtttccctttataaaaccatcagactcatgagacttattcactaccacgagaacagtatggggaaacctcccccatgattcaattatctctcaccaggtccctcccacaacacgtgggaattatgggagctacaattcaagatgagatttgggtggggacacagccaaaccatatcagtttattaccttgattgtggtgactgtatcacagttatttgcaaatgtccaaactcatcagattatacagattaaatacgtgaaattatgtgtatatcaattatacttcaataaagctgttaaaaaataaaaactaaaataaaatagaaaataagttaaagtccacccactgaaaaaattatagtataaaacatagaattatgccaggcatggtggctcatgcctgtaatcccagcacttagggaggccaaggtgggaggatcacttgaggccaggagtccgggggcagcctgaccaacgtggcgaaaccacatctctactaaaaatacaaaaattagccaggtgtggtgccatgtgcctgtagttctagctactcaggaggctgaggcataagaatcccttgaacccaggaggcggaggtcgcagtgagccgagatcatgccattgcactcgtgcctgagcaacagagtgagactctgtctccaaaaaaaaaaaaaaaaagtgaaatcaggaaaaatttatataaaatctaaggcaaaaaaagatgcaaataatttatttaaaaattgatagtttgatttagcttttatttctgaaaattataatacgatatatccagagcaaatcgagaaaagcactttacacagtaaagcttggatatgttcaaagtcacaactagatagcaaaaaaatattccatttaaaaactgttaatctgtattaaaggaatcctgccaaaaaagaactgggaatctttcatgaatttataggcactgtttgccatcctgatccaatttttctcttgttgaaactgcttcattaatttaatgtgcaagaaataaatatttgatgtgcaattagttggagattattatggccataatggaacctttccaaataaacagctgctccagcactttaaatgcatgaaaagcaagacagaaaatggaaaatataatgaaacactagctctacaggaaaaaaagttaaaatattcaattagtgagtaaggtggctgctcatttagaagtttggtggtggtttatcaaagcataacagcataagagctcctaaactttagccaaatatccatccacctaaattttcatggaaacattcacctgcagatgtaatacattcttctctgacaagaagagagtgttaggagaatagacattggccaattctaccaatttcttcacgtgttttattatatatacataaatgtatatcaatgtatatttgttgagttttgattattctacattggcatttatatatgcactataaatacctatttgtatatccacatatgaattgtaatgattccactttgagagggaataatctgccttaaaagtttcacactgactgggctattttaagtctgagtgagcttctgaggtttcatagcatgtatgcagaccccgtgaaggaactgacactattaagttagttaaactccttgggagttttacaaaatgttatcttcctttcaaaatggactataagatttggagtcagttgtctctcttatctactgcactggaaagcacttgagggtagataccatggctaatatctcagtatctccaaaccctgatatagttcctgacacagagtagctcaaaagtattcattgaaagaatgcctaaggcaatttgcaatacagatggggaagagatagacatcaaagggtgagtattatgagctacacacacacacacacacacacacacacacaaaaagtttactaaaatagatcaatgtctcctattgagatgggagcaaaaggatgcaatcccattggcattctgttccactgcagacataatagcaaaagggcaaggttgttgctggaactggcagtatttggcttgtaattacagatttgaatatcaaaaataatcactgggaactgcttacaatgaccaatgttttggtatacttttctagaaaactgacttggggaaaatttattacttattggggctctattctattttgagattcgattctgcaattaattacattttactcctccgctttgctctaaaaaactcattggtccaagggaattcaatttttaaaaaaaaattattttctctgctccctgctgcttccatgagtgaaacacacgcacatatgcacacacatacatgcatacacatgctcacatgcgtactatggaggagcaaatgaaagaataaaggcattcatgtaacaccattttgccccagattcgatccattcgaatgtgatagatggacacgaactgtcttgctatacatggaggtgtaatgtctttgatggccctcccatgagtaggtagggttaatgcttccttccctggattctgggtgtacctacaatgtgtctaagaaggaggtgatgctgaaagtctcccaacacgaggtactcaaagatcatacggcttcttcccagtgtttgtggcattctcccctagggatgcaggcaccatgctttggagaagccaagcagccatatagataggtcccacatcaagtcccctgccagcagcctcagctgaagtctcagggacaggcaacaaaatccccagacatgtgagtcgtcagactcgcgatgatggagcccccagctatccttccagcaagccagctgtcgcatggaacagagacaagctgtgcccacagagacctgcccaaattgcagatttgtagggaaaaaaaaaagactgctgttgatttcagccactaagtatcatttgttatgaagcaaaacacaactaaaacacttgtgtgccagaatctgaaaccatttatttgataaacttatttttagcttataacataccaaagctattcaaatgtgtggcttcattgctacccatatcctgccgtccccacattacacagtaaggaggggatatttattaagaaatatcttcttgtgaagccagagcctaagtcactgctgctattcaggagcttacattataatgggagaaaatggggacaaatacataaattagtaccataaaaatagtacacaggagtactctgcaagttattcattcaatgcatgtgtaaggcatgctactgagtcccaggaacattgctcttcatgctataaatgcagcagggatgaaagtagacaaggatcctgctgtcagaaattctatatccctgtgcacatcaataaccagtagacaagcaaacacacaagaccctttcagatcaagaaaagtgcagaacacagccagggcacagagttgagaggaattgtgaccatagacagtgagggaaaccaggatctgtcccacaaaagatgcctctttaacatagaaattatttatgagccaaaagtaattagaaagcataaaatgaaggaaatgctggccctgtcctcctgcttttctgcctaaaggcaaaatatagattctcctttactggagatgactctaaactcttatcagcccagagatggcatcagagagatctgcaaacaaaacttactccattaagtttcttacaatatatttaccttcccaccattgctgtcccttggtagctgaaaccactttcctttgtcttaccatttctctacacatgcattgttcttggtggaatatatcctgtaagccagatttctaatccactgccttgagctacctttcactgagatttctcctgtatgatgtgaacagcacaggcgaatcagcttcctttttccttctgttgacttgccttttgttacaggagttcatcccaactgagcttatggaggatgagaaaaagtatatttcttccctgataatagactatggccgaatttttctttaataagatggcatttaagctgagatcttatggagaaaggtggttggccatggcaatacatgaggagagaatggggaaagagcaaatgcaaagacatttgagggacttggagaaacagaaagtcagaacgtgaccaacaagggggaagtaatgagagggagatcttttggagaaatatcccaggtgagtctttgtgggacacatgtgtgccagagtctgaaaccatttattcagatgtagtaaaagggccttcaattttattaccctgattgctacgggaagctactggcaggtgtcaagcagaagagtctagtaatcattcatgtggattgagtataaatcactttgactgctgagtggtgcttgggtgagaatcggaacagggagacccagttagaacactgcagttgatcttcattatctgcagattctgtatttgtaaatccatctagttgctacgtttatttgtaacccccaagtgaatactccctgtgcttttgtggacatgtgcagagtggtgaaatattctagtacattcccagctgaggttgagtaaggagacactctgccttcttgtttcagttctcatactgtaaataactattcttttcgtggtctatctagggctatattgtttgtatttttgtgctttttgttggtgcttttgctgtttacaatggcccaaaaatgcagtgctgaagtgctgcctagtgttcccaaacacaaggcagttgtgatgtgcctgccttacagagaaaatacatgtcttagatatgcttcatttatgcatgcatgacagtgcagttgggtgtcagttcaatgttagtgaatcaacaatatatatccagtaaagtatgtttgtacgaaaacacacccaaaacaaagttatatattggttggttgatgaaaatgaaactggagctcacgggaacctaaccctgaattttccaagaagaaatggttccatattcagtgtttgtgatgacctcttagagcacaactacctccaataagcagaattaaccgtatcccagtagtccaggtggaagacaaaggttgtagaattggtgagaagtggttgagcttggtcaactggcagggtttgggagtgatctggatgttggacaggagaaatggagaggcactgccatgtgtggatgctacgtggacaggcagggaagggttgcatcaataaaaaaggaacccacatgaagagggcagcatttgaactgttccttgaaaggatgaactcgtgcatttcaaatttatttatcacatatacacatgtatttaagtggaagttatatactcacacagcacgggaacataaagcttagaaaatttatgagcaaagtagagttatttcttgtagtatttttaaaggacatgtttgttttgtgtgtgtgtattgggaactcaatccttatctcactacaaatacattaacacaaaataaattcattggcctatacacaaaagctaacacagtaacatttctggaataaatcataagagaaaaatcagcaaccatagggataagacataaaactataaactataaaagtaaagaattgataaactagacttcatccatgttaaaacttttctctggaatacacaaatacacaaaaaaatgtcagacacaggatggaagaaaacattagcaatctaatctaataatgtaatggaattcaatatatataaagaactctgataactcaacaatacagatcaaaaaagccaattaaagatagcaaaagacacattacgtaagaagaaatgtaaatggccaataatgacacggaatgttgctcaacatcattagttatcagggaaatgtcaattatatcacaatgcaactccactctgtacccactagtctggtttaagtggaaaattctgacaatttcaagtgttgtcaaaaatatgaatgcttactcaccacttgtgggagtctaacttgggaaaagtcctggaaatttgtcataaagttaagcatagtgaccatataactcagctatttctcctttctttctttcttctttctttctttctttctttctttctttctttctttctttctttctttctttctcttcttttctttctctctctcttctttccttctttctttccctccctccttccttcctcaaatttattcaatattcattgaacctttctgatttttaaaagactgctctaaagtcgataaatactatataacttacattcgattgcagtgaggggcagagaattatcaagcaaaattatatttcaaaagattatttctttaaatggggttaaactctatgaagaaaaagttatgtatttcagattgaaagagagtaaaaggagaatgtgggcaactttgtataaggtgattagggaagcaaacctggaataatgttatttacagaaattaatgcaattaatggacatattctatactgatggcatatttctatataatctctgcctctaaatatgtaggcataaatcatttttctttaaccaatatataggtctcttttttaaccaaaagaattgtttaatagagaaagaagacttcgttgaatccaaacggtgagagacatcaattttaaaccaaaagtacttctgggtgttggcagatatcctccatagacagctacctctctgtggttttcaagatggtgcccttaggatataggcatcagcatcacctggcaaccttatttaaagggaagcttccagtgactacttctggcaatcttattattaacaagcacttgggctgattatttggtatcttaaagtttgaataccattggctgtcagttgcaactttaaaagtgctgacataagattgaggagggtatatttgattctgagtacaccaggcaggatcttatctttgtgatactgagccatgggggacttcttaactttatgcaggaacttcttaggctgcctggactaccaagctctagtctttcctggagaacactgagatgtgagtattagatcttggggccaggagttctggccaagttggagcactgaggatgcaagaaaaatctcttaaaatctcacagactcagtttgcaccttggagaagaagatcaaagtggtagtatatatatgcacaaccctattgcccctctccaatgaggctttgaagatcatatgcatactaaacctaatgttgatattcacagttttcatgcaagaaaagaatagaaagtgattgagtttctactgtgtattaacacctttaaaaatattatctcaattaaaattgctgaaatcttctccatgacagtttagggacagtattgctttctacatcctataggaagaaataattggttgaagcaggagaatagaaatgcaaatccaaaccttgcttttgccacaagttcaggttaactctagaagcattatttgattattttattctaaattcctttctttttaaattaagagtatttcatgcgctccttgtatgcgtcaatcaagaaagactttaatttggctttttttaatgatccaccacccttccacgtgctgtctaataacatgttctaatattatgatagcattgctgagttccaaaaatgcatttcataattgagatggtggcttatcaatggcagcaggcttaaaatgaacaagaatccaaatacttgtttcaagagtttattttttattcctgattatctaaaaactgctaggcaattttttacctaatcatatctcaagtagtgttcgatgaaaacattttttttaacccatggaaacataagcaatggaaaaaaagtgcatgtgaataaacagctttattttggaaatctagggaagaaaatatagcacaccatttcccaatttgttttcctactcaagacttgtgttgaaaacaccaagccaaagataatccatggttcttaatcgtatactgttagatgtgcatgaccaagcgttgtcagatgtgcatgaccaggcattgttacagctccccctattgacctatctcctgtcttcttctcattagaacatttgttctttgccccagagtaaggcatctggccatattttcattaattcattctaatacctattttgaggattaacatatttaatatgcttatattgaatatttgtcaatttgtataaaattatatttaaatatatgtgacatagggccaggcatggtggctcacacctgtaatcccagcattctgggaggccaaggtgggcagatcgcttgagtcgaggagttcgagaccagcctgggcaacatggcaaaatcctcatctctagcaaatatgcaaaatttagcctggcgtggtagcatgtgcctgtaatcccagcgactcgggaggctgaggcaggagaatcgcttgagcctgggaggcagaagttgcactgagccaagatcacaccaatgcgctccagactgggtgacagagccagcctctgtctcaaaaataaataaataatgtgacatagcattctgtatatagtacaaggttcagtggttcaaatgcttccatatgtaggtgtgggcgtatctgtgtttacatatgtacatgtatttatgtgtgcatgcaaacgtgtgtgtacatatataactaaaaatcatatctatagtacaaatatatatacatacatatgattttttcagtagtatgtgtatacacatatatgcggtacatacaatcatacatatagtacaaatatatatctgtgtgtgtgtgatttttttaaaagatttgtgttccaccaggaggctatttccaatatttgtatggactctaaaggattaaattaatttatactacagtccaccttctcttttaacatttaaaactagaatttttatggctagatggtgatatttcaatgagcaataccttctacataataagtcatttaaaaacttgccatttaaatcaataaaattttgcactcaatacttttgcactcaaaagtattttaaagttatctaatattttgaactttaattcacttatcaaacagaaaacatccacttgggaaagtctaatacacctttggttaactgcacaatgtttaaaatccaataaaacttaataaaataatattttaccaacaagagaattaattcctatgaactatttatctatttgtatagtctgaggctcatcataaatcaaataaaagcatagtacctcagagcagagaagtacacataatatgcttgtcctaacatgatttttattacttgcatttccctctggaggaatacagtgaatgaattaatgaagttggcttttattactgattcattgcatataaaatgaaaaagccgctttggatgttcaagaatttacatgcaaagtagactaggaattccaatgtcagtttatgggctatatatatgtactgcagaaggaacagggaaaacacaaaactgagggtgttttctggtggatgggactgccaggaggtcagtgtgccttggctgaaggaacacggggtggtttgtaaataaagcatacaaaccatcagcctaatatttttggtatggacatcaggatgtctgtgggcaaaccaagtcaattgctaaatgcaaagttgcagattgaaggctgctgtggacatgaggcttgagtccccaagggtgtcctagacattgggatattagtttggaccctgccagagttggttcaggggtcagggtaggactgcagctttttacatggttttaggtgaaaatgggggtcgatgttgcctttaaagcctgttcagcaaggagaccactttgccaggctctatttatgattgacaataaatgaattatctgtttcctttcccgtgcccacgacttcactttactattgtgacaactttcttagtgagagagagagcaatgctggatgaaagggcaatggattgttactgagaactttgttttgtgtgcagaggtgaagtgaacaggggagtagaggttataaagtgttattcgggttctatgtgaatacctctgggtttattggaacgtctgaatgcgatgcctttctctcctgctaaacagtaagtaaggactgggtctgctcctgcaacatggcacagtatctggcctgaaaaagtactcgattaatatttattaaacaaatgaatgaggttaagtgaatatatagaatgatggatggatggatggatggatggatggatagatggatggattaataaatggttcatagtgtgcaaaagagggaagaaggctgggcatggtggctcatgactgtaatcccagcactttgggaggctgaggtgggcaaattgcttgagcccaggagtttgagatgagcctgggccacatagggagaacccatctctccaaaaaaacttaaaaagttaatcaggcatggtgatgcacacctgtggtcccacatactcaggaggctgaggtggaaggatcacttgagcccaggagtccaaggctgcagtgagctatgatcgtgccactgaactctagccttggcaacagagcaatactctgtctcaaaaaaaaaaaaaaaatgaaagaaagaaagaaaaaagtaggggcgaggcataaaatgaaaaagaaatgctcattacatttttttgaagttattaaaacatacaaataaatcagagtagtcctttcaaagaaagattagattagacaaaacctctggtaccaggtcttatgcctggtgagactttggatctcctcctggacaagaactttctaccctgttataaacattcaaggcaatctcttaagtgctctaagtgattgagcatctatccctgtgatgcaacccgaagctaccaaaaccctcccagatttctacttagttctgcctcttccttctccttctccttctctttattctccttccgctccttcttctcactctctttcttctcttgttcagaatttatctacttctttaaaagtaggcaggagcaagcttggtcaaaataaaaatgttgtaaaaccttgatttcgttagttttgttgttaccccctgacaatgcagtaagctcagaactgctaagatttgatgatggaatttgaccaaaaattaccagaaaatcctgcatgttgtacaggaagggggccctgagacacttggaactttacaagagcatcagagaaacaggcaattgggcaacactgaggaaaggcagagaggtgagggagaagatgtaaaatgtcactgatgtaattttgcctagaaccacccacagcacatcgtaaaaactaattagatctctgaaaagagacatgcaagagtggataagtgagctccttaggtcaaagtgttaaggaggtccatagttactgaggtaagagaaagaagaaccatcagaatggaaggagtattcagaaacatgaaagatgattatgtgaaggcagtgtctaggcgaagaaaattaaaaattataaaggaggaacaatgcatcaaatgaaatacaagaagccaagaagtctcggaggcttaggatgcttgaaaggatcctaagaggagtttctccaaggggctgaaatggatattagaaaatatattagctaatatatgcaggagaagtttacagaggacattatcataattgaagggacaggagtggaagtaaacgtttccattacgtgtagttgcatgagtgtatctttagagatgacgatcagagaattctggaacaccctgtgatacaatatagtgtagtttttatgacctaaaatagcacattaggtagcttcttgattaatgtcattacagtggcctggagttaaggtgctcttcaattgtcatattcctctacaaacctacactggtgaattacatggaaatagctaaaggacccaggcaattgttggttgacggtgtgccttaaatatatcatgttaatatagtgcttgcagtttaaaatgtcttcccacatacatttgcccatttaatttcctcaatgtgaggcaggtgctaatctcattttatagtgagaaaattgagcgttagagaggctgaaagtgataccctaataaggggcaagagttgttcttttttgtcagctaggtcaacggccatttatgccattgaactcatatcaagtgctcttcttctttctctataactgtgggaagacaaaggtttatcccaaagtgtgtgctataaaatcagtcctgcaagtcatatttccacgcatatcaattttgccaatgtacacattgcaaaattacttttgttcttccattgttccatcgacaaaacactaacgatgagaaaaatatctaatccatgggtgctacgagaattaagtaaattaacatgtgtaaccttcctagaaaagtgcttggcaaaagtaagcagaaaatagatatttatcattataattgttggtgttgtattgttatgaatgaaacgaaaaacaaaagtatagtcatgcacagcataatggcattttgatcaatgatggaccacatataaaatggtagtcctataagattataagggagctgaaaatattctatcatctacaaatattgtagcacaacacattactttttctatgtttagatatgaaaataccattgtgtgataattgccttcagtattcagtacagtaccatgctgttcaggtttgtagcctaggagcaatagcctataccatatagcctaggtgagtgatcgactgtaccatctaggtttgtgcaagcacactctgtaatgtttgtacaatgacaaaattgcccagtctcacatttctcagaatgtatcctcatcattaatcagtgcatgactataaacattttttgggcggaaaccaatttttcacttgtgaaccatctccgatcagtaacaaagtgtcctgttagctcccatatgaaggagagcaatgcttgagtggcaagcaggaatgaaagcgcagttcacctacctgtcccgtgtgctctcaggctctcttccatcagcagcaaagccctcctcccacccacacacacagagtcatgcacgtactcacacaaattcactcacatgcatacacagacagggtcatacacacactcacacacaccttcactcacacataccaccatgtaccaagagtcatacctaccaccaccaaggacgccatcctcctggcaacatcgaaaagaaagaagagaggccttgcagctcgccagaactatttcttgatagccacacttgggcaatgcggtatttgatgtgtcttcatggaggcatcacctttgctgttgttatctcatccacatggccatagtcattgcttcacagaggactgggtaaaaaaaaaaaaaaaaacaacgcaaataaatgaccactcacaggttctgagtggtgagtgagtaaatgttggtgctggctcaggatggctaatgggaactgctagcaagttagctggggccagcctgaagggcctggggagtgtgctgctggccgcagtagccacttcagagaagcctctaatagcaatgccaggaagggacagataacactggagcaacttcagggcatcaactcccagatcctagcttggctgcctgtctattgtcctgtttcctgaaaacaccaaggaatggagtcattcattaactcagcaaacacttaaagattgcattctgggttctgagtggttttaggtgctaaaaagagaataataaacaaaaccacaaggctttttgtcttctggagctgatacttaaattgatgtgagacagatggtacataacacaaaaaaacagctgttatcggttaaaattaggaacaatgaagaaaatgaaagaagataatggaacagaagatgacattggatgagatgagcctctatgaagaaaaggagagagtaacaggccaacgggtaagttgggggcaggtacggcggcataagttggtggatgcaacaagtgagctgaaaattgagtggcgagaaggaacctaccatgaaaaataaatgtgaggagtatgtatttctggcagtgcaactaagaactggcaaggtgctgagataaaggctctagaaaggtgtggtgtgttcacggcataatgaacaggaggagagagagttgtaagaggaaaactcaaagagataaaagtgatgtgccatggggaaaagatgggtttaattatatttggatggagagcgatggacaggttagtagcctctcagtaagaaggcctgatttacaattttataggaccattctggttaccaagtggaaggtggtgtgaaggggtaacgtgagaaaagcagaacgacctgggagctcagacaagaggtgaaagcagacatgggccaaagccatcagattcatagcacatttgtaagacacagaagaaaacttgctgctggatgagatgcagggtgtgagtcgattatcgaggaaaatgctcttccaaaagaagtaaacgatataaatgatggaacgtattacaaaacccaacccgaaattattgccagtatcagagctaacaattctaacctgaatgatcatccatctccctaccccctacaaagagtcattcatgagagaccatgagtctaaaacatcattattgaataggacaaagcgtgaggtctttctcaaaaagggtccttatcctaggcatgtttcatatcctgctttgctaaaattgcctctttgtttaaaattatgaaatcatgttttgaacaaatgaatgaaattgaaaattcatatgcaatagctctattgacatgggaaaataacgtgtttgtgtgaacatgattcactcacactgcctcttcagatacgaacaaatcattttgtaacatcggtttaattccatctttctctccatattgtaaagattatctttccaacttcacttcagaataatggttattattattgtaaattgtagttcttctccccttttttcttagtcattatatagtagttgattatctctctttctgcaggggttgaggtccccatttttatttccaatttgtgatttccagctccgtattttacagtattatattttgtgcactcggctattgtaaaatgatttcctattgcctcttttgggggcatagatttgtagcaatttagccttttttatccattcttcccagaaggcagtttgctgacatttatggagtttgaactgttacagagagtgagatgtgctttgcataaggacatttctgtcattgttcttgaggttaatgctatgtgggctccagtggccatgctgaaatggagtgtgaggtatgaatcatttcattttgattttttcagtgtatcagaaaaggacaaggatgtattgctatgctgctgatggtaccagaaactcttatctgatgatggtgatgaagatgatgatgatgatgatgatgatgataatgtactaattatgttctgcgttcagagacaggggaagcttttgggtgactgtcattaatcttctagcactgacagagactatcaaatggaataaggtagggtagcctcagaggaaggaaggaaggtcctcctgcaatcatatgcagttgtcaggaataagtcacccctctaactctttatattgagcctctcgataggggatatgaaaacagagagaggtactcaatgtctactccgtcattctccttcctccctggcaaactgctttcccaaataccagatagggaaaggtcccaaacagcagcaagattcaggactattgttgcaaagtaaatgtggttcttggatcgatataaatatctggagactctgaaaaaggccaagtgctttacttcagatagttgatgcttgagagcaaactgcacacagtccttttgaagtcaacagtttatcagggcattacagatacacacttcttgggccttcgcgaatacactcattgagaggcaatttgatgttatatctttgtcttctctagagaacgttatcacacagatgtcgatttgggtagtgtttttataattttgcaaatgaattattgcacattgcatctactgtcactcataaaagcccacacaatattccttgaattttaattcgagaagtagcaggggatcaggggaaggaagagattcacccctaggaataaatgtgtatgttttctcttatcagcaaaaagtatatctatgtaggtaaataatgaagacagaattatacaccttttaagagttatgtttttgttgttgttgttgttgttgttggctttgaacagagtctcactccgttacccaggctgaagtgcagtggcacaatctcggcacactgcaacctccgctcctggattcaagctattctcctgcctcagtcttccgagtacctgggattacaggcacgtgccaacacacctggctaatattttgtattttagtagagacaaggtttcaccatgttgcccaggctggtctcaaactcctgagctcaggcaatccgcccgcctctgcttcccaaactgctaggattacaggcgtgagccaccactcctagccgagtcatgttttcaacccataagagttcataggtaaaggatatatacatatatatatatatatatagccatcaacaaatgttgacctaaatttacaactcaagcttcccaaactactcaatatgagcgctcaggagtaccaaattcttcagggttttctgatggactttgtcttcatttattctttatgttttatgttgtgccttgtcttcatttgagcgttgcctcacagtcttttggttttcagctgacacaaacatcaaattagtgagaaggaaagtcttttgttggggctgtttatgcctggtctctttgagagtctcaagtgtcctggggtgtccagaagccattttctcagttatgtttctcaggacacaattctgagacataaggaggcctaactgccaaactcctctttgggcttcctgccatggattgtatttcatttctagataatacagcgaaaatagagccatccatacattgcagtatcatagggctcaatgactcattagacctatgaagaaaaaggacacaaaaggaaaaacataaataaatgcaaaaactatattctgaatgatttggttcagtggataacaataattaaaaggtgagctcacttgatgaatttgggggaacaaccaaaagatcatcaaaattgtagatgactcagaaatagattaaaaacagacctaacaggtcacagaatctgaatttctcctctccaccttctaaacatgcctcgcgattttcttaaccaccaaatctttctcctgatcatagacaactctcacccaggttgtcaacatatataaaactggttaaaatgatgagaggtcttcaaatttattcagagtaaatgctgctttaaaaatggtcatgcagcattgaaaaacgatcatgtggaaaaaacatacttggactgaagtgagactatataacctgtctgatttgggtacaaaacagtcttatttcttccaccttggtcacagtgacaatgataatattattattttatggattttctggacatcttccatatgcacagttggatggttatttgatgcatttatttttctgagtagctgatattaagtcaattcttgctcttgctacatgaaactaagagcttttctttcacagtcacataccacgggctctggctaaccagcatgcagggtcacagtcaggtcaaagaagcatcctaaacccaattgtgtcttaattttagaaaatggaaaagatcaatatactccatgtagaagaatagtgtattagtctgttttcatgctgctgataaagacatactcgagactgggaagtaaaagaggtttaattggacttacagttccaaatggctggggaggcctcagaatcatagtgggaggcaaaaggcagttcttacatggcagtagcaggagaaaatgaggaagatgtaaaagcagaaacccctgataaaaccatcagatcttatgagacttattcactaccacaagaacaatatgggggaaaccgcccccgtgattcaaattatctcccaccgggtccctcccacaacatgtgggaattatgggagtacaattcaagatgaaatttgggtggggacacagagccaaaccatatcaaataggtaggtacatcatggaccctgcatgaaagagagtattctacagattttaagagtcatgtttttaacccatttcagttcatgagtaaatgatcaaaaatacaatattgacacataaaggctattggtaccatctatatattaattaagtttttagagatatatatatctttaaggatagattgatagatagacagacagatagatagatagatagatctatatatgcccctcattatactctctcttgtttatctgccaccatacatagaaagagagacacagagagaaggtgaagaagaaggtgagggaagaggaggtacgggagaggaagagaaggagaagggggaaagaggtgataatttttaaaaagctgcagtgcaatgcaaaaaaaaaagcaccagcacctacagaaaacaaacacccactttaatttttcccagtggtggaattgattgttctgggacctgagtaaaagagcagggatgtctctgtctattctctctctcgagtcagtcagtgtgatgctgctggcctgtgtttgtgtttgaatgaggaaagaccttcactctagtaatgacctagcagttagcttggaggaccctggacatatttgtccagttccattcaatactcccataaagtgcctgtggtattatattagtttgctttcatgctgctgataaagatatgcctgagactaggaagaaaaagaggtttaattggacttatagttccacaaggctggggaagcctcagaatcttggtgagaagtgaaaggcacttcttacatggcaatggcaagagaaaaatgaggagaagcaaaagcagaaaccctggatctcacgtcagatctcatgagacttattcactatcataagaatagcaagggaaagaccggcccccatgattctattacctccccctgggttcctcccacaacatgtgagaattctgggagatgcaattcaagttgaggtttaggtggggacacagccaaaccatatcattccacccctagcccctccaaaacctcacatttcaaaacaaatcatgccttcccaacagccccacaaagtcttaactcatttcagcattaaccaaaaagtccacagtccaaagtctcatctgagacaaggcaagtcccttctgcctataagcgtgtaaaatcaaaagtgagctagttacttcctagatacaatgggggtacaggtattgggtaaatacagccattccaaatgggagcaattggccaaaacaaaggggttacagtgcccatgcaagtccaaaatccagtggggcagtcaaattttaaagctccaaaatgatctcctttgactccaggtctcacatccaggtcacgctgatgcaagaggtgggttcccatggtcttgggtggctccgtccctgtgactttgcagggtacagcctccctcctggctttcatgggctggcgttgagtgtctgcagcttttccaggcccacggtgcaaactgtcagtggatctaccatgatggggtctggaggatgatggccctcttcttacagctccactaggcagtgccctagtaggaactctgtgtgggggctccaacctgacatttcccttccacactaccctagcagaggttctccatgagggtcccacccctgcagcaaacatttacctgggcatccaggcatttccatacatcttttgaaatctagtgaagctttcaaaacctcaattcttgacttccgtgcacctgcaggcacaacaccacgtggaagctgccaaggcttggagcttccgccctctgaagccacagcccaagctgtacgttggctcctttcagccagagctggagtggctgggacacagggcaccaactccctaggctgcacacaacacagggaccctgggcctggcccataaaatacacgttttcctcctgggctagagataactagatgaagccagtacctggaataaacatattctttgtcatattttttcttatgtcttagtgacataaaactagacatttagtggtacttaggcaaacagttgaataaacaactagcaattagcaggaaaactggttgaacatagaaagtttagtaaccattctagtcaactctgtgttcttattttttttggattgttgactaggtactatggatacagtaactagagttacctgggtaagagttaaatacagaatcctccataaaactagaataactggttaaagacaagtataaaatttcattcttctcaacatttctcatttcttgttggaataatgagttagttctgttaatgtgtagtagtacctaggttactacaaatcaagaactaggaagagatgactagactaggataagtatttgacaccagatggtgaaaaaaaaaaaaccagtgttttcaaatagaaactcttatttcctgtgtgattaatgagttagaattagtactggagctatctctatgagatgtggatttcattttggggggtggtacatactcaacagatgaaattttgggtcatatggtagttctattttgattttccaaggaaccattatactgtttttcataatgtaccaataacatttctgccctgtaagggtccccttttctgcacaacctaaaagggtttcactctctccacacctttgccatcattactttttatctcttgactttttgctaatacccgtcctaacaggtgtgaggtgatagttcattgtggttcatttgcattctctgattattaatgatgttgagcacattttcataaacctgtcagccagttgtgggttttctttcgagaaatgtctattaaagtcctttacctattcgtaaaccagactatttttttttttttttttgctattgagctgtatgagttctttatatactttggatattaactcgttattagatatatggttcacaaatagtttctcccaaaccataccctgccttttcattttgttgattgttgactgtgcagaagcttttagtttccaggctgctcacttgccctacatatttcagcttcctagacccccacaatgtgtgaatgtgtgagccaattgcttagagtaaagcatatcgtatataatattattcataaataaataccatacaatagtaaatagatgtttatgacatatattacacacacacacacacacacacacacacacacactcacacaaatatcctgttggcttagtttctccttctctgaggaacccagcctgatacaaatacccagctgagcgagtgtctttgctgatcttcaccgcctgaagccagtgctttaaaccatgagaatgaaacattgaggggcactatgtggacactgggagaaggaagtgagatggaaaagttctttgattgcatccaagaagtgaatggtcctcaaggtgcagcagaggaatttgtaggagagagggatgattgattgacggctttttttttttttttttttttttgaggcagagttttgctcttgttgcccaggcttgagtgcaatggcgctatattggctcactgcaacctctgcctcccgggttccagcgattctcctgcctcagcctcctgagtagctgggattatgggcatgcgccaccatgcctgactaattttgtatttttcgtagagatgggttttctccatgtaggtcaggctggtctcaaactgccgacctcaggtgatccagccaccttggtctcccaaagtgctgggattacaagcgtgagccactgtgcctggtcaactgacgtcttcatatagccctccgtctatcccagttagcatggagggattttaggtaggtcatacagaaaccgggtaatgatggcaggtgtggaggaacagaatgtaccactgaatgggaggtccgggggaaacatgtggcggaaatatcctcccgtgccacgtgatctgccaaaattgaacacggggagtttaggaggggtgacatgtcagtttgggaactatctttaggggtgctaacccaaatctccctttctccaattagagcaccctgccttcctcattagatgtcacccccccccccgcccccgacttcatccgccatgtcctgatggtgctttgtgacgtataaggccttccttcccgcccagggcgaccattggctgggtagtggagtgttgaccaatcacagctcaggggcgtgattgtctcgtcctgggatcgcgagaggggtatatacagggaggccaggcagcctggagttagccgaccgttgcgagacgttgagctgcggaagatgagtccaaagccgagagcctcgggacctccggccaaggccacggaggcaggaaagaggaagtcctcctctcagccgagccccagtgacccgaagaagaaggtgagtgaccctcccaagctcctcctcgtcttcccctcgcctccttcctcacaagaagcctctcctgtcctcacttggcacaaccccccaacccggcccccaccgcttctgaggacacgtccctgttcccagcctcctccatcctcgtccctaaaccggagcccttctgtgatctccctgttgtccttccagactaccaaggtggccaagaagggaaaagcagttcgtagagggagacgcgggaagaaaggggctgcgacaaagatggcggccgtgacggcacctgaggcggagagcgcgccagcggcacccggccccagcgaccagcccagccaggagctccctcagcacgagctgccgccggaggagccagtgagcgaggggacccagcacgaccccctgagtcaggaggccgagctggaggaaccactgagtcaggagagcgaggtggaagaaccactgagtcaggagagccaggtggaggaaccactgagtcaggagagcgaggtggaagaaccactgagtcaggagagccaggtggaggaaccactgagtcaggagagcgaggtggaggaaccactgagtcaggagagccaggtggaggaaccactgagtcaggagagcgagatggaagaaccactgagtcaggagagccaggtggaggaaccaccgagtcaggagagcgagatggaagaactaccgagtgtgtagacggccaagtactcccctatctccgagagcagcgactaagttcaggcccagccgccagacctcagagatctcaccagcggggtgcttgccattctgaagataataaaatgaatgtgttgcaaattgatctgagtgactctgtgttctctgatggtggggagggagggagggagggaggaagaggtggtgtgtggggagggagggagggaggaagaggtggtgtgtggggagggagggaggaagaggaggtgtgtggggagggagggagggaggaagaggtggtgtgtggggagggagggaggaagaggtggtgtgtggggagggagggagggaggaagaggtggtgtgtggggagggagggagggaggaagaggtgtgtggggagggagggagggaggaagaggtggtgtgtggggagggagggagggaggaagaggtgtgtggggagggagggagggagggagaggaggtgtgtggggagggagggaggaagaggtgtgtgaggagggaggaggaagaggtggtgtgtggggagggagaaaggaaagaaggaaggaacaagtggtatgtggggagggagggaagtggggtcccgtggggttgaggtcagggggacaggtcacagttagccagacaggaggataaggattgcgtcatggctgagcactggagacaaatttccccttcacaggatgactccgcttcttacacggtttgtttcttcatgcaatcttgctagcacatacaccaagtaccaagaactggattctacctacttaggtttcactgtcaaaataccttttcggttatagaaacctatggaagaatcgtttccatctctttcctttcagcgtcccctccctacaatctaatataattaagaagaaaaattcaaagtagagaaaaatctatctacttgaaaaaagcctttttatttttgcaactcaggagacagaaagtacaattcatatttccatacattagaaatacacaggtcttttctacatctagtagaatttactatatacaaatatatgtaaatttttatataaataaaatatacaactatatttactatagacaaacagattatatgtttacatataaaatatatacatatagacaaaatatggaatatatatttatatataaaatatataagtataaataaatgtaaatatagattatacacattagaaatacacaactcttttttgtacatagtagaacctattatgtatatttatatattaatatatcttatgtttttatatttagattacatatataaatatttatattctatatattatatataaaacattaaacatatatttatatttataaataatatatcaatatagacatcaaatctatatatgaaacctatctataaatataaatacatgaaaatagatatatataaatatatataaaatatatattctatatgtgatcatttattttagaaggtaaggtgttgtgattgttgaagcatccttcacagattaaaaaaagaaaggaaattatcattttaagaaaaataaaataaaaataaaaaataaataaagtacaaaattcccagttgtcaataattacaatgagagaataatatagaacttgctatatatagaaagtatttctatatatatttctaatatatatattatgtatatagtatttctaatgtgtatatatgtaatgtacatttatatatataattatataaatgcacagatcttttctatatatagtataatgcactgctgtatttctaatgtgttatatatattaaacctatatttatatatatttatataaatacacaggttttatacatatttatataaatacacaggtatttatataaacatataaacacacaggtcttttctatgtatagtagaattttgtatagtagaatttatgatacatttagaaaagacctgtgtatttctatatttatatttagaaaagacctgtatatttctaatggatatatatatagtttgtatttatatgtatatttatagataaatatataatctctatatatttatatatctatttctatgtatttacatttagatagagatctatttcacatatagattatataaatatattctatgtaaatatataaatacatatataaatatgtaaatatatttatatttatgtataatatataaataatatataaatatgtaatgcataaagataaatatacaatatataaaatatatattctatatgtgatcatttattttagaaggtaagctgttagtattgttgaagcatgcttctcaggcaaaaggagaaaggaaattatcattttaagaagaataaagtacaaaattatcacaatttaatttccagttgttaataattacacagacagaataactcatgtcctttaatcttacaatgaatagcacgttaaacttttatgtgattctgaaaatatgaatttccatataataagggtttgagatgtaaagcactaactttataggcagttttcacttgttacatagattgttcttagagctttaaagatgttaaaattaatggtggctttgaagagatggtagcatcatttgagaaacaataaatgggttctgtttcatcctttccttggtgcagtcagggcttcacttcattagcttaggaagggatttcagagctttgcatgttgatcttgtagttgcctcctgtggaatcctacgaaacctaggacgctataccacagaaacagggccttgccccatgtcctgaacaccatcattttgtggtatatttcttttgtattatttcttatatggaaataccatataagaatgagcatgcttggtataactcaaagcctgtttatttgcaaggctgtattgaccctggacaataaatatttgtatgttacggatgagaaacaagtctgcatgaaaagctcctgctgtcttttaggaaagcgtattggctgtggttgtatatctctttccaaagggaaattggtgaactctctgctatagttttttccataatgacagcataaaaactgaaataaacttatcttgtcagtggccacttttggggttggtgtatattagggagcacttttgcaatgtgtttcaaaattacattcaaggattaatttcatgcaccttattttaatgccatatttccattcaagctctgcatgtcaaaacagtctgtgatgattcttttggcattgaaataattatccatggcacttaaaccgtgtttctttcatcatttcatggcagtaggagcttcaactgctatttgttgggaacccatcctgactagctctttcactagggcttcatgttttattgtgatgattggcagacttgtgtttcagacattttcagatttggaaagttactatgattttgaaattatagatgcaaaaatgtcattgaatttactttcacaaacttttaattcattatagacaataagaggtttaatcagaaatcaggccaggtgcggtgggtcacgcctgtaatcccagcactttgggaggccaacgcaggcagatcacttgaggtcaggagcttgaaaccagcctgcctaacatggtgaaacactgtctttactaaaaatacaagaattagccaggcgtggtggtgtgcacctgtaatcccagttacttgggaggctgaggcaagagaattgcttgagccctggaggtggaggttgcagtgagcagagattgcaagactgcacccactgcactccagcctggctgacagagcaagactccatctcaaaaaaaaaaaaaataaataaataatttaagtaatcttttaatttgttggagcattcacaaatactacatcttcatttaagtctctctttattctacatgttatacacacagttaaattagttaataagagtgttaaatactttccctccttctccaactacccacaatctcaggcttaaaataaacagtggaatgcgtaaagacccaaaataatataacagcaaaggtgcagttgacttttgtaatcaaatgataaatatcaaagcttcctgacgtttttaggcaaatcttcctgtgtccctaaaaggaggatccccttgacagcagtcatgaacaacaggtgatctgaaattctcagctgtcaaagacggtgggagaatttgaaaacaccttgtacatattaaagagctaagcatgagctgatgcatacatacatatgtctctgtctcattagaccacaggaaacaggacacatggcaggaaggctcacgtcgattccccttgaccatgcagcttcctctgctcctgactcctaagaactttctgacctattggtcattcccagcttcagatccccacgcataccgattgtttttggccccacgtcagtgatacacacgacacagaattgctctcaaaaaacactctggaattgaaaaatgacaggggaagctcaacgcgatggctgggtgccagagggaaggccttccgctgttttgaacactgatgctaagctctagaataactgtagctgcagcctgttggacctgggcatgtgtcaggcagggtgtgaaatgctccccaagcacgacctcatttctccctcacgttacccctgtggattaatcggggctctagagagacaccaccaacaggttatcagcaaagatagatgagaggggatttattaggggaattagagggtgaaaagtctcaggacaggctgtctgcaagctggagcccctgggatgccaggagcgtgactcaggtcacaaccaaaaacctcagaactagggaagtggatggtgtaattctcagtataaaaggagcctgaagttctggtgttcaagggcaggaaaagaagaatcccagctccaagagagaaagggaggaaagtgcctttcctttgccctgtttcttctatctgggccctcagagaattggatggggcctgtctctattgaagacatcttccccactctgtccaccagctcacgccaatcttcccaagaatacctgtgcaggctcacctagaaacaatgctttactaattcctgacgtattccttaaggcagtcacgttgacacctgaaattaaccatcacaccctgtaaaatgggtagtgtccccactggacaaatgagacagacagtttgggtacctttcttatactgcttataggttatagagccaggattaaaactcaggtctgcaaagaccaaattctaaactccaccctcttaaggactgctgctcaacactgtggaagcagtactgcattagacactgtacgaggattgaagaggcattcgagacacatcccctgctttagggaccacatcttagcttgcattcatgacaggagtcatgtttctgtgactctactatagaccccggaaccaagtgtgaattggtacgctttaggtgtgcatacgctctgcagaaatcctaagaaagagccagataattataggctcgattcatatagggaagtttttatgaaaacagcttttagccaattcctgaaagaaaatatttttactggcagaaaaatgttctgctagagaataactagttgaagggctttgggggaaggggctctggacacatgtccacggaagtggggaaaaaagacacacagaatagaaacagaattggggacccttcaggaagagaagtaaggaaaagtgctagcccagtaagccgatatgtaattttgaatcttaactagattgagaatttggatacaactcaaaactagaaaagagtaattgcactaaaaaaaaatggcgcagagcagggtaaattaaaataaaaattcattaataatgaattaaattattcattcaacaaacatttattgggcaccttccatggtccaggtagagggctacatgctaatcaaaaaataataatcgctgccaggactgagcaatgcctgtgagtcatccttagactggtgctggaagatagatggggctgtcttattccatcctgagtttacaagagatgaccctgaggaccagccaggctaaataaccttttccagatcacctagtacttgaaccgaagcttgtctgactccaaagcccacacgttctctgatacgccatgcagccagaaaagggcagtgaagtactaaggtttgctaaggtgttgagtatatggaataagatactcaggagtatttttaaacttgtggtaaaacacacacgacacgacatatacactcttaacaaatgttgaggtgcatggtacggtattgttaactatatgcccattgtcctacagtggatccttacaactttctgggatggttaatattgtcaacttggttgggttgaaggatgtaaagtattgttccctggtgtgtctgtgagggtgttgacaaaggagattaacatttgagtcagtgcactgggagaggcagaccaaccctcagtctgggtgggcaccatccagtcagctgccagcgtggctagaataaagcaggcaggaggtgggagaagccgacttgctgagtcttctggcctccatgtttctcctgtgccagaagcttcctcgaacatcagactccaagttcttcagcttttggactcttggacttacaccagtgtttcgccaggggctctctggcctttggccacagacagactgaaggctgcgctgtgggcttccctacttttgaggttttaggacttggactggcttcctggctcctcagcttatagacgggctattatgggacttcaccttgcgatcatgtgagtcaatactccttagtaaactcccttcatatatgcatctatcctattagttctgtccctctagagaacactaatacactttctcgtcttgtatgactgaaactccatgcccattgcacctcaattccccattttcccctcccccagcccctagcaatgaccattctactttctgtgagtttaactattttagatatttcataaaagtagaattgggcagcatttgtccttctgtgactggcttgtttcacttaagcatgatgtcctcaggtccatctgtcctgtaggagtggtttctgacatcctacaaagtgagagggttttgaaacttgtgagacatgcacaaaggtggagagactactatagtgatcaccatgttttcatcatgcagctccaaccactacaaaagtcagctaattccatttcacctgttaccctctccaaacctgacctatcccctgcccaactcagttattttaaagcaagtcctagattactttttaagtaaactgacttgggcgtgtttaagaatttgcctcaagtcagatggttttgattttttaattttttcctggtgacaacagtaatccaagattgagtaacaattattcaagccttacagaagcacacagagagtaacattttatagatgttacattttatagatcctcagtgaggatctatattagctatgtgatatatgccactgtaaagctctttcccaccctgtccatgtgctaatgttgacctcacaatgttgtgagcttacgttgctctctaacgctgttcacttaacagtatagccagacaatgatttcatcatggaactgaagctgaagatgctgttccaacctctgcctgttacccagttccaatgtcgcttccacatttttcaggtaactattcagcaactccccactctattggtaccaatttaccatattagtccattttcatgctgctgataaagacatacccgagactgggaagaaacagagatttaattggatttacagttccacatggccggggaggcctcagaatcatggcaggaggtgaaaggcacttcttacatggcagcagcaagagaaaatgaggaagatgcaaaagcggaaacccctaataaaaccatcaaatctcatgagacttattcactatcatgagaatagcacgggaaaaactggcccccatgattcaattacctccctctgagtccctccaacaacaggtgggaattctgggagatacaattcaagttgagatttggatggggacacagccaaaccatatcaggtattatatatataacataagaaatacatgtttagtctctggccctcagttccttgcaccggaacttgccaggaatgcctaacaacctctaggtagaggtgctaggagaatcttttgttctaatattttgtatttgaccctcagttcctgacacagagcctttaagtccctaggaatgttttgggtgataggagcatcttttgttctcctggtgggctcctgaacagcctcacgatggaagcagattgccagggaaaccaaccatgtcattagagggttagagctccctctaggaaggggagagcaactgaaggttgagttgatcacttgtcttagtccattcagggtggtataacaaaataccttgctggaggaggaagaagatgaaggaggagaggagaaaaataagaagaaaagagggatgagaagggagaagaagaaagagaaggaggaggagaaggaagaagaaaaggaagagtggaagaggaaggaggataagatgaagatgacaaggaggaggaaaaatagaatcttaagagacattaacaaatgactatctctaagtgacaacattatagtaacttttactgttttttattttcaagatttccaaaatatcattaactattgtcgtaactggtactttataaaattaagagagtgtaacaaagctgaaaccccaaattttgtgaaaagcaagatgcataggagtcaaaagctgctattaggaaaaaaaaaaatagggacagggccccaagcattacatgaggttaatgttggttgttttctgatgaacacaacacaggagaatgtgaggatcaggcttgaggctctacccttactttcagtaataggggacaagaaaatgtctgcatcaaagaatcaaggttaaggataaagaggtttccttttaagcaattctgtgggctcactgcatccccagcaagatccctttatttagtttcaaggcatggaagtgtcaaactgtaagttacctatagtgtaataccactcagactaaatttagaccaggaagcgtagtgcactcaaagcaagtaagcattagtctaaaagtgattgtcctactgacagaagacatgttgttttgctaccttttccccacaaattactgtggtcctgtatatcagttggggagaacggcactattcacttaggacaagtatgaagaaaataattgttaaattgttaaatccttacctttggcacccacccgaagaactgtgcttttacacaaatgaacacgaatgaatacgacttttgaaaacagagcattcttactccaaggtagtgtgttagtaggaaacttagatgatcttgattgtacttcagcaaaggcatgagtgccaggcagatgctgttctgacggctctgtgtggtctgacagctggttgaggtgccattggcattcatttgagatggtcacctgggaaaccgaaattaacatagcatccctgaatcaggtaatcatgcaccatcctttaccaggtagccactttgggtttgaaccaaaaaaagatgagcttgaaaggtgtggagcctgtagtagtgttacttgaaaaagaccttgtcctttatctagttttgttggcacaagaaaataagcatatttcttgttagatctctttttacgctagctatcaggaggatagttaaactcttcatgcagcatgacaaagatttttttcagacatatttcagatagctgagattcctttctttgacacacacacacacacacacacaaacaagtatacaaagcatatacttgtatatattttaattttatacttttgattcctattatgttaaatcttggaaatttttcaaaaagcattttaaattatttagctgttatttttgttttaatactgttattaaacaatttctgttgtaaacacattttcttatctccaaagatagcacacacttagtcaatgtttcttatcttcttggtcatcttctcctcttccaaatgttgaactctcccaagaccccattcctgacacctgtttttcctccagctcttctgcctctgcagacaatgttatccattcccatggttgtgtatagcgtttatatcacgatgaccccaaattcttatctcctgttctgacttctcctctaaagtcctaaatcctaaatctaactgcctaattcgtatctacatttggatgcctacaaggcaactcaaaatcagcacgtccaaaataaagctattggttctagatcctacacaaactccagctctcttcttcagtttctgtgtctcagtgaacagcatgtgcacccaggcatatacacgtgattcctgtctttccctcatctcacatccattaacaggctgtattaataactcttgtcagctctggttttatattatattccacatctgttcaattttcttcatttccactagtgtcaccttattccatgcagccatcatctttcatcttcgttcttgcaagagtttcctaaatggtcttccagacaccattagctgaaaattcccatactttgggttataaaatattattccttggatcaaaattctccagcacttccaaacatactttaaaatggaagcgaaactcttacctagccgagaagttcttatgtgactcgggcttatgcccttctgcaacctcattccctctcactctcctctcagtcatgattccttcagttctgttagctcaatgttttagttccttaaacactcaaagctaacattcaggcctgaacactcaggctaaacactcaggcctacagcctgttttagaagctgctccctctgcctggaataatcttccccagtatcttcatatgtctgagttcttctcgtcttttagattgcaatttatatatctactccaaaaaaaaaaagaaagaagccagccctgacactacaaaatgaagccatctaccagtcagtcttcctaacatttacctgacatatttttttcgtgtcacttattacttactatttacttgactttgaataagtcatctttttacatttcatattctctgactttaaaaagagcatatttcataaagttgatttgagtattaaaggagttaatacacatcaagtgctgagagtaaatattcacagaagcaatcaatttattcttccacacagcagtcagtaaatgttggtggactagtattaactatcatattattcaggatatgaactaacttgttttaaattgcagacgataagtattaattctgccatgaagtgcccgtatccaattttcaaatcaccattgctgccttcacactcaagcaggtcagatggcaaaagccctaaaagtgtatagctaaaattactacacaatgacactataaccgttcttgcatgtgtctttggtaaacacatgtacccacttaggttggatatttacctaggaatgaaaatactgggtcgtagagcatgcatgtattcagcttgtagatacttctgaacagtttcccaaagttctttttccaaaatacacatttatactatattttaggtatagtcaaaagattttcaaattagctatcataaaaaaaattatctgagaatataatccatgtgacaaaacatattcctattagctcaaaagattattataattagaaagaaatatatcagcataaaaatgatataggaattacaaattatatatcactctacatttgtaatgcctatatcactgtttggaatatctcattattttaattgtaaccaattactccagttggaagcgtcacagcaagcagtattatatattttaggaataaattgaatatatcatccaatatctcatcctaacttcctactctttcatttattaaagcgtcaaagttcccattaatgctcataagaattttgaatccacataaatatataattaagctgaaggtgaatatctttcaggtggatttaccagcaagtatgaatgttaaaatgatagctaatatacatttctacttttaatttattcagtgcagttatgatactgctacaatactcatattgttgtgccatctataaggtttaaaaataattaacatgaagatgatgttctataattgttttattggtttttttattgtgtgcaaatctaatattgcctcactattgactccctatataaacaaactattttccaattccttacagtagacaaatatgcttattcaataagagaaatgaatatattgaaaacaattttgaataataatatcttgtatcttaagacacaacttcaaatattgtggcataaaaattgaatctaataatgtgcctttctagtggactttactatcaaaataaaaattcttagagttaaccttctatggtttggagatagcgctatcataaactttgttactttgttgtgtttttttaagactctttccccagtctacggacacaacatatttaatctgagttgtatgtgatgtgtggtgtggttaatttattgccccggtttacgtaaagtgtgttaattatatttaatttggcattttactttcactgtctaatcagattctaactatagaaattgacaacttgtggctaaattcattctcttcttgtgtttccaattgtgttttcattgggctcctcctttgtgtcattttttgtatgtcttttgatttggtcttactaatttacctggacgaaggagtaaatcctacaaaagtacaaatacatttatcatggtctttatattgggagaactaatcaattgggcttcattttttagaatttgtgtttttcttatgcaatatgggtttagaagtggatagaaaataaacccatttggaacatatacgaagcccagtgttggtctaaacttcctcacaggttacttgagtcctgatccatcacaaatacaaacacatttaaaaacataaagcattattacaatggaatcaaaataccatgactaaatccattttcccatcacaatgtcatttcttagatgaatacaaacaatgttcatattaaatagccatttctatcatggatatgagtttctggtgacttgtctttgcataataaaaagatctcatttttacataagcaaaacgagcaccataactttgcataatttatgtttgtatcttggctttgctgagagttagatacaatggaaggaacaagggcatcgaaaccaggcaaatgtgagttctaaaccaagctctgacatgtgacttcaaattgatcaccataccattctgagctgtggctccatcttatgcaggatggagacaacaataccttgaaaaaatatttgtaaggcacttagcagaccataaggtgagttgcccctcgaaatgcttgtagcaatttacaaccttccattaccatttgataattccactgaattctctaccccactgcccatatccaaccagctgttaagctgttgctatttgatctggaataaagtcaaaagtggctgtatggctttgaatgcccaggtggcaaggtggtatattagtcagttaaggctgctataatgaaatatcataaactgggtcgcttataaacagcagacatttatttctcacagttttggaggctggaactccaagatcaaggcatggcagattctgtgtctgctggactaaattcctggttcacagagatggtgccttcttgttataccctcacagggtggaaggggcaagggagttctctggggtcccttttataagggcactaatcgcattcatgaagacattaccttcatgacctaatcaactctcaaagcccccaactcctaatactatctggtgggagttaggatttctttttcttttctttttgtttttttttgttgttgtagtttctttgagacagagtctcttggttgcccaggttggagtgcagtgccaagatcatggctcactgcagcctcaacctcccatgctcaagtgatcttcctgcctcagctcccccaagtagcttggactgcaggcacgcgcctcctcacctgggtaatttttgtatttttagtagagacagagtttcaccatgtttcccaggatggtcttgaactccagagttcaagcgatccacccgccttggcctcccaaactgttaggattacagacatgagccactgcacctagccagaggttaggatttcaagaaaggaattttggtgacataaacattcagtctgttgcagtgggtgataaaagatgatgctgacagtcttgcagggtctattttatggagaccccaagtgtcgtatttaattaaagctagtctttactctaaagggcaaaggcctttgaatgtgctcttcctttgtctggatgttctgctattctgcattcatccatttcctccctattctcctctctggattatcacatacgtaatgccaactcctatttcaaggaaacaacacatcttttccaagatggaagctttttaaaaaaaattttctgccacatttcatctgctccatttcaaattgctggttcctgatagatgccactttcttcatgaagtttgacttgcacctgtaactgatttagggactgtattagtccattctcacactgctatgaagaactacctagacttggtaatttatgaagaagaaaggtttaattgactcacagttccacaggctgtaaaggaagcacggctgggagccctcagaaaacttacaatcatggcagagggtgaaggggaagcaagcacgtcttaccatggcagaggaggagagagagagagacagagtgaaggtggaagtgctacacagttttaaacaaccagatcttgtgagaactcatcactatcatgagaacagcaaggggaaatccactctcatgatccaatcaccttccacagggtccctgtccccacattgggaattacaattcgacatgagatttgggcaggaatacagagccaaaccatatcagcgacctttcaggtgaactcacatgtacttacgtcttcagacattcatcatatgacgttgtagaagcttttgcaaatgtgtctgtttctccccatatgcctgcatcccaataaagacagggatggctttgccgttgctcaccatcatattcccataattctaccctcctctccagttagttctcactattctcacttccaagaccccagtcccaccagccttggactttctcttgactaatttactctcctatttgaggactcaagtatcattctttataggtacaagccctgacaaatactgattggatggcacaagaaagtgagaagtattatatataaaggacacagaggcgttttggccacacttggcacaagccctggtcacaacatagtctatagttgtttctgccattgctgcttagaattcatttcatttttcttccatttccttttcagtgagttttctagtttcccccaaaagacttatttaatcatggacattggagtacttaattaatttctattaagcatggtttcaaaatatctaacacttacatgcagggtccactgctttccttcactgacttccctggtgaatattgagctatttacctacagagcaggaaatacacatggtctcattaatctctactctgcctaacccaaacctactcccccgcaaactcaatgtgaaacagattgagtattcactctcatatattatttggagagtaccattgatttatacaactcttcctcggtcagaagggtagtgattcattggcccaatactcaatttaactgcagggaaagtttctatttgttgagaataccatttcccaatgcatacaactgttacaggggggttcatctggtttagccacaaaaggactctctgcaggtgtaacaatctgaaacataggaggactattttgggaatattgtctaagaatagggtaatagttcaaaataaattgaaacaattattaaagtgaaaacatttaccctaagtcagaaattatgctattaccaatgtgaagaaatttaaaggcaatatggaccatatctccagacttttcaacaataatgataaacaaagacacacgattaattcagaactaccacccagtctctaagtaatttttctattagacaagtgcctacttcttgctaagcagttcgcagcacacttttattattgttttcttgtgtgcatatcttaaatattgatattagctcacctaacttcctaaaattatatgaacactcaaaatctctactcatattttatgttttttaaagtttaactaaaaaaaataaaataaatatagtttagagaaaacaataccttagtgccaaaatcttaaaacctttggtaaagaaagggctaagagcagtttaggaattctttttcttgttttactggggacgccaagggaaagaaagaaagatgacttgggcaatttacctgtaagcttgcaaatgtcagaccccttggaaaacactataattttatctcttagtgggagataccattaccaagtttttatgatccacttttagcagactgttgtaactggcctggttagtattgtttatagacttagggacatggatttctgaaaaatgttacataaactatgtaactgagtctaattggaaatgtctcatgaaagaagcaactcccttctgcatgaaaggtgctctcacaagcactacttagagaactcatagttggaacccagagtcagaacgtgtcctaatgaaagaagaaaggattcaaggaggagtgtggatggtcccaaactttgttttggctgtgtgaaattattagtagcatttgccactgggcaagatttcagagtgaggctcatttagtagtccaatatgtctaagctctatgctgattttattttagaagatgttccttacttttgtccctatttattttatattttaatattttatgccatagcattcactatctttgacatattcgtttgtaaagatggaaggctcaaaatcaatgtactaagcatctaacatcagaagaaaaaaaagaagaaatagtagagatatgctcctttaaggatagttttcctctttcttctgagtctcttgttttttaatctctattttgtttgcctcagtctatacatcatgttaaaacctatgtcaactatttggtcttcctggactgctcattccatgttgagagagacacactaaaatgtcagttggtagctcctgttttctaatggtgacctttatggtacaataactcactagaaaccttgctatttcacaagatgaccatcactctcagcatctaaatttttttcctttgggttggtcaatttcttgagagaggaattctggctgttagcagttggtgaacagaggaaaaaaatcaattaatgattgtgtataaagaatttaacctaattcagacttgcaaggttaagaatgtttactttgaaaaaaaaatcaataatcatgttgatatggaattttgcactaaaaatgcttgagggtggcagccaataaagcaattccttcaaaaaactatgagaaagttattctccacctagaacattacacaatgccaggtaaagttaccaatcaaatctgagcatacaatacaaatatcttcacatatttaaagtccgaaaaatgtatcatcttttctgaggaaattactaaagggtatgctttaccaaaacagaaaaggactgagagtaaagaagtcatagtgccaacacaagagagaaactaaagaaactacaggagcaatggtgataagaaattccaatatcaaagctatgcagcatgtccagaggcagtgagttcagtggttcaagaacatacagatgtttttggttattttgaaaacagatgtatatttctgtgggagaggcagagacaattcaagaagagctatataaaaattagacaagtaaacaaaaggcaattactaactccaaggaaaaccaaagagatgtactagaagggaatgcaatcattgttcatcatatggtttgaccgtgaataattgaaatatagccttaataacataagcaaagtatacttgatttagccaattcctgtgttcattatcggtggagagggagtgaaagaagcaaaatggtagcggaagtgataagagagataaatcaataagtaataggtggataatatctaaatccaaaaaaaaaaccataagcttgctattcaaaaaaaggaagtaaatatcttgagaaaacaactaaaatagttaaaaatgcgtgcatttgcaatgccagaaatggagaagagtgatggaaagaactactggtttttattgtagtccaattaggacaatttcattaaaatatgcatacataaataatattacatatatatataatttcatttatgttgaaattaagcatttttacaaaattaaaggttgtgactgccctgagattttttcccctatattgctaaaggaatacacgcattgttacatgcaaatgtcagtttaatttgcataatctttaaacatttttcaacctctaagttttggtattattgggcaaggctgtgtcctttcattctagataaacttctcctttgtggagaaaatctgtcaaaatctggcccattctttctcagatttcattcaaccctcttctcccatttccttcaccttggccatgatgaaaccgtccccaatattttttatgctctgcaccttttaatatcaaattccttcacctgcccccagtagaataaaaaacttggaataagtttttttctaagtttttaattcttcaagaccaattaaaactaaggctcctttcagatgaggcagtcaattcccctattaccttcctctgcccacaatactttatttccattctttctcctttctcctgagaaagaatagttatttattcacatgacactctttctgaaccaagatgttcaaaggtagagaccgtgtcttattcctctttacatcctttgggctggactagcacactagctggctcccagcagaaatgcaggcaatgaacacattgtgagtaagttagtggggggatgaccagcaaaggtgcagtgtaagtgtaagtcattcttcctcttctgcatgtaaaatctgccaggagcgactgaatgcagcgtcccaaaacaaatatcaaaaactaacctacaacaatccaaaccattgttcgaatactaaatttttatgaaccacagaagtgaattagctcctttatcaatttgcaaaacattcaattttatgtacaaatataatatcattataatgagatagtttcacaggaactgtctctcagcagaataaaattgttgctagaaaggaaatcaaacaaaatattataagatgtgtgtttgttcactcggaatgaactttctgaaatacttctcttgaaatatcatttatatctcacacttaatttgtctatgccgtctcgttacatattattcagatgaaatatcaataatagaagttgtttctgaattttacagagaaattatgtgcaaagttctttgagttaatcgtgagctatttttaaacttctgactgttaatgtccagaagggaatgctaagttgcagtattttctaaacagtgtccacatgtttacatggaattttggcttctcttcacctatcactcaatgctgaattgttacccttctgtcttcagaaaagatgaatggaaagaaaggacagagagtccaatatttctgtgaaatctctgaccagaagtgccgattcttcacttattttattttttatttttttagagacaaggtgttgctctgtcacccaggctggagtgcagtagtgtgattatagttcaacgcagccttgaactcttggattcaagcaatcctcccacctcaccctcccaagtagctggaactacaggtgtatgccaccacacccaggtaatattttaaaatttttgtagagatgagggtctcaccatgtttcccatgctgatctcacactctgggccttaagtgatcctcctgcctcagcctcccaaagctctgggattacagacatgagatactgcaccaatcctccccttatttttagatactcagcatccaatacactacttgtgtgttgcatggtatatccttgatacttattttaatgaataaatgcactaaaggaatgtgcaatctctacagatgaagaaaacccagtgatattaaacatgttattagttgttataaactgtattttatatccccataaaatcatatgttaaatctctaacccccagtggctgatatttggaggtgggggcctttgggaggtgatgagatcataagggtggtgccctcaggatggcgttagtgcccttataagaagagacacaaagtagcttccttcttcttttccttctttccaacatgtgaggacaaatagagaggacagccgtctacaaaccaggaagtgggttcttttcatcagatcttgagtgtgctggcatctcaatcttggacttcccagtctccagaactgtgaggaaaaattatttgttatttaagccactctgtctgtgacttgttatagcagcctgtactgaccaagacatactaacaaattatgaataggtaaaacacagatgatttctttttcttctttttactttttgtatttctgtatattactaaaagttcttaaaaatcctctgaggaccctctactcaaattgtggcaaaaagaccagctgcatcatggatatcacctgggcacctgttaggaacacaaatcctcagtcggctctccaggtctactgaatatgaatctgcattttaacaagatcccctggtgttttagatgcaaaattcagtttgagaagtactattttaaaagagtttgctgtaataactcgtaaaatgaatctctccatttttaaaaaaagtacctgatattgccattaactttttcttttcttaatgtaaatcccaagtattgagaaatacttggggaagggtattactgcctacttgactgagccattgagaagttcatttttcatacaaccttgatgatggtgaaacacccagccatttggttgcctggggggagggtattctggggagaggaagtggaagcaggtattgcccatgccttagaagggcaattggagtgttcaaggatcagcaagaagcttattttggccggattagaatgataaagggagaaagagtaataaagtggtgggagggaagtcatgtggggccttgcagatctttgtaaggacattgatgtttactgccagggaaatggggaattcctggaaagctggagcagacagaggctggcatgatacattctatcatagaacagtgtctctctgcctatgtgttaatagtagtctacaaggggaaacattggaatcaggaatccagctaaaatgtgaatgctgtgcctccagggtacaatggagatggcttagagaaggtaggagagaaagtgggaagaagtggtcagattctgcttgtacttggaagacagactctataagatttcctgaaagatcagatgtaggttgggaaggacagaaagagctcaaaaataattcctgagtcttcaattgagtcattgacattaattaacatggaaaacactgcaagggaagaagggatttttactttcttctttttccatttttgttttgttttgttttgttttaatttttggttgtggtgatgacttctggttttgacatgttagattgaggtgaatattagcaactgtgtagaactattaaggaagagttggatgcacaaaattagagttcaggtgagaggtacaaattggagataaaaattttgttaccagcagacaaataggatttcaagtcattagtctagataagaccaggatgggactgtgtatagatatgaaaatggaaacattcaaagggtaaggctggaccacaataacatttaaaggttgcgtagataaggataaatcaataaaggagtctgggaagaaacaacaggggaggtagaaggaaaagaacaggagtgtgaggcatccacaccaagaaaacttcctaaggtaagaagagagatgatgactgtcaaataaatgatgctgtaggtccagtcagctgaggtttgaggttggcattgcatggagcaatgtgaagatcattggtgattgagaaaaacagcatattcactggtcagttgtgaagaaaacctggtttagaagaagaaattgggataagaaagagatttatttgcttccttccttccttccttcttcttttcctttcctttcctttccttttcctttcctttcctttcctttccttccttccctccctccctctctctctctccctccttcctcctctccctccctcctcccctcctgcccccttcctctctcccttccttctttcctcccttcctaccttcctctcttccttccttcctgcctgcctgcctgcctgactgtctttcttcctgttagtattgtagagttctggcttgcttccaaatgtagtgatctagtccttggtgacaagctgataatgacagagagagggagacttgtcaaagggatagagaggtccactctggtgtgaacgtggggtgctttcattagatgggagcaaagatggtttgaaatcacaagagtgaaggaaagaatgtgtgggcatgatggcatgtaggtgggtagagtggaggtcagagcttgtgtaatctccctactgatggtttggattttcctagtaaaatgggaagcaaggtcatgcatggaaagtgaggataggagagagaacgtatcacagtattggacatttctgaggagacaggaacaggtgagaaataagactttaggtctgtgctattcagaatgtggtctatagaccaccagcatcagcctgacttgggagcttgttagaaatgaagaatcgccccaaaacaaacaaaccagaatctgcactttattaagatctccaagtgatttcaaagccagcttttctcaaatttgcacactggaatgaatcaagactattctaaaaatctgcatgcccaggtcacacccaagaccaatttcataacaatattctggggattgagaccccagcatcagtagtttttaaaactacctaggtgatgttaacatgaaatcaattttgatgaccgaatgctctgggtatttaagcaagtaaataaactcgggatagcccccttgaggataatgatccttctttaaagataccagtcttctaggctgtgaatttttctccagctatatatggctgttcaggtgcaggtgtggaagaggcaatgaagtggatttaatgaaggctgagattctgccaagcaactgagaacagcagatgatgttccacttgctgtcccgccttctctcccacccacaattctcctttccaactagaacagctccctttgtatctgttctacattttagctttctgaaaaagagttaaaagcaagtgtgcaagagttaaatgcactgaaatgtatgatgcctttcccctctgtattcatcagatcaagtgtctgacaatacaatgggctcccgctgtgtatgagtgtgtgcacatgcaaggcataagattgatttttttttatttaagctagaatatactcattagtaaatctgtgtgaccccagagtcttgaatatcatttccttttttttgttttgcctttccatttcttcctttgttgatttatacacatttccaacttttctttaattcttcatttaattttgataatttgtattttctaatgatatttctctaaaattttccaatttgtcttagggatttgtacgtagtgttgccttagaatcatttaatatcttttctctgtcctattcaatttgtcaggtctaatttttaaattttctctttttttgcctttttgttgtattttatagagttttgtctatcttgctcattgatttaaagactaattttctggtcttatgtatttcagttttctctttttatgaaatataaacatacataagactaacatttattatagacaaattagactgatctgtaggaaaaggcaaaactagtcatcagagacaacctaggcatattttaaaatgttaattatatttattattttctttttcaaaatttgttttaagtttttgtagatatacagtaggtgtatatattcataggtacatgagatattttggtataggcatgcaatgcatcataatcacattatggaaaattaggtatccatcccctcaagcatttatcctttgtgttacaagcaagattattttagttattttaaaatgcataattaaattattgactatagtcactctgttgtgctgtcaaatattaggtcttattcattttttctttttttttcttttttttttttttggaacagagtcttgctctgtctcccgggctggagtgcagtggcacaatctgggctcactgcaagctccgcctcccgggttcatgccattctcccgcctcagcctcccgagtagctgggactacaggcacccgccaccgcgcccagctaattttttgtatttttagtagagacggggttccaccatgatagccaggatgtctcgatctcctgacctcgtgatccgcccgcctcggcctcccatagtgctgggattattcatcttttctaactattttttggtactcactaaccatccccattttcccctaccccccaactacccttcccagcctgtggtaaccctccttctactctctatcttcatgagttcaattgttttaattttcagatcccacaaataaataagaacatgtgatagttatctttctgtgcctggcttatttcacataacataatgacctccagttccatcaatgttgttgcaaatgaaaagagctgattcttttttatggccaaatagtactccattgtgaataaatcccacattttctttatccttacatctattggtggacagttagtctatgcatattcaatagctctctgtaaagatgcttctatgcatttatgtacagactctgcctgcctatttgtatttaaaatggtctcatatgacagtcttgattatatccttgacttattcttagtttgacagtatagagagtaatcaaggtggggatggagttacggagactgggattcaaatgctcactctgctactgctttgtgagattaaatgtagagtattttttatccactctgatgatctttcttcccacatattttctgtagaaagcagagatgatcacacctacctcacaaggatgatgagagtattgtgattgcaagtacttaccacctcaagaaatttacaccagtgtcaatggccatgttttgatctttattattgtaagcaaattgtttttcagtccctcagtatgcattttgtgtatttatatcatattttttacatgtttcagaagtactttcggtggattaaaggattgaaaaggatttaaataaataacactcctaaaatataatagccaacatgataaacaatactcaatattcaaatgtcatttttgcatagatgaaaaattctattgttttaatgtgaatttacttaaaccctttagggttaaatatttattcttcaatgatatggaagaagaatatacccatgaaacgtggataagtccatgtagctcctttcaaagcagattcttggagagaattaatccctccagcaatgacttttcttctctgcatctgccactactagttctaaaaaacattattaaaattatttttatattgtatggttgaggtaaagacccttcattaagaaagactaaatgagaaaaattaattcaacttcattcactatatttaagatgaattttccttaaacatgtttttggcaaatttggcaaactgggcatatgcaaaagcaataatttgccttaggagaattttgcattagatgaaccaaattgtgaaaagtcagttatccaataagtagagtttatgccacacagtataatatatagtgatctttatgattttcttacattttccttgtttattttttgctttcttgtgtcaggagcagagaaataggttatatcttcagctgtcacatttattttaatttgccatttatggtttcctttcaaagattcaggttttctcctaactcattaattcacacatttatttatattagttcactgtgcttttgagttttgtccagttttcttttcctatttgtagccaagtaagttgaaagaatagtgaatgtatttttgtttctttgtttaacgtagaaaacttttgtgagtatgaacttgcctctgcatacacattaaccatattctgtgcacttcaatatttagtaatttctgatcatcaatgccaccaagtgccactgtcctgtttgcccaacacgctccagtttcagcatgcttctaaatggacatagttgctatttccttttcctctttaaccctatttatttatttaaaaatatttatttgttgatgcactgaacaagatacagtagataagattggggaaatagtcaaaatctaaataaatgcatgaataaaaagatgctttacaattaagacagtgtgatattagcaaaagaacagacaaatcgatgaaggaaacagcatagagagcttaggaattgagccccatagacacagccaaatgttctttgacaaagtagcaaaggcaatgcaatggagaaaagatagtctttcaacataatgcattcgtcaagactcatagaatgtacaacaccgagagtgaaccctaaagtgtgggctttggatgataataatatgtcaatgttggggtggctgggcatgtgtcagggcaggaggtatagggaactctattttctgtacaactttgctgtgaacctaaaactattctaaacaatttaaaaagatacttcagataagagtttttgaaggaaatggctgaggttagtatagtatgataggaaagaaggggagggggcaaattttaataggctctgggcttcctctctgagggtaattaacatcctcttatttgggtaagtgaagctaatttcccagttgtcagagtttgctgctgctcttgtggggacagtaatatcattgctaccaaatgttatcaaattttgcgtatgtgtgtatttccatgtgtttaggtgaaagaatattttcaaaattattattattattttaaagcttagtataaattatttattgcctaacatgatccttttggggaagcaacatgtatatacttgctaaaacggaaagagcactttaattaatttgcatctattaaccaacattattggtcatattgctcaaattctccacatttttatgtatttctgctgacttgttctgtcaatttctgctgacttgttctgtcaatgacagaaaaagtatgtcaaacaatttagtatctttgtacttcaaaaaacatgttgtgagtgcatttcagatacacatggatgctttatcattcacctcataaatattcatgatgggaatagctccattgacattttatcttaattgaagagtgctttcaaattttgtccttgacatattttagtatcaaatgtttgagcaaatcaaactttgttccattttagaggtttttgttttgttttgtcttatttttaactttctttagtcatatgaattaggcaaagacttgaaacattcatttttatatgatttctataaagatgaaactaagtcaaattacttaaaaccaatttcagattgtgaaaacaaaatataaagacttcttagtaacctttcctagggtgatttaaacaattcaaatatcaaccaaaacactaaatgcagttgttatcattcgatgtatattaattttgacagcaagttgatgagataatccagttcgacttttaaaaagagaaaactagacaaagagaaaacatattggcatgcacattccttggttgaaatactgatatttactttatattcaaagtgctttcagtgtctgatcaaatcatggtttccattttactatctcatgcgcttcaaccttagagatcattgtatcatgacgtgtcttgtttggttgtatccatttatgtatttcacttggcacattggtacgtgttaatatgcatatttttagaatccacacagcaacgcagtaatgggtgtggtcaagtaaaaagaataattctttcagggtggaatcaccatttgtacaatgcagctgtattggaacttctttgaaacccacagcacacagctgagatagtccaatttttaaaaagaaatttactataccaattttgcaagctcaagattttagaataatttgaaaagctttgagttctactcattgcttattgtcattgctggcttaaatttatttcccatctagatagaaataaaaggtaaaaagcttaattattttgcatcatatttcattattttcttttgttagtggtaatgaaatgaaacacatgtctgaagttcacagaaagactccttggtaatgactttctttaggcatcattgagttttttcatttaatcaataattttattattttatgcagtgctttgcaaagcattcccttctgtgggtttacatatacatggatacacaaccagtctgtggttttaaaacattaattcctgtcaaaactatttatgtaatttttaaatattataaatccccatgtttacttcttattggcatgctgtctttattatattatggaatattattatttagacctgaagttttgacaaatgacgcaaacaaatctattgattcattccgttacattataggaaaagtccctgttggtagcaacgccgctgagcttcaaaacagtggccttgtcaggtaatacaagccgtggcattttcttcgcctcttttgacacatggtgtaggatagtatgcaaattggtacaattctacagggctggaggacaaaagcaaaaatcaagattaagcagggacatttcccccatgtatattgctaatacccacctaaaggtaatacaagacattaacggattatgtgaaatctccacttgtaaaattttttaaaaatttaaggggaaatgtgcttttagtttctctgacttttgtcagaaacttttcacctaagtaaagttgctcttttacttcttgaaatgtttcttgtatttatgctgagtgagtttgactagtttgccagcagctccatctacctcctgaagcaacatttgaagatgtttcttgcttttataagaatatatgcttatatacaaaggtatgctttctctctgtgataatccctcatccctcataccacttgataccacttgtaaatgcatacatatatatacatatatatatatttttttttttgagacagagtctcgctctgtgtcccaggctgaagtgcagtggctcaatctcccctcactgcaagctctgcctttcgggttcatgccattctcctgcctcagcctcccgagcagctgggactacaggcgcccgccaccacgcccagctaattttttgacagggtttcaccgtgttagccaggatggtctcaatctcctgacctcatgatctgctcgcttcggcctcccaaagtgctgggattacaggcgtgagccaccgtgcccagcctacatatattttttcaaacaaacaaaagctttagagttctgcaggctcacaaaaacctccgctgttatgaatcatgttatatttgaaagaattttaaacctatttttcagttcagttcttctcctgtggttcttatgccaaggtgacttcaagagtaatatctacatggctaatcaagttctgaaatagagattgattggtgttttggtccccacatgtccacatggcattttccttgacaaatctacaaaggcactgataggattatgggtcatggataaaggaaaccaggtctgttgtggttggtgcatctgcttgggggaagagcctgaatccagtatttttgtaggaaaggaaaccgacatttcctatgccgccatcactccctgtgtaggcaatcctcttagcaacttcaagtaaattttgtactcatttggctgataaatacatttgagttcaggaggttaagtgacttgtaagtggctgagattaggatttggtttgtctgggctcttgtgactgctccctctcttattttctgtgggagaataaatatgattaattgggtaacccatatgaccggcctgtttgtagcaactggcagacaaaccattgaaacatatctcttcatataggaaaactagagaggatggagataaagacataaaaatagcatagacattttagaaatctggatgtaaaagaggaatagacacacaaggcgagatgatgtttgattatgatacagaacagattcctaaaacacttaaatgtaattaaagatataaaaaggatagaacagaacataaaaaagttatgaatatacagcactataattagttgcttctttttgagacacagcactagtttcagacttgtccattaaaaaggaaaaaagagagaaggctgcttctgaagacaaagacaatttaaatgcagagcttggcaggtggctgccattgaggaaggaaaaacagttaggatagccttcgagaagatcctccaagtgatcaaatattgtctagagtgctagggaactttcacaattttattggcaatttaatataattcaatcgcagtctacatcatcaagacttagtatattcagttctattttgcagagagtaatgaatctgaaatttatgtttggcagtacactccagaaagtaacatttcccttgatgcatctgctctgataatttgctcatttaactatacaaatgacactgcaactgacctggaaagccagttatacaagattccaacacagcagagaccctgcaagcttctaagactttctcccactttcaaatgtcacaaagacagattcttaagagtgtttctgaaaaaaatagcaccttggaattggtccatcttcaattaaatgatggtggtgatcatccctatgaagttttgaaagtcacatctcttcttcaagaaggcattttgtgaaaggaaaccaggatcattgtatattgtaaaagaaaaaaaaaatcttaaagatagactccctttcttttgagaaaaaagaaacatgcaattttaaatcttacaaacactactgatttgaacttaatgttgactgtattaaattacaaattttaaaatgtggcttctttttttaattaattaattaatttatgttatttattttgagagggagtctcgctctgtcgcccgggctggagtgcaatggcacgatctcggctctctgcaatctcctcctcccgggttcaagcgattctcctgcctcagcctcccaagtagctgggactaaaggcgcacgctgccacacctggctaattttttgtatgctagtagacacggggtttcaccgtgttgtccaggctggtctcaaactcctgagcgcaggcaatctgtccgcctcagcctcccaaagtgctgggattacaggcatgagccaccgcgcccagccaaaatgtggcttcttttagcccctttaaattaaacttataaatattgtttttatttataaatctagaaaatctataaaataagaacgattcttttcaagggatcatttgaacaatatttgttaaattcaaattgaatagtgtaaataacaaagcagtgatactatctatgttatatgtgtgagaggggcttaatacctacatgatgggttgataggtgccgcaaaccaccatggcacatgattacctgtgtaacaaacctgcacatcatgtatatgtaccccagaacttaaaataaaaataaaaattaaaaaaagagagaaagatcatttacataagtcaagtgtgaaagcagagtttctcccactcagcactactgacatttgtctctggataattctttgtggtgggggctaacccgtgcattggaggatgttgagaaggatccctggtctctactacccactggaagccagtggtagtccgcttccaggtataacaaccaaaaatgactccagacattgtcaaatatcccccagggagtgacactgtcccagttgagaaccactatgttagaattttttcttgtaattctgccattaggaatatttttttccccttttctcatattttttatcctctgaaatcttcctaccctcacctctcagaaaatgtaagctccatgagaaccttgttcatcttgtttaacacacgcagatcctagcaacttcaatacttcttgaatacgtgaatacaaatataatcaaaataaatctgctcatgctctatttgactggataaaggatgtgattagattaataatatatgtaaatctttgtgagttcttcttcagctgtgtattaaatggaattttatttactttggataagtgaactttacaaataatatcaattgttcacacttgccctatctcccctctgcttattgggttacaaattcaactaatagccattgtaggcaaggttgtggagaaataagtaagaaacatattattatatactgtgactgctttgtggtttataaactgggaaaaactacagaatgtcaacatcccttgtcaattgaaaaggaaaaacacaattcacataaactggttgtttggctttgattacttttcaatgggatgttccaataacggaaatgatgtgttcgtacttgtggggaaaaattaatggtggacaagctcatagacttcaaaagaatgcaaattaatttaggcagtttcagggcaggctatactggaaaacaagaatgaagcaaaatgaggtatctgcttttattaagggaggtgctagagcgtgtgaggatgtgagttctaagcttgatctgaagctagacatgggccagactcagcacagaagcaaaaatctcagcaacacctgaaatctaatgtgttattcaagaaagtgtggatccagggactggcagagataaaaacaccaggcaactagtgacaaaggtcagagaaagcaggagtccggtacagagaaactctatcactggagaacagacataggggtagcaggaattcagcttgcttggatgccagagcttaaaccagcatccagatatgggagctaagagtccagcagacttagagaactagaaggggctggtggtaatgtgctcctagtctttttggtcccagtatgagggacttatttccttggaagactccctcaactgggcttctagtagagccatcacatgagaaatgttttgggctacagttgctagcaggcatgctccagcacctcaggctggaccataccctgtccatctcattgtggggttagaggaggcatgtgccatctgttgctattgactaacaggaaacttggtcctgttgtacaggaagcaaggtagggagagaaggaggtaagcagagagggagagaagaaaggagggtgggtgggagaatatgatgggtagttatgtaaagatattacatcattcatggattttacacaatatgcttaagttaaaagtatactttacaaagctgtaaatccagagtgtgtgcagagtcctttcctgtaattgttctgtggatgtcatcatgttttgagatcttcccacaatttttcagacagacttccctagaacaaagcatgccccctcctcctgttgcaatcaatactctagttcctggaacagacaaaatgtgagaagctgtagctcttacagaatgctgtttaataagaatgatttccagtctaaaagtgtgaaattttgggaacttttctatgcatgtaagctattgccagtcttctttgatgacaaactgatatggtttagctgtgtccccacacaaaacttaccttgaattgtagctcccacaaccgcatgtcatgggagggacctggtgggaggtaatagaatcatgggggcgagactttcccgtgcttttctcataatagtgaatgagtctcatgagatctgatggttttataaagggcagttccccttcacatgctgtcttgactgccaccatgtaagatgtgcctttgctcctcttttgccttccaccatgattgtgaggcttccccagccatgtggaactatgagtccattaaatctctttttctttaattacccagtctcgggtatgtttttattagcagtgtgagaatggactaatatacaaacatactcaggtgtcctttgtggagaacaattcttccccaaatctcccgtcaagacagaacctttgtgccactccacttcatgctaaacagtccaattgagagctctgccttgctgtatctatttaagaattcttgccatttcatttgccccccttttaaagtcactttcttctcccagtgctctcctgaagctgctttctctgaggcatcttatgaatttatgctggttacatcattctcacatctttggtatctccaaggaattgaccattctgttccctcccgtttggcatcaaatgagcccactcgattttcctgctacttcccttattatttacctgacaccattggtctctttgtgtcccatgagccctgactgtatttctgtgattccattgctgcaggctcctcctgatcaatcccctcatctggcagttgcttgtctcatttccttccctgcttgcctcttcatgattttgcctgagaaagcttccctgttatattccttgaacttgaatccctgggctggggggagttctgcaagaacctgagacagacaccctgtcttcttagaccccatcattccacccattatcacatcattagactctagctttgcattcactgtcacatctttaggtctatttatttcctcctgaaccactcccttcttccatgaccaccaccaccaccactccactggaaacctcttgcactgtcatagctctatcacctccaggacaacacataccaaattgccatcctcaatgctaacctttctccaaagctcccaattggattattttcaatgaaatgtctacaattcccacatttaatatacataaaagcaaatccatcttctctaggccacactgtctcaaggacttgttgttgttaatcattttcttcctcgtatcttctgcaaatagggtcaaagcagcccactccacagtgctgaggttggagctgggggtagaatggagacgtttaattctggtttacattcatgtgatgcctatacttaaagttatagtgtctcccataagaccgcgatactggggagctcttgcacccagacatctgtccccttcacagggcaagagctccacccaaatccaaacccatatttgtggtgttagccaatcctctctgagtcaaagcagtttgaaagtcccaatatttacctaattcctcttgctttaggcttttctccaaaactactggtctggcaattctttagagtctttgcaaactcttgaatcttttaaagatactttaaaatcatattttattcagatttttaaaaattactttcagtcagaaaggaaattgttttgaatgacccagctagcattcctggaaattcaacgatttctcttttctccaccattacttcaattcagaaccttctaatcccatcagagaatgataaaatcatctctaaatatgatttcttaagtcatttcttgttcccactcagtgaattcatattcatcttcctgaaatacagttatgacaccttcctccaatacagttctaacaccttcctccttccacactcagaaatggtcaatgttgttccgtcgccaaagagtcattacaaattcctttgtcacaggaatgcaagtttgtttccaggacatgccctcatctaatcttccacttttcactactgtgcatttaaaagatgcttcaaataaatgaattccacattagcaaaccttctgtttctaaatatgtttgtgcatacaccccctttcttcagcacagagtgatcttctcagcttctttacaaggcatcttattgcacatagtgcttacccggccgcccatgcaaagaagctctcctattcccttgtctcaagactcttttgccttcaacgatacttgtattaccactttgtattccaggactgtgtttaatatagctcatcattttgagtactggtatatcactattagggtaccctcatctcacccaattacacctgatgtagtgcatatgacatgtagtgtaatccatccttaccctgaagatttatcttttttaaatgtacacatgactttttagcaatgaagaaaatttcaatacagttggtgtcactcttacccaagtcaactggaaaaagaagtaaccaagtcaggtgttgaatcataagaggggtaggtaaagaataaaagaaaagcctgaacagaagtggacttttagaataaaacttggaataggtatcacatgataaggtaaagtaaatccaggttttagaactatctttctatgcctgggagaagggaaagagctcagacccaaataagagagactgagagtatatgtgttcagtgctaaattggcagtgctaagcctagaacacagtttaggattgcagactgagtaggttaaataaagtttctgcttgttcatccattttaagcatccacagaactcttctaggacaatagtaggaatcagcagaccataattaacaactgcaagtcataaaatcagaaagacaaggaacatttggctcaggggaaaacaaaaacaaacaaacaaaaacgtgttccacagaagagcatcattccccattgataaggtttggctgtgtccccacccaaatctcatcttgaattgtagctcccataatccccacatgttgtgggaggtacctggtgggaggtaaatgaatcatgggcgtgggtttttcccatgctgttctcatgatagtgaataagtttcatgaggtccgatggctttataaagggtagttcccctgcacatgctctcgtgcctgccaccatgaaagatgtgcctttgctcctcatttgccttccaccatgatggtgaggcctccccagccatgtgggactgtaagtctattaaatctctttttctttataaatgtcccagtctcagatatttcttcatagcagtgtgaaaatagactaatacacccatgaaagacactaacttctaaccattgacttaaagctgtagggaaagaaaatttgtaaatagatctagtgagcaagagaaggcaatcatcattgattatagaattttcttaatttctaatttagtatcattaacatgctctgaaggaagaaagcttatttgttgtattttaatgaaaagagtataattatctaagattttctaaatttgtgtgtggccttgatcactctgttttcccatcagatcttaaaaatttgcacccaaaacgtcctctacatggttattaattgcagttggaatgcactcttgtgttggcctttcattcacgtatagcaagtgagtgaatgaatgaatgaatgattagtggaatattatatgaatttcttgtttgcctttctgcctcttcagatactaccttcacttagaatgatgcttaaattagaagtgaaactgggattcttatcttctcagatacagcattgcttttcaattttgttcataattttctccatgagttgttcattttagaaaaaccctaaacaaatatcaaattattaggctgattatttataatgttgactaatatttaaatccatattgataaagtttatttgtgtgtgtacatctggcatatggactttgcctttattctgagttgtgtgttttagtattatgcagagagtgtagcaaatttactgtaagattagcccattctgtgagaaacatctgtgtacatggaagtttagcattcttatccaatgtttgtcttcagattttacaaaagctttggaaactttgacaacttttctgttccttgtcatataaaacttattccttatcctcttcatcttagaactacagttcaaattggaaacgataattcaaatatcacattgtgcttataattttagattatatacatgatctgtgaagcagtgctgcacacttccccccagtctgatatccttcggagaagcaaagaaattccatacagtaaaatttaccaagtcaaattaattttacacgaacacaccaactctttttctcaacacaaatagtttgaagacttggagtgctacttcagcatatttctcttcctctcttagttacttacgctcagatgtaagaactcatgtaaagatttgcgtcaactctctacctacaaaccgtaggatgtgttatgtgtttgagaataaattgggcttaaaaggtcttctacccttgcaacttcccttctcctccatttaggccctagagtccatcttgggggaaatggcaccagcaaagcaagttttaaccccagttaccaagctggatgcatgaaaaactacagccttcctttcatatttcatgaatagaaaagaaaactgaaaggaggtaagccttctgtgcaagaattttgaagcctctgtttgaacgcaaaatgagattccaagagaaagaaagaaccaagtccaggtccagggccatctcgcgcattgccatctacctagagaacaccactgagaaaacgcccgccttctctcttgcatagacatgaatgaaggaagcagaaagatgtagagggagtattttcccaatgctcataactccttaaccatggagaagagtttttcttctcttgacaggaaataagaagaggaataataagacataattctgccgccactatcaaagaaacatgtgaataaggactccaactaatggatatagcttaagacatgagtttccaaatatggatgaaatcgatccttaaaatgataaaaaccaacccaacttaagattaatatgttttctaaattaaacacggtatatttctgtttgtgtatttctgccaacctgatcctcaaaatttgaaaatattaacactatccacagttattgaaggtgtggaggaaaatgttctcaaaaaatgttgagagagtatatcttggtacagccttatttgaagggcaattgcctagaatgtctcagaattttaattgcgtatgcctttgagccagtgatgctacctgtagaggaatatcccgtggaaatatttgtagtgtgcaaagacagatgcacaaagatcaaagagaatctaagtgaccacatgtaggaaatgatcatatgagttttagtgtactcagacatgggcaatctgttaaaaccaatggttcctgtggtgtactacctagtagtaggaaaaaacacaagagaaagttgcagatgagtacataccttatagaaagtatgaaccaaatctatttttgtactagaaagaaaaaaagatacacttttgcatctgtgtacctacatacaaaggaatacacaccaaagaagaacagttaatactcctaacatgtgaatatgatggactgattggaaggtgctttttttgttgttttttaagcacatatacactttgattttcaatatgcatcaccatttggcattaagacatacacagaattttttaaatgtgctgccagatgtgaagtttctaaaaacactcagaatccatgtagtagaaaatagttgggtatttgcctgccgcccattgaaaacccaaatctcaatgggtggcttgacagccatatatagacatacatatacctgactcctgtcttgcttagaagaagtaaacccatctaaaaccaatctgccccatgttgtcaggctcaaaagcttattcattctaaaataaccctgaaaagaaaatacttcagctcaaatcacagtttggaaatgctttgcatgtagaaaacaattgtaaaactaagtgactttttctctataaaatttcaggaatataatatttctatgaatgttactgcagattatctggtgtcatgaatgatataataataaggctgcttatctgacaaatctgccaaatgcaaacagagcttttaataagagtattcatcaagtgtggggagataggtcaattctaaaaatgtcaccataatcaaaaaacattaggaagtacaaaaactaagtataatataaaaatttaatgcctatgtagagtaattcaagtctttgcattaactcctctttgtatcattatgtattcatttattttcaacattttgttatacaccataaataaaagtttgtttctttcacttctccatgcctgttttcccataaatcaccttctactgatagtcgtagattattcaggaagaacaagataatggagtcttgttttcgagtgtttttctttattctaaacattccatctgtctaactatatttatggtatgtaaaacacctgcttttatttccaagggacaaatatagttctaaagtcacagctggtgatagtctgagagggtgttcagatactatttctcaagcaggacagatggctatcaaaagaaactttgtaattttattttttatccccatcaagaaatttggacaaactcacagaactagaactgggaatacttcaacatgaacagtacaggactacatgtgaggaataatcataggcatgtgacaatggaagagatcaaacactaggattcctaatctcataagaataatggcaatagcgtcaatacttaggactaaatggtggatgagcaatgatttccaagagccatatgaactaaacagttagatgtaactagctttggccaggtctccttcagaacaagcaatggcagagaacactccctccagtctgaaaatgaaggtaggcatgaaacaggtaagtttagattgatttgtactaggatgagatgtccagaccaatagatgttttgggatcaaaggtagggctaccaaaaaaaaaagatattgacaaactgttggagacagtgatatggacaattccttatgtaaagggcaaagttaactctaaaagtaagacttcacctgttgtgtaatcaacttgggtaaaatcaccctggaaggtgaaaaaaattctgatgacccacaccataaatttgttggtaaaccagatctttcaaccttgggcaatctaaaatgcttcttctttgtctccaggctgcgtgagtttactgaaacactccacacatgtacaattagtaaaactgataaaaatgtacaagaaagagagctctaaaaatgaatgagagagaataagaatatagataatgaagagacatcatgaagttacaggtattagcacttttgacctccttagcctgagtgaaccaatctaattataacaattgtaacattacctgtgcttgttttgtctgctttgtatggcgcttaaagcatgaagaaaatcagatctatcagactgtgattttaatgaaatgattaaaattatttgattaggtgtgtactcaatgtttaaatgtctatgggaatctaatttgttaaattgattcgcttttgctttattggctacataaataaatatggatatttaaaagaatgctacataaataaaaataaaccagatcaaaaagtaaaaatggtggtgatcttaatgtgcataaacttttgggatattaagtaatttctcaacactaaaaagggcagatgcctcagtatttcacattgtttatagcttgtacaaattaaactctggaaatactggtaaaggaaggatgaaactaaagatgcaatgacctctggaatacggtaaatacattatataaatctgaaggatataatcactagttgaaaatattgtggttttaacatatttaaatcgagtgataggaagcaaagaagatcactccatggaagtatttatagctattagtagaattcattcttaagagagattttgacactgcaaggaaaacttgcaatataattcagcaattaaaggaataagttgaaagaattaaaaatcaaatgacaaaatgtaaaattggcaaatatattatatatactttatcatacatctagatggggtatggggccacttgagaaaaaaaacaacattttgagggtttaagagatggtgaggatgagatcagtgtttggttacagatatgtcaagtttgaagatgtttctgagacacccaacttgaggtattttgtgagcagttagataaaccagtctggggccatatgatggtaagtctggaccagagctagaagttgggagtcatcgactgatggattgcacttgatgcctgcattactcagcttagaagagtgagtgggaaaagcagagggttcacaagatcatctgaagagctctgaccttgagaggttgtgcagaagcaaagaaggtgacattagacacctaaaagagtgcccaaggacttaggaggaaaatggcaggagggtgcaagtgtttggagacagcatgctaaatactgccaggacatgaagtaaggtcaagaatgaaaaatgtcccctgcatttgtcaactcaaatacctctttggtatcacagcaagagcaatcttgatggcatgttgggggcataccctacaccacgatggaagaaatgttcctaggaaatgagtaaacggaggtggcagtggtacgactactgagaagtttggttctgaaggtgagtagagagatacggtggtgccttaagaggaaagtggggccctgggaggcttttatttttcacatgggggatattgaagcctgttagtggcggagagtatgaaggagaaagggagaggttgatgatgccggagagggtctatacatggtggaaagagctcccagaaaaggtaagatgtgttgggctacaaagtcaacacacatttcgggctttgagagagggagagacattttctccattttgtaaaagggaaaaaggggaagttggatatattgaccgtgagaaggtgatggactccccattagatgtgtttcatttcctccatggtgtggaagatgaggtaatatgctgactctgaaaagaatggaggcaccatgatagataaggagaagagaggaagaacaaaaccgttatcccagtggggaaagtgaaagatgaatttactaggaagcactggttactggctctttttaagtgttaaaattaatttaatagaatttgaaaactaagatttttgcaaaatgtggatataataaaaatataacctataaattattttataaagccttaaccctcaaattattaacaaacccctaaagtgattctatcatctgaggtagaaagacaaatactatcattacttatcttttaaaaaggttactaccaaatgctctattagttattaatagtatttttcctggaatggtagtggaatttgtatattcattttctattaatggcaatagtaaagcaatgttctctaatgagttcagaaacttgctcaccaacactaccgttctatgtacagaatgtttcataaaatttcatatcagaaataaaacttttgattgggatattttctggtttctcttccaaactcccatccctcatttcttccattttcatcaacctacctaaccaaacctaacccaggcagccatgacaccagcaggcattgttgccatcctaggcttcttcactccacaaccttccaggctcccacctgtccggctcccactaccatcgtcctagttctctgcttgcggttgcagactatttaagtgtggtaggatgctataaaaacatggtactgttttcactaattgtcaaaatacataatctcagctagtctcttgcattttctctggtagacccccactttttcatagctgttccaaacttagatgatttgccttttattctgaaagacaacagacctgctcatgtttctcttctctgttcccaaatccctttgtcatagccagcttctctctcttcctaagattatgcttctctcgaagagttctgtctcagtcctccatcagtgtttttgatctgccctatgccaactttcaccagaaactcgctcaacaaatggactgcctgggtattctcttcctgtcttccattctctggcccttctttatttgctgacaaatatgccccattcttctttttttcccatcatcctactgtccacaacccaaactaatttctattcacacacctaactttcaattttacagccctctctccatgtttttaatatcacacaacttgggaaaagttagtttataaaatacagcaatgttgtctgtataatctgtcactaattacacacttaaaaataaatttgtattcccatcaccatagaaaccaccatcttagctttgcttctcaaaacttaatgcgcatacaaatcacatgggattgtagttaaaaatgtggtttttgtttagtagctgggagatggagcctgagagtcttcatgtctgataagctcccaagggatgccccaggattggttcacagaccagaatttgaaatgcaaagagccagtggatcatcacccaaagtcttgttatttttttttttacaggctgtcatttgaagattaaacctaaaatagtgtctatctatttttatcttttccctctttaagtcattgctacttgtcttccaagtgcgtctctccatacaatccattctcttcagtcatctctgcggtgtcacatccaatagatttttcttcatcatctcattggctgcctctgctgaattcaacacagactactcatacaatgaaacggtacaactgtggcttctatggaggaagagattccccttatagcattactgggtaacatttatgttgtgctttcgaaaaaaccaagtcataaaaaggtttaaatatttacctctttccatgttgcttgagccacaggccaacaaactgaacacatgatttaaaaccgaactgtcaggatatccagcccctatgcccacagcaggtcagggatgatacatgacttaatcatgcccaatcagaattctctcttacactttctttcgggcctattaaaaaaaaacaaaaacaaaagaaagcttatactctgtggctgttaaaatatgatagaatgtgagttttgctctgagaacagccatctcacccaccatctgtagatctgttgtgaaaacagatggcatttgaatgccttcatttcagctgctatgcccaggtggccaggagatagccctagactgtacagctatatgtacttgtaaattcctttctctttctttgatctctctgtggcttgtggtaatttgtgttgggcttccttcacatgcaacaaaaagttttgacaataatccctcataaataatctcttatctatagatttttatgagaaaaaaatagctgagaaaatgacacgtctacaatagatagaaaaatttggatataaacaatcttagtaactgtttttaagttttataaattaccaatttaacaattgggaaaataataagttagctatgtttttatggggttttcttctgtttgtttgagacaggatctcattctatcataaaggctggagtgcaggggtgcaatcatagctcactgcagcctagaactccttggctcaagcagtccacccaccttagactcctgagtagctaggactacaggtgcacgtcaccacactcagctaatttaaaaaaaaacatattttttgtaaaaataggatttcactatgttgctcaggctggtctgaaactcctggccccaagcaatcctcctgctttggctgagtcactaggattataagcctgagtcaccaggcctggccagctatgttttcaatgtctaaaatgttacttagtaccctacatatatattaagaattaacacattggaaaaattcagcattgtattgctcttcctggaatattttcaaatggctaaaataaacgaaagtaaaaatgaaaataaaaagaaaaagatatttctctttactctgttttcctaaaataaaaatatctccagccaggagcagtggctcatgcctgtaatcccagcactttgggaagctgaagcaggtggatcacttgagcccaggaattcaagatcagcctgggcaacatgtggaaaccccatctctacaaaaaaaataaataagcggagcttgcagtgagccgagattgcgccactgcagtccgcagtccggcctgggcgacagagcgagactccgtctcaaaaaaaaaaaaaaaaaaaaaaaaaaaaaaataaataaataaataaataaataaaaataaaaattagcagggtgtggtggcgcacacctttggtcccagctacttctgaggctgaggtgggaggatcacttgagcctgggaggtagaggctgcagtgagctgtaattgagccactgaactccaggctgggtgacagagtgaaaccctgactcaaaagaaaaaagaaaaaacaaaaaacaaaaaacctctaatacctctttagaaaaataggcaaaagacagtgagagaaaattcactgaagaatttaagaaagtgaatattaagaaattacatatacagcatggaatactatatagccattaaaaagaaggaaattatgttcattgcagcaatatggatgcagctggaggccattatcctaagtgaattaacacaggaatagaaaaccaaatactgcattttctcacttacaagtgggagctaaatactgggtactcattgacataaagatggggacagtagacactggggattactagaagggggagggaggagaggggaaagggttgaaaaactgttgggtactatgctcagcacctaggttctgggatcacttgtaccacaaacctcagtatcacacaatatacccaggtaaaaacctgtacatgtacccccagaatctaaaataaaagttcaaaaaaaatttttaaatagatttaaaaaatagttaatcttttttggctattactgagcatttattctgccaattgaatttttttttttttttttttttttttttttttttttttttttttttgagatagggtctcactctgtttcccaggctggagtgcagtggtgtgatcagggcttgctgcagcctctgcctcccaggctcaggtgatcctcccacctcagcctcccaggtaactgggactacaggcccataccaccacacccagctaattttttgtatttttagaaaagctggggttctgccatgttgccaggttggtcttgaactcctggctcaggcaatcctcccaccttggcctcccaaagttctgggattacaggcatgagccagcgcgcctggtctggcagatgaactttaacatctacttgtcacattttgaaaaccaaggttctgagtgcgattgccatttgtaaaatttgtggtttaatatatgggtactcaacaccaatatacaacgtaattttcccattcagcaacataatatgtctagtatcacataagcagatttaatgtgcagagtttttgaatgtatcttgcacattttctgtgtgttgccatttttttttgctattgtgatttcatttttctacttttaaaatttctggtgatataaagtattattaatttcaatatattcttatagacatttgagtgaattctttaacttctcatattactttttcagttgattatactgaaatatttaggcattcagttacttatttattccacaattattgaggatgtgcatgatactagagacaatttacaaatataattgttaggttttgaagggaaggtgagggttaaaaaaagacacacacacagaaagagggtggctcaacagcaaatgcaggctttgtgtccagcataaaacctaaagaagtgggggaccagcttaatgccagagcccaccgctgcttacaggctgggggtacttgggtttgggcagtatggcttgctgcctggcgggatgttgataagatgttcccacgataaggtggttctggtccttgttctggcgggatgtcatcatggtgttccttggatctttgcccagcaagatatgatagggacgtttctttagttggggctttgtctgccttgtgatcaggtggttaggcaggatgtttctcacggcccgaacccccgtgaaatgtttcactttgaccaaggtcagcacaatagcggggagcttacataaaggtgcagtttggactcacattctttcaaggtttgcaaaatagcggggagcttacaaaatgatgcagtttggaccaacagtaatgattccagtatcttttttttcattttattggtttttctttttctttgttgctgcattttccaagtcttgcagaacagtgtgtggaatagcagagatgtcaggcacacaagccttatccctgatttaatgggaatgctcccatgcttcatgacccagaatgaggcttgccatttgattgtgagtttttaaatggtattttactgaaacttcttttttattcttgagtatagctattttattaatctatcatgcccagtgaaagaagagcattttcaaaaggatggtctgctttgactgaataaagtcagaaaagggcagtgttgtgtctacaaaagaactgtatggggatgatgccaatctctctgatacagcacctggagcattacacacaaccctcacaacaacatcaaaaaagacttttaaaatttattattatttttattattatctatgattttacattatttgtgccaaaagcatattaaactaatccaaaaggaaaagctaaagatcagtcccaatagcactagcaccatcagacaaaacaaaactactgtgagctaatatctctaacaacgtcttcaaaacagcagctgggccatcatggcacaatcctgtaatcccagtacttcgggaggccaaggtgggacgaccccttgaatccctccaggagttcaaggccaacctgggaaacagcaacaccccatctctacgttaattagctggctgtagtggcatgcacctataatcccagctactcagaaggctgaggcaggagaatcgcttgagctcaggagttcaaggttacagtgagttatgcattcactgcatagtgtcactgcactccagcctcagtgatagagcaagaccctatttctaaaacttaaaaaaaaataagaaaaaaggcagctgattatgattgagcaggcatcattcgtatcaaagtcattgaagatgtgcattacaatagcaaaaatacaataacttcccagcaaacggcaataaacctcttgaggaaataaagtcattttttgaattaatgcaaggatactattgggagtgaggatggcactgatcctgctatgctttttgtggggccatcttcccccttagtctatagcaccatagactattttattctatttatttttgtaatttaataaaatccccatttttaaccttgtttattgactcatttacttgttactgctttctcacccagtaaaacaaatattcccttaagtcaggaacctgctttatttgttttcatctacatatcaagtatgtagcacaaattctggcacatagtaaattctcaataaatatttatggaatagaccagaaagcaatgattaaataccttctttctgacccttctaatccatagaagtactttgcaaatcactgatattttgaaatgtacattaaaactacattggtaccctctcaatcttcccagttatagacaataatttaattacaccatttaagatgacatgcaggctaaccagtaaattgtagccactaagtaaatgtgatagatcaatatagaacatgaattgtagaaagatctttaagcaaagtattttacaatgttgattgcatattctaactccatatgcattctttttttaacagtaagttaattatttcactgacagagatagtgaaggtattgtaaaacacaattaaaaatatattatatactgttgttatataaaataacaacaaatgaaaatgaaatcaattgcactttttcatgctagtggcctggtgtactaaattgttcaaggacaatctagccaactgattttatgtttattgttgcaaggtgacaatgacctatgttagatataaagtatttgcatacttacaggtatatttactttatcttaatgtccacaatgtggctaaaaaataagaatactttttggtttatataattaattgattaaagaatttcatcatggaatgactatcaccatttaagtagctttatatagatgaaatacataaactaaggaatttttatccatagcacccatagaaaataatcatgcttttgagcagaaataatttctgagatattctgtagccataaagttaaataaaacatatctaagacttaagaggagaaagaataggaaattattttaaataaagtagtaattatttttggatgccatattttttgtaaagtcttttaaacacaagttgagaatttcagtgtctgtgttgttctaagtttgcattagaatgttttcaaactgcagattgtgatccattagtgattgtgaaattatttaagtgtagcatgacaatttttacaaatcaaaatggaataaaaacctcaaaaaatattacacataataaaagtgtttcataaaaattatttttatttatatgagtaaatagttttactcaaatttatatttgcatatgtacacctatatgcatatggaaatatatgtgtaaaatatgtgcatatatgtattggattaccttataaaacaggtcatattcaagaaagattggaagtcattgaagaaaatgttgtaccaaacattagaatacataggtggctataatatgcaaccaaaatgtattcagttcttagtgtgtgaggaggattttgcaaagactgtcagctaaaaacaacttcatggtgaaatgtaaggaatgataatgtgataagccatttgatctccttcagctcctcctctcagtttctgagtgttaaggatgttgtatttgaaggcggacactcctactcttttaccccacacgtaagttctagttaagcaccaggttcctagttgggagacagatgacaacctctcctgttttaaagacacatgtcaaagctgcatatttgtaaatgacaacctaatcaaagcccctttatgtttcctaactttcaatgcttactttaggaggaaagacctaggtaccctaaaacaagcacaactgtgctgccctacacaggaattttttaacataagaaattaataaagaaataattgttaagttctcatctgctttttcaccagttgttgggcaggtatttatatacagttcatctttgaacaatatgggggttaggggtgctgacttccctgtccaccactcctgtggtcaaaaattcacatgtaatttttgactctcccaaaatgtaactactaagagcttactactgactggaagctttaccaataacataaacagtcaattaagacataccttgtatgttatatgaattatacactgtattctcacaatcaagtaagctaaagaaaatattaagaaaatcataaggaagataaaatatactcactgtttacttagcgaaagtggatcataagggtttttgtcctcgtcttcacattgactgggctgaggaggtggaggaagaggaggggttggtcttgctgtctcaggggtggcagaggcagaagacgtagaggaagtggaaggggaggcaggcacacttggtgtaatttttactgaaaaaatccacatggaccctcatagttcaaacccattttctccaagggtcaagtgtacattgactctaagtggggtcctttagcagcaagtaatagaccctggctgtgttaagtcacacagagcaggtactggaaggatatgatatgaacagttcctactattggcagctggtaggagaacaggcttctaaaactcagctacttggcatcaggttggccatcctaggtcactgtggctgccactgtttctgaggtgacattgactttcctcaatcattctctattccaggtggcttccttttcaggcacaggtcaggtgatcagagtccattttccagtgacatgactcaaaccttaggtcctcagggatgtgtacccttgcttctgccatataaggttgcaatggcttcccactaactattccactagtgctggttgtagactggataaccggaggggttaccccaatttcatgctcattcctccctatccccatcatatggcagcaaatccatctccccttgacaagtacaataagatcatccattaccatgattctgttcagccagtaggaggaggaaccagaaatggcaaaatagaacagatcatttccctcactgggagtgattggcgctagtaacccccttggatttgaaattgtcaagagatagttctgactgaggttgatcagtagagctaaattgcctagttccatgaccttgccaggaaccaagttttggggttgatgtgtccacagtgtcaataagcccagtgatcaccccttcgaccattttaccttcttcctggagtaacttcaggatttgaacatgtgtcatcctgagcctttcctccagggggtcctcttgtgagtggtgggtgtccaggtgagtggtgggtgaggggtaatagtgaagtccctgtcttggctagcaacagacaccagcacatctcgctgttggacaaaaggagaagcagccaccgtaaatcttcctcaagcttcctggccctttcacattgcttgtgtggcctgaattatctcacatgattgttttcttagttgctcaggtgagctccgtgaagggagggatccacaaaagtgcccagtagacttttgcacggcccaagtccaatcttgcaagggacagtttatgaatcagggacccacctgcagggccatgagcttggccatagctggaaggtcatgttgcaaagccattgagcccatcaagggagggctgatattcttggactggctggaactgtggggctttccaagagtagagtacgcatatgcactttactaggtctgtccacaaaagtgaatctgactatataaaggttaaagagcacttataaactcagtgaaatcgggcattacataaatgctgcttcatctcggcacagttaaaatgcagctgctgtgacatgttttaggtatgtgtatatgtacatacatatatatgtgcaagtatgtttgttcatattcatgtttttcacaaattatcttatttcaagattaagttggatgtgatattatgacttgtacatgactgtgtactcagacatgcattctaaagtatgaataaagttaaatcatatttctcccctctaagtcagtcaaaatggggaaattatactgagttaggggatatgtgtgaggaaaaataaacatgtgtgttagcattaagtaagcagagctttgagttgtgcagttagaaaaaaattgaagtgcagaactaagcaaataaatggtgaattctgcccaaagaaactgtcaatttgcaaatcagaatcatgatagctgtctaaaaatctgtccactttacatgaactgcaataactgccttccttcctactttatttagataattacttcaacttctgattttattttgctatcacgtagacaaaatttaggcaagaaaaatcccaaaacactgatcttccatagttaggctcctcaattgtaaaagtaatagactggatccaaaaactttctacgactaatatttataaacatgtttttatgtaattgtatttatcttttttaatcttccaaaaaattaaaagcataatcactaatatctgtgtattttgagtgctcatgcttgtttagaatcaaaattcaatgcccagagtggtgagactgtatctttgcaagcttctagtatacacaccctgcacctgatattaagaacccagaattaacagtttttttttctttcttactttttaatatatggcttgttcctttagagcactattgaacttcaaaaccaaacctattttctctaattgtcaatggaagcactgggttaccatagttacatagtaaagtgtcttattgaaaagaagaaaaggaagactaatgacatttttaatgacagattcaaatatataaggaaattgcccccacagggaattgggaatttatcaagctgccaatcacagtaattaccctgcaaacatatcagtatctgggtcagaaactcctttcagattttctatatgccagttctacaatgcctcaaaattttgatcccacaagtgaggcagatcctgttgtgaatgcctgttttcaattagtatggctgcatgagcacacactccagcaaaggtaagcagagcatgcttggtagcatgctcacaggagaatttggtgcaccagccccggagagcgcctagtgtgcaccaagtatgtgtttcattacaccgctgtattcccctcatgtaggaaagttgctgcagactgatacgtcaatgatcttacagtatttttaaagaaaagtaccaacacctgggtgataaattaatctttacaacaaacccccgtgacacaagtttacctataacaaacctgtacacgtacccctgaacttaaaataaaagttaaaaagaaaagtaccatcctcccacagggtcaaatacatatgtagtcgatacaagatacttcaaaaaagtcttatacaatgagatttggttttgcagcttaaatttcttcaatttaagggtacatcaacaaggaatttattgaaatacagtgtatcatacaaatagaatattcacatgaaatgatcaaaggaaggggtaaggagaaaagtattaaaactgaaaatttacctagtgaataagtggacataacaattgagaatctatccacttcatgtcacttatggaaacaacacattaagattaaactacatgtttgctagagtaggagaaagtatataccacagggaccatcattactctagagtgggtctatgcataactcctcaaaaagaggccatcgttggtgtttatgtgctaaaagttgtgtattttggcttctgagaaccataaaattgactcaaagaatagtttcaaagagtaaaagaagaaatgcgtgacaattgaagacatggaattaaattggtttgtctctaactgcctcttagtaatcaagagttcttgcttggcaaaacctcataaaaacagatttaggatttaagacagtgtcagtaaattggtacaagcccatacacaagtcctcaaagtgatggacaactactcagaaagtaaaaaacctgggatcagtacaacgtgatttaaaaatgagaagtgaatgattattctggatttaattcttatttactaggctacttggttctttgtgtttagtagtattttatctatttaagttcccataatagatgtatccagtatatagaacaatagctaaatactcagagaggtatggcgagagagagagagagagagagagagagagagagagagagagagagagagagagaatgaatgacaaccagcttgataatctcctaaactggggtggggtttaggggaggaagatgagaggggataagcctcttcaaaatctcctaggcttctggatatctgcccctaactgcactgggagcaactgcacacacctgtggaaagcaaactgttatggtttggctgtgtccccacccaaatctcatcttgaagtgtatgtagctcccacaattgccacacgttgtgggagggacccagtgggaggtaactgaatcatggaggcaggtctttcccatgctattctcatgatagtgaacgagtctcaagagatccgatggttttataaaggggagtttccctgcacaagttttcttctcttgtctgctgccatgtgagacatgcctttcaccttccaccacaattgtgaggcctcctcagtcatgtggaactgtgagcccattaaacctttcttttgtaaattgcccagtcttgggtatgtctttctcagcagtgtgaaaatggactaatacacaaacctttgttcctccagtcctgatcaaaggtctttaaccatgagttgcctatttctcaaatccttcctctcctacctagttccttcagttccagagctacagggacacagctaagtcacggaaacacccatgcttcacgtcaagatcatgccacatattctccatggaacctaagtggtggccctccattttccatgttcctcaatttacccaaagaacctatcctcctccattttttaaaggacacaacagttcaccaaaaatgattccttatcacctaagtgtatccttcttaatgacgttgtcaaattctaataaagtgcctcttatatccatgtgctaagtaataattcaaatattaaaaataaacacaaatattacaaggagtaatacaattgagtcatgatagattttctaaaaaggatttgattagaaacttccatcaaaaactatctaaaacgtgttttgcattataaacttttatgcattttattcaaaccaattttctttaagtaaaaacttaacagtgtcatcaaaaccacactgatacaaagattccattttcctcttgcttgggggaaaaagggcttggttgagtctcaccaggtttgccagggacaactagaataaaaagaccaaaatttaagctgtaggatattgcagtacaggtaaatatacactatttttataatctaggttttcttatcacagatacaattagcagtaacaaaaaatcagtaggaaaaatttaaacttcagaagttacctccactgatacactaaaggagagtttctcagccttggtactgctgacatttggggccacgacgtcttaactgtgggacagtcatgtgcactgcaggacgtttaacaccattcctggcctctacccaccagatgccagtagcaccactgggacatgataaccaaaaatgtctagtacaatatcatcccatgtggaaaactattagactagattaagggaatcagtatttttatgtcaattattcatttgggtccctaagtttttctccactatttttatatatttcattacctccatctttctaagcaaataaatgattttatttaaaattgctctgggccaggcgtggtggctgaggcctgtaatcccagcactttgagaggccgaggcaggtggatcacttgagcccaggagctcaggaccagcctaggcaacacagtgagactttgtctctgcaaataatttttttaaaaaagtagttgggtgtggtggcacgcgcctgcagtcccaggtacttgggaggctgaggtggcaggattacctgagcctgggcggtcaaggctgcagtgagacatgatcttgccgctgcactccagcctaggggacagagcaacaccctctctcaaagaagaaaaaaattgctctgatatcctaccaagtttattgatgtaaaaaagaagtgaagaaaaagcagtgacagttaataagcagcaaaaatgggtgggcgtggtgcatgtctgtaatcctagtgctttgggaggccaaggtggaagaatcacttgagccagggagtttgagaccagcctgggcaacctagtgaaaccctgtctctacaaaagataaaaaaattagccccgttcctatggctgatacatgttataaagtattaaacaacacactaaggagaagatgcaactcctacctacaattatcaatgaacttccagtgcttgggaaacacgttgaattctgtgggaatttttagtagatcagaactcttcaaatatcactgaacataattactcaccatgatatcctgcttggcgatattaacatacagatctagctgccctttgtcctgcggggagatgtccagtcgtccactgaagggggagatggttactgtccggccgacgggcaggatgggaagagcgttggtgaggcctccgtccacccacttctgtggaaagaaacatctcacgtcagcacacgtcaacaacacatcctgcacaaagaaaagcagcttctaataatatgtgtgccttggatatgcttttaaattgctatttttgaggactaatcccattggggatctgttctgggggtaaaacaaatcttggtacacatatcacttaccaatataagaacaactctggacagaatttaactagattattgtctgtaagacttgaattcttactgactacagtgcatgcttaagaagccatgtgtaattagattggggttcattatttaatcaaactaaaaagtcaaatttactgtggatgctgaacaaaacatccaccagcagaggaggttccatttttattatatgaattggaaactggcattttctgtggcaaacttaaaaagtaaatacagcaactagaaatgcttctaattccaaagtggttcctgtgctcttgaagcaaggggcatgtcctgaagccataaggaatgggagtgctgcatcaaagcacacattcctcagtaggcactcagtgctctcaagcccaccgcaaaggggagtgagtgatggagaaggcggaggacagaagcctcccaaggaagaaaatgaaagagtcttggggcaatgaggacggacaatgaggtgctcaaggtgtgtgcagcctcagcccctagctctacagaagcgcacaatgagaaatggtgactgaagaaccacacagacaatattccttctgctgtctattccaaggccaaacagtctcaatgcagccatgatctgatgtattcacatgatcagctatagcactcaataaacacaacacacatggaaataacacccaaattgtctaagtttatctgttattaaaaatagccttcagataatatacaaaaaaacaaaaagtctggtaacagttgaaagtcctgtatgcaggaatctttagtgaagtttgtaaactgagttttgcttcaatgtgtaaaatgcaatgcagataaaacaaacctttgttattcaacataaaggtggcaagaggagggagaaacaggccaaaataaaatgttctcaactcacttaaaaccatgcatttatttcttccaatgtgtctttttcatgtccttcttgtgtttatttatttatttatttatttatttatttatttatttatttgagacagagtctcgctctgtcgcccaggctggagtgcagtggtgtgatctcagctcactgcaagctccgcctcccaggttcacgccattctcctgcctcagcctcccgagtagctgggactacaggcgcccgccaccatgcccggctaattttttgtatttttagtagagacggggtttcaccgggttagccaggatggtctcaatctcctgacctcgtgatctgcccgcctcggcctcccaaagtgctgggattacaggcatgagtcactgcgcctggccaattgtgtttatttctaaagctgatgacaaaatgagtggtattacattatttacaaaggctctggacagccacaaactcctccaaaggaaataaaagtaaataaataaaagataaaaatgggttgaaaattccttttgagagaattgcattttggtggaggagagagtataagtagattggattaaaataaaactgacctgcataatttgcatattgtcattatttttaaaagatataaagattatgatatattatgtgttatgtgtattacacatacttatttatatgtgtatgtgtatatgcatgtacacatgtgtttgtgtatgtgtgtttatatatgtacccatatgtatacataaaatatagctggttatgtaactgtatgatctaaaagggaggtttgcaaaaaaaaaggctccaaaatatctgattctgtcccagaacctgctttttttccctgattgctttaggtgtaaatatcaaattctggaataggataatacccagaagggaaaagaaagacagcttccaaaattatttcatattgtcaacagaagctgtcatcaacgatgtaaaaattcatacaggtttcatcaagaaaaattaaagatatgcaactttaagtaacagctcttctgatttattcaacttaatgaaaagaagggcaatctggctcagtaaattaaaaagtgttctaatttactgtggggttaatgactgctgttttagggaatcgaaaatcctttttccaaattttgttcactcttgttagcttattctgattagataaatgacaagggaaaatgtatagcagcttatcaaatcacttgattaaacttgcaatgataccggctccttcacaacccttgatgctatagccccactgctcagatatgctaaatgtggtacctcttactcctgatttatgctctcacgagctgtatcacttaggacaatcacacattcattcgggcatacagattccagcagtttctggaaacaaccgtcacaacaacaaatattcttcaacctccaaattaaaagtagaaacattttatatcttgtgctctactgatagtttaaaatcttgcatagtaaacacttctgcccatgaattctctggctgttcacaacatatggctgtgagtcattcccaccttcttgcttcatgggcagcattttacatgctggtagctacttccatgagcttctgtgactccaaaattgtccttaagaaaaatagctgctggtctaccccgttagagttttcctgtgtgtttgtcagttttcatcacatatcaccatcatcctcaaaggaaaagggagagcaagtacataaaaattccaaggcaaaatagtttcaaaatcatactcgttacaggctgtacagtgaccacctctcagtcccactgctagacctactactcttttctctaatctttggccatattctaaatgtgttccacattcaagtcaatgcctgagtcctaagacatagaaataagcaactgctcaatagaaaaaccaaaaacaaaacaaaaaaactcatgcccaattgtggggcagacatctactgtgattgttctctgaaagttatagcactgaaaactggaattaatagaatcacttctaaagagataaggctacccattacacctaaacaggctagaatattcatctggcagtacttgttaaacttcgctttagacattcatgtgttatgggtagctattgagaacatgccttatgaattcaagtaactgctattacataacgcaagtggaaaacttaagaaaggacctgatgagttaacctgtactgaaagggccagtttattcattcagcaagtgatccctgagcatctagtgtgtgtctggatgtatggtagatgctggggatatgtttttgatagaacttccatgaagggctccattttcttaaggtatattttgctcaaaaaacaagtgaataaaaaatactttgctggaagaatgaatgttgctatctataattattataaataccatggcagagggcctagtagtttaaaagtgatttcacatgtataatttaatatgcgaaccctgtaaggcagaaaggtcatgcttgtatattcagttccctcatgttacagaagaggaaactgaggcttgcaggtttccttgctatagttcacggggtggtaaactacgacccaccatctgcttcagtaaataaaattttattggcacatgaccaggaccttttgttgagatattgcctgcggctgcttccctctactacagcacagttgagtaggtgtgttgacagagacaatgttgaaagcatttgctatctgatactttacagagaataaaacatctattgctatagaatatacaggcaagaagggatagttgtcttttcacttcaggttttttttctcgcacactgtaaaattcagggatgctcgatggggcagggcaaattagaactgatttctgaggggtgagaaagaagtaaatgtgctttgaacaataatttcttatttgcaaacatatctgcattgctttcatgagatagcctacagacagcaatgcccaacaatgctcttgattagcaattcctaaaatagaagggagagggaaagagacaaagagatatccacttccttagacacaggtgagaatcttccaattacggtgggaagaagagacagatgagattttttaatcaaagaaagacaagtaaaaatacaattctaaaagagaggttgagaaacctgccatactaacctctactaagcattgattcttggtgcattgctttcttggtttttgcatgtgtgaaggatgattaaaaatgatgactccagatatctacttttgagaaggctctaaagggttaacagttgaccatctataaacaccatacagaaaatttttcctagaggactaacatgttgtttcaaaaattaaacagacagtgcaaaaaaatctaaaaagtgactgaagaataagagcgtctatttcagaataactagaaattgatatccaggtttccatccagccaaatctagctggtggcaaggccagctaccactgtttgctatgacagtgacagagctgcatttccatgtaaaaagtctaagccacgaggaaatagaagcctaaggaccacagtatcaacctcatataaaagcacagttacatggagtattccacaattctctttcccacacaagtgtcaataatgaaaggaaaaatgacccatatccgcatggactagggtaatacaacagtgcattttcacgttcctgtaatagtatatacttaatcttaaccaaaaggccaagaagcgatcttgtaatactacacagtcaaaatattacttgaattccaactcagatgaaagaaacaatgcaaaatcctacagcttttcttttcttttttttttcagacagagtttcactcttgttgcccaagctggagtgccatggcatgatctctgctcactgcaacctctgcctcctgggttcaagcaattctcctgcttcagcctcccgagtagctggaattacaggcatgcgccaccatgcccggctaattttttgtatttttagtagaaacagggtttcaccacgttagccaggctggtctcgaactcctgatctcaggtgatccgcccgcctcagcctcccaaagtgctagaattacaggcgtgagccactgtgcccagccaaccctacagcttttcttctgatctgcatgtgccagttctggagatgattttattctgatattttagtcacctgccaatgctaattctatctcttaaaacaaatgagttaagaattcctcttgaaaattttcattcttattccaaattgacaagaatctgtgaaaacatggcctaaatgtgtgaacattcctgtggatttattctaccactggaaagagttcatatgtagtaaagaaaaatcattagtcaaaaatataggactaaacttcaatttatttccattcattcactgacaaatctattaatgagtatgtactataaggtatcaaaatagtcataagatgaagccagagaaagctacagaactttttaaaataatattttttaaaaagcagttttctttctttcttttttttttttaaacagggtttcactctgttgcccaggctggagtacggtggtgtgatcatagctcactgtagcctcaacctccccaggctcaggtgatcctcccacctcggcctccaaagtagctgggactataggcacatgccactatgcctggctaatttttgtttttttttttttgtagagacagggttttgccatgtttcccaagttaaaaagaaaaagcaattttcaaagacatcattccactttaaatcactggtagagggttttgaaaggactcatactggtatttgctgtggttgaaattaatcttaagtcttattaaggtatgattcttctaagcgattaataaaaacattttttaatgcacatattggatccacaaatatatcttaataaaatccagtaatacccgcaatgtagaaatgaggaggtctgtgtatttaacaaaagtcacaagtggagagactagactctgcccctgttggctgagtcccactttctctgcctttcctgactcagtgccacaaatataagtaacgctaagtccctttttccccttctgccacctccactttcgtcacttcagaaaaacaactaaagacaacaaatacatcaaaacctgagctgtatgaaaacatgaaaatctagaaaataagaggtgtattcagcacaactgaaatgtttatgtaatttaagtcacataaaaagcttatacccacattaaaacactgcatttaaagcaacattcacgcttccctgaaaatggaaaggaaagattctagaaaacaactcggcatggaagccctattagaatgtgggaggtgatcaggcttaaagagagttagtgttaagcagagaatggcacttctaaattgtccctttctggtgttataaacaatgcaaggccgctgtggctctctgtcaatcatgtgcatgaggcccccttattgtggactccattaaacaacagaggaaaactgaatgctttcaggagacataaggttcaactctacaagtaattattggtgtgcctcctatgcacagacaccacatgatcagcaagacactgtcctgggacattgtccagggtcaaggggcttgggtgggtcgctttccatcttcctcacagttctgggcctgtgcgttccctgctgtttaattgtggctgtcactctatgtccatgtccaaagtacttaatcacatcatggaaagttcactagaaactgattcctcattcatgcccttttaaacattgctagtcttcctgtcacacacccacaacatggcgctgcggctggacaggaagaaaacaaggaacgcattgtttgaaaagaactaaagggcaaagcagagtaagaggcatagcaaagatagaaacattaaggactatcttggggaagttgaccccttccaagctcagtgacttcagtgaagtagactgatgtctttacatctcaatttcctcacatgtaaaattggaagtaagaatccctacagcagatagcactggattctggtgtatacaataataacaaaagttttaggctgggcacggtggctcacgcctgtaatcccagcactttcggaagccaaggcgggtggatcacgaggtcaggagatagagaccatcccggctaacacggtgaaaccccatctctactaaaaacacaaaaaattagccgggcttggtggcatgcacctgtagtcccagctactcaggaggctgaggcaggagaatggcgtgaacccgggaggtggagcttgcagtgagctgagatcgtgccactgcactccagcctgggtgacagagtgagactccatctcaaaaaaaaaaaaaaagttttacttcttttttctggtaacaggaatatcgagggcaggctggtaaggtagactcctcaaatcatttaggacctgggtatttccagctcactatttggccatcttcagggtgtgatccttgacctcatgatgaacaagagctgctggagctccagtaatcacatctaagttctgggcaacaggaaaaatggaaagatatacaactttccttgtactgtaagtcccacagttattcggctcacatgtcattgcccaacaatgaaataaatggccacacctaactgcaagggaagctgggatgtataacctagctgcacagccacaggttcagataaaaattgggattctgttactaagaaagaagaagaaagtgtatattggaagagaacctggagcctctaccacctgcctctccttctaagatagaaacactcttaatttgtaagtgagagactggcgtaatagggacatagaggaaaaatattctaatctcctaagtggcaaagtaattttacttgtcaattcaacattaagtatttcaaatgacagcatctgaatatgtggaattttaccactcactctcaacccattaccttctgctctatcaaaacatacattctccatattacctgaagcctattatgatttgcactagagagaaaagaaaaaattccaaagctcagcaaagctcaaggaaagacactgatgaggaccgatgagatcagaacagagacactgcctcgatcctattagccaaagggtttgtaaaactcagttcttttgttgagagaccatcaattccttgagcacaggcctggtgctgggccctcaaggtgagtgggtgaatgaatgaatgaaagatggttaaagcactttgtatgtactcttttattaataaataaatatatattacatatatataaaataaatgtaatttattcatcctgaatatatgcttgatctctgatatatgctaaatagatactttattagatatatgctaaatacttttattataaaatatatatctctgatatgtatgaaatatctactctatttgattataaaacatatctctggcatgtgttaaataggtactatatttgattaaaaaatacatatctctggtacgtgttaagcagatactctgattataaaatacatatctctggtatgtgctaaacagataccctatttgattataaaatacatatctctggtatgtgttagatacctactctatttaattataaatagatatctactctatttagatatctagtagttagatatctactctatttaattataaaatatatatctctggaatgtgttaaataggtataatatttgattaaaagatacatatctctagtaattgttagataactgattataaaatacatatctctggtgtatgtgctaaacagatactctatttgattacaaaatatatatctctgctatgtgttaaatagctattccatttgattataagatgcgtatttctggtatgtgttaaatagatactgcatttaattacaaaatgcatatctctggtatgtgctaaacagatactctatttgattataaaatacatatctctggtgtctgtaaaatagctactgtattaattataaaatgcatgtttccagtatacgttaaataaacacattaaaccaaatactatatttggttataaaatacgtatctgtgacatatgtgaaatagacactatatttgagaataaaatgctcatgttgaacctgtgtccatgcaatggaggagctgccttgggtcgaatggtgaatactcaaaacaaactctgtgtagatcacagaaggaagctgggtcacagtcagcgcagacttcaggtggaagcccatgtctaaatttccctaaaagaactggcatcctgtcttaagtgccagctccaagtgaggagcactctcctcaaacaaaatgggttttggccttgcagtgatcaacgtgtctgggtaagtagagagccttggaggggagtgggtcgtcccctagcagaggggctgaggacaggctggaaggaacctatgccgcattgtctgggggaggacaaggtgtggagccctaaagccttttctcaccctgacggtggtacaactctgcttagaaggggctgtgagtatggactttactaggtggaaaaaaaatcgttcactgctaacaacaacagaatatatatatatgatgaaaataagagcatcacagtcaatcattcccattcacaagatcttgatgataagttatcactagccctgtatattctttccctcttaaagagaaacaaagctatttaggaggaaaaaaacataaactgatttgaagccactagaataattataaaattggatgtttcaaaagaaacatattaatatagggaggagggtaattcctcagttataacaagcttacctgccctttgtattccactagcttcagtcctgcataaatgggcacaaaactgctggctaggaggacctagatggataaaataaagaagcagctcatgattacaggcatgaacattcagacaatacagttgatgtagtattgactagcaaaatctcaataaataagccccacagacttcaagtgcagcactgcacgtaattacataaaagataacactttatatcggaaaagactctaaacagataggtacaagttgacatactctgaatcaatcaacttcacctaggtaaaaatcagcattttaatagtagacacacaagttactacaaaatgaaatttaaggtaagtctaagttcctgagtatgtaaaggttacagataaattatatgtaatgttccatcatatactgtaaaaatcatgttacagttgcactcctgctttctggaggaacaaagccctccgattatgacaggagagattagtccgcagctcagagatgttctcatttatgtcaccaggatttgcaaagggaatggcatattttatgttccaatgacgtggtcaggatatgtaatggaaccctggcaagcagtgacatcaattatgctttatctcccatttaaacagttgaaaaagattgtcatttaggaaattaccattccatacatcatgggaagttgggctctgatagcttttctgaaatgtaaatgttttattttgccgtgtagtttccaaatcactagtgttctatttgaaaacatacagcattagatactgaatattttttaagctataatctttcaactgataagtgaaagactctggctgtttgttgtcaaagatttcatgagttttttttcatcatacattattcagaaatggattatggctcaaatgctgacttgcagatcatccacttacaattatttagaactcagaaggcatttcctccaaaaatcaatgttataggtatggtttttgggtcagctctcaaaagcctatttattctgaactgcaactaaattacagactcagtcaccagcataacaatttccataggaaaatcctcttttgagctgtgacccgacacagctggaatccactcttgccatgtttatttctgcaccaggtacagggaacttccatagctttcttatgcagtggttcttccttggacatgtctcctgtttcctcattaccaaaaaacccactgaaaggagagggacttgtgtctctcctggtatgtccagcccttggcagagttagtactcaacaaacatctgttgggtatctctctcccttctctgtgatgggaatggacccaacactcctccacctacctcaatagtggcactaaagaaggttgcccagtgctgttggtggcatgttggttgcaaaggcacaggcctggttgtaacagctcctatagcaacaggctcctgacgagtgcccacagaagcttctggggcctcaggtttcagcagtggcaaattcaagggtaacagcacaacacaaggactccagcaggaaagaaggtaagaaatagccaagtgtgaaagggttctattgcaccatgctggtgctaggtgccagaatcagttatataatttctgggtcctgtccaaaataagataaatgcagggccccctgttcagaaagtatggagaatattaagatgttgacagcagagcattaaaccaatggtgaggccctttggatagtggagccacgtgcaaatgcacaggtcatacattcatgaagtagaccttgcctcaaatatagtgtctcatttaattatttctcgaccctgtctcaaaaagataaagttgctcaaaggtctctctgctaatacgtggttgagactgtccccagaatcaatttaatataaaatgtatatttttaccagagccaacatacacgtcagatttctcacaatgggtctttttttcatcttttggtcaatttcatgcacatctatctcaatcgcttgtttattgaaatattgaaagcatgctaatttgcagcactgtttcccaaaggaaagcatgcacttctatttattttttatgtgcttgtttatttatttattacaaggcataataataacctcacgcaaggtctgccaaccttctacaaaatgtcaatgtggacatgcccgcactgtgacattcttctcaaaatctcaactttaaatggcccgcataatgcaatactgtgacattagagcaatcatgtctctttcacaaagaggcaaagcaggagtgagtagcaccttgggtgatttggtgaagatcgcttaataaatcaataggagagagaggacagaaagcaggcatcttcaactccaaccctctcagtccaccggtagcaatgacatcattggcttcagagaaaggttgtttacggttaaggtaactgcattcaccctaactaaacctgaccttatcatcaattggctatgcttttaaaaaaataatcacagaccctaggtatgtttcgcaagcacaatgtagctatttaatgaagttattcagcaaatgcaacactgcaaagcaataactagagcaatttgtagatagcgtacatattgtgaaattacagtacttagaggtctttaaagaaccaaagacaatacataaatataatgatttatttcactattctgcagagagacatgtggactgcaaaaaaatcactaaccttagaattatgttttttttttcttttcccccgtgtcaaagtataatgtagagttcacaagttaatgcttgcaactattttgagatatttggatgaaaaatgctatccaattactttcctacagataataacagtaagaatcctcctaaatgatatgaaaagtgcaatgaactggaaaatacttgtcacttctccaaatcaatgtatttgtttttgtcatagctgactctccctttatatggactgatgatttgtatatcaaaccaagtttagttgggaaattagctttagatagttaagagctaagcagcttttcttatttgtagtcagcttactgccattttattgcaggcaaatagaatttcctaagaaaggagataaagactgacattctaaggtcatgtaataaaatattatgcctaaacatgtgcttttagtgtatctcacctcacaatattcccagtgaaattcacctcgccaatgaacctcaacacgtctacagcacttgttctcaactggaggtgattttacccgctagggacatttagcaatgtgtctgtcataacctggggtggagggtgggggggggggtgtgtcctgctagcatctactgaacacagaccagggatgctgctcaaattcctacaaaggacagacagctgtcacaatacataactatctgggtaataatctgggcccttactgccaggagtgcagtgtttgtggttgagaacgctgatgtggaaagcaggggtatacttttcacaccctatcacttggtacagcactttaaatgttggacatatgtgaaaccactgatttgtgttcttactaaacacacaatgataaaaatgagagctagtgtcttcctgtagcaactgtataaaacatcgccaggtgcgcattcccgacacgttctgattgactctcttcattttgcattttacagaaaagaggtatttagaaaattatgtggcctagcttccttagggattaaattctcagcaagtttcatttatgcctaaagtttactgtggactttaatgagaattaactgtttatacagaacttgctgctgtagttcaaattcaaagacagattcaaatttatcttcctcagtttttccaagataatgaccaatcttaaattcagtttttatttcaccttcacaaggctaaatgtgagaggatcttgttaagagcattctcacacatgcaaagaaattcaggacatcactgcaacagagacagggcagaattttctcaagacggccagggacactatggtgcaggaaaggcttcctgggtacctctaccctagagcattcacacgtgtcaaaagaccctttcggaaaacacttgtgcatcagtcttaaacatgaagaattcaatgatttgtaccaattcagggaagtagtggaactctacgacgccattgcactgttaatttatgcatcatttcagctcagccttggaagttgcatatgactttcttttaacctaggggctcacctccctagttaggctttgctgaaggctaacattaaaatgtgtttggatttcctagttgcatgcatgcttctaaagaaaaagagcccacaataaaatctggaactcgaaatgaatgagttggtatgcaaaatgcacacacttgacactcgggggatactgtgtagagcggcacaccaggagaggaatcaggaaggaatcatgctaaataatgaacagtatgaagggatggatgtctggagagtggaggcacttgaaggtgaccatgcacatctggtgtgtacttaagagctgatgaaatactttcatacatacttcatttgaccttgttctgaaggtctccatcttaaagatgaagaaaccaaggctccaagaagttgagactcgccaagggtcccagagcccaccaacaacagggttaggtggatgtgtaccacccctccatgactcttttcaattccctaaattatctgcatttgcaggaactgatctcagcttggtgttgatctgctggcgacccacagacataaagggtcatccttgggggtaacatttttctgggtgtggcacctggaaataaatctctcagacgggaaataaagacatgattttggaggggggcctcctggggctctggttaactctataaaggggtctcccctctgcaggctgccttcaagtagttgagcagacatcatctgtgtttccctttgtcagtacagttactataaaggaggaggggaatggttggcaccaataaattctgaacaaaggaatgccttaaggcctgcacctgtcttataacagtttataaagtagaaaagactgagttaaatcctcatgaacgtaagattcaaaattctgtggaaattcaaccccaaataaaatgaatagttggaccacacagtccacaagggtttcaagaaaacaatcaactagcattgcagctatcaaatgagtgatttttccatgctactaaaggtgaagctcattaagataaattaagtatgaatcatcacacaaaattatttattttaaaaaagaaggcttataatgatgagctgtaaaatcagatgcctaaaggtagcaagaactcagtagcaaccatttcctgaagtattacagatatcggttagcacattgttcatgaagacaggtaataagcaaggggttaaagaataacactgataagaaaaagtaatcctattcagcctgaagaaaagaaagttgtgatttaatatggctttaaaatttcatgacagattcatacaagggtgctgagcaggggtgtgtgtgggttattatgttattcgttcattatttatgaaatattagctccattcagcatgcataaagggctttatcatttaaaacacactttcacatgctttatcttatttattctgtacagtaacactcattagtattactgtgtgaattactccatttcagagatgagaaaactgagactcaaaagtaatcagtccaagaggacaacgtcaggaaacgacaggcctagacatgatcaccgggacactcataaaacaagtaatcattcttgaggagattcaaaaacacgtcaaaatacacacacagacacaaacacacaagcacacactctcacatattctaagctacaggtttctagttggattttcaggtacataggcactctgtaacaaacagcatcagtcagctagtggataatgaaaaactaggcattttttaaaaaattcaactattaagtagcagaataaatgagttaatgataaaaacagaaaatacaacatggagcaaagtttaaagaaggtgaaaatcaccagtgtttagtatttcatgctctcccatgctcttttactctaacttgagttttaatcaacctctctctttctctctgtctcccatcccctcccatctacagaatatccagatactgggaagtagacctgtattagttcattttcacactgctgataaagacatacccgagactgggtaaattataaagaaaaagaggtttaatggcctcacaattccatgtggctggggaggcctcacaatcgtggtggaaggtgaaaggcacgttttacatggcagcaggcaagagagagaatgagagagaagcaaaagcagaaaccccttataaaaccatcagatgttgtgagacttattcactaccaggagaacagaatgggatggggaaaaccatccccataattcaattatctcccactgggtccctcccacaatacatgggaattatgggaactacaattcaaggtgagatttgggtggggacacaggcaaaccatatcaagaccccaggctgtatgttcagagcgaggtgtgccaagccctgggagacccacagctacccatcatcgagctgcttcaatgcatggcttcagagcctcctgtctccacctaaggggagtggggtgaccttcaggcagcctccccagtcccaaccaaaaaggtcggaagcaccatcctcccatggcaccacctcagacaacattctcccaccagccacttctttcaccggaacatatatacttgatcatgtccctacctggcagggggtttactttacttcctcttcacacttcttcctttgctacatcatccctagtcttcccgcactctcactcttttcccctaaatgcttcatgagtattccaggcataggtttcacagtttgataatcaccatctgctatcaaggaactattcatccttcctttttagttctgaaaaatgttaaaacatcctcctaaacacgtggaatgtttcttgtagaacctagaataaatgtcaattattccatattctccttacaaagtattacacatttgtgtcaacaatttctcttctgttcaatgaactcaagtaattacacaaattctctgaatagttattatccaaaacaaaggaactagaaaaacgtcatgttttcttaacagcaatagtttgctattgccgttataacaaattactacaaatttaaccccttcaaacaagacacatgtattgtcacacagtctgagggtccaaagtctggtatgggtcccactggggaaaatccaggtgtcggcagggctgcatctctttctggaggctctgggggagaatgtgtctccttgctcagtcaggtgttaggagaatccagttccataggttaaagggcagatgcccccttttctttgctggctgtcagtggggacctgctttccgagaagcctctgtgcttccctggcatgtggttgctacatctccaaaccagccatgacacagaatccagaaaaggtgtccacttttcaagattcatgtacttagtttgggtccacttggataatatgggatcatcctcctatctcagacctttaatttaatcacatctacagaatcccttttgccaggtaaggttatatctggacaggttctggggattagggtaaggacagttttgggtgtcattcttctctctgccacataaaagggatggatagggaggatgagcattttatccagtgtggggtatatatagttagggaagaatgctagacacatgaaccacagtcacagctgggccccagccagctatgtgattttgcccaggtcatacagtatggagggcccagcttctttcttttcttttattttaaatcgagccagtgtaacagatgcaaccttggttcatatccattcgtttcacgcatattacggagtgcctacacaatggctggcagtgtggcaggtactgggctgcggcagtgagcaaaccagagaaacccctgcctcttggagcttacattctggtgaaggaggatggacaatgaaagctgaacaggacagcagtaaaagaggtagcatgctaaagagtgatatgtaaatcaggagggatgtggggagatcaggggctgagagttctgtcattgtagacagaaaaaccagggatggaccccgtgagagagatctggggcagaatccccctcattttatgtcacaagagcacacagtctgttcctaggtaaacaagaggatgcatgtctgcccaccgcaagccttatctgtctgtattggacattgatggcttaggaccacttagcatgggttgcccagctcttcccttgacactgtcaagtctacataatattgtaataagattatagaataatgtctttttataagatagactcttgtaagtgagagaatgacgtaatagggatatcgagggaaaatattctaatctattaagtggcaaagtaattttacttgtcaattcaacatttcattaagtatttcaaatgacagcatccgaatatatggaatcttaccacttactctcaacccattaccttctgctttcgaaaacatacattctccatattacctgaagcttgttatgatttgcactagagggaaaaacaagaaaaaattccaagagaagtacaccctttccaccctacaaatattcagtgcattaccacagcaggcacattggtatttggaaatcaaccagctgaagtatttcccagagatgatgaattctcaaccaaccaactttcaaatgtgtttggatagaaagacatcagaacaaaatggaagaaacaaaatggaacattagattgaaaagttaggagacctgggtaccagaattagctcccactgccacgcaggataatcttgggtacataggtacgtacatcacataaaatctttccattcacttctctgttaaaaacataaaagggatcaggtgtggtggttcatgcctgtaattccagcactttggggggctgaggtgggcagatcatttgaggtcagtagttcaagactggcctggccaacacagtgaaaccctgtctctactaaaaatacaaaaattaggtggacatggtggtacgtgcctgtaatcctagctactcaggaggctgaggcaggagaattgcttgaatctaggaggcagaggttgcaatgagccaagattgcaccactgcactccagcctaggcaaacgagcgagactccatctcaaaacaaaaacaaaaacataaaagggtcacaataacacctaccctacttgatttacagaaggacttgaaggactgaataagagagtacatgttaaaaaccctacatacactccaaagtattagccacataaatttcaggaattattattgctactaaactgcatcagcgacttgcttcacataatcaacgtgagatctgaacattgcaggaaaacactgaacaagtacagggagcatttggatcacagtgcatcataaggcggcctcaggagggatcctggcgaatactttcatcaaacaagtaatttactgagcactcaaccatctatcgggcctggtaagagacacaggatctaaagaacgtggtaatgctcattactttatatgaagtattgaaatcagcacttgctgatttcttcaaataggaaacatggctttgttaccttaatgaggtcctccctggaggaaaaagtggagactaagtgattttctctggttttggcgttggtgatggatacgtgcagtcggttctgggccagctcgtgagcgctgggaggaagaatcgactccatcccacttctaaagaagaaaaagcaatctgaattactcacctttaattattgaactccctgtaaatattttacaagagagaatgctgagcttgccaaagtttgtacagagagtcgtcaacattctgtcttcatgtacttttgggcaaaatgtactctgtataccttagtcgggccatgaagtcataaccgggcgttactgccccgaaagactgccttctgatttcttcggcaaacttgtaggtaaattggttacattcctaaaaaaagaaaattaagaagtgaccctaggtgttgtaaagaaaacaatcattccacttctaaaacttgggattctatagacccaacagcaaatgtagggtgtcatgttattaaaggtgtgcaaattccccacctggccggggcctcacccaccactctcaggccctttgcaaggtatacactctcaagaatcctaatctttttttgttttttcctttgtaaagcaccttaaatggcctttgccccatctgaaaaatccttgaaggctcaatctgaattttaattgagcacattcttcaaaaggtttcctcagcgcaattaaccttctctcccacccctattttgtggtctcagcagcagtttgattacaaccgtgcaacaaagctgattacaaatgacagcaccagtgacagaaataggagtagtgacgtctatggtttgcacagactgaatcagagtcttcggagattcatcttgggcactggtattttataaagtctttcagggatgctcatgtctaccctggactgggatccacagaggtgacactgtcagttcatcttcacatcaccctgcagggtgggtataaccatcccacttgacagacaagaaaacggaggattggagagttcaagtgtctatcccaatatctcattaaaaatgagtctcagagccagaatttacatctaagtctattttgtattaaataatgaattaatttggcaaccaactgggcaccaggtacttggctaggcactgggacttggagaggacaagatacaaagaccctgtgctcatgagagtcataagtgcctccaagagcaggtcatagagggctataagagcccccacaagggtgtgtttggctctcatttagtgcaaaaaataaataacaacaggtaaactgttttgagaatatgaggacatcaagtctcaaattcaggtaaatcattcaatgtcttaacattgcagaatttcagttaagtggctatattattgcagcagtctctcctctccccacaaagatgtccacattctagtccctggaacctgtgactaggagaccttctatgttaaaagggactttgtagatccagttaaggaccttgagatgaggagataatcctggatgacctgggtaggcccaatatcatcacaaggtttcttgtaagggaaggagggaggtaggagaggcagagttggagagatttgaagatgctgtgcttatggctttagaaatcaaggaaggggtcaggagccaaggagtctgggcaccctccagaaactggaaaaggtaaggaaatggattctcccctggagcctctggagagagtgagcatggacattttgattttagctcagtgagacccttttagacttaagaccgccagagctggaagatgataaacacatgctgttttaagccactacgctgaaggtcctttgtcaaatcagcaacgggaaatgaatacagtgtgtgtcaacctccaacctcatgggttgccaaaggtttccctccaatttgacacccaggctgggacttaaatataaacaggagttgggcagaggacgaaggtgaaagcagaggatagtaaaaacaacagcaagaacaattctgagaggggcacagagctgaaatgtgtccctatggcgagccacaagtagggctaagtcacatggggccttgtgatacatgctgagaaacctgggtcacattgtcctaagtccacagacagcccctgccccgggggtaatgaggtgatcagatgtgcctttgggtgacatcactctaagcgctatgaggtaggtggattgtagggagcttgaattgatataggctgtgggaagctcctgggtgagaaatgggggtagccccaccaaatgtatgttcattctactgagctagactgcccatctagcctatttctttgtactaatattagttatattcaatactctccatagcccggaccagactgtaaacttattaaagatggacttattcatctttgagttccccactgagtctagcaccatggcttcctcgcaaattgtgagggctgaggaaagtcttgcagcattgagctcttccacatcaatgtctaaatttgcctaccacttaaaatatgcccagtatcaggtgctcctcttaattattcatgcataagctcagaagattaattacacacgtatttgtcacaacagtaaaaagcttgaggaacttatatcatcagcgagaaccgagcgaacacgaatctgagtaggtagaaacatttgctaaaaaaaactcaaggctatcctacaagtggattatttcagatgctaaaaataaaggaactaaaataaccttaagtcaaagggttactttggctgaaaaattattttgaagaagaacaaatgaggatgccctaaggaaactaagaaaattattttctaccttcccatgggagcaccagataaagacacacaccttttcatcataccagcaccatcagacaacacaacccagtctctcatttagtgcaaaaaataaataacaacaggtaaactgatctgagaatatgatgacatcaagtctccaattcaggtaaattattcaatgtcttaacatggcagaattttagttaagtataaatggctgtactagtgcagtatttccaaatcaggttaattctaaatcatacaatacattttttaatttgctgataattggaaaccaagtctacataactccaaagcttaggatttgccacagctcaagaaaagactgcagtaaaaaggaagaagtgacaccctgaaagccctctgcttcaaaaacgaaacacagttatgggaaggaggtagcttgtaattcaaagcttatgaatctgctagtttagggggaattttccgacctcatttataccttgcatggcttaaggttctggtcctgtttaatctctgcagtttttaaatcacttttctagttccctgtaaatcaaccatataaagacaggaagataggtggatttctgaatgattggcctcaaatctagcttccctttgataagcagctcacaaaagatctgaaatgagattctgatgtttaacattgcatagttttggaattttaaatgtgactgaaattcattcttgggtatgagggtgttaaattgttatttcattattgttcaaagctgctagagtacgtaatgattaacaaatataatattctccaactacggaatccagctctcacagtcagcaaatgattgatcactgtctggatagcagaaaacagattttaaaacatagattgcattaaataaagtacttaatgaataattatttgtattacttctggataaattgcttggaactcagagcttcctcttactgtgagaattaaaaaagaattaaattcctataccattccacttaatagaaactgcatgcccacattttaatttatgtatctatttctaagtagcagtgaggtaagacttgttgcccacatgttcaaggccttgaaaacaggccccatgctcttctcatgatcatagaaagaagaaatatcctttgcttgaaaggaacagagctggaatcttaaggataaataaaaactcaagagtaatataagtcattttatttccttatttcactatcacccaaaataatcttttccacaaccagagcacagatccctaataattacatcttaagagaaaagtcctaatcctttctgtttccaagcaaacgattatttctctgcagtgttaacttagtagagtcaatgctggtgtttgcctttgggtcttaatttcttgatgaggaacacagcctaagttactacttaattacctctattttttctggtgctgttagcagaacagaagcaaccaacgatcccgcagacgccccagcgaaggctttgacatccttcacaagttttttgccatgtctgcaaagtgcagatgctgcccccaagtggtaaatgcccagaaatccacacgctgcaaatgataggttgatgtgcttcattctagctgtagcactggcaatacaaaaaacaaaaatgctgtaagttggaatagtttatcccacatactgtgtagtcttatgttgatcatcgttccaaggctttcttctaacatcattctctgttttaagcacagtggtttcaattaattctaattaaacacaagaatctttcaaggaaaccctttctttccctcctcaccttgacccaagtcttatacattaaaacaaaacaaaacaaaaacattccacatttattcggtacatagattatgaatctacgatttaattacttggcaggaaacagacgtataaattccagttgacaagggcatttggtcttttctcttgaccctttgaaacgttttgcgggtgggggcggcactaccattatgaaacagaaaattattagagaccgtatcaaattccaaatgaacaatacatttgttcttggtaagtgtatcagaagatttcaaatacagttccctactccccttcccaatttctattgtgagcacccatgcttttatgaacgccaatacaattactcagtaacgcaataagcaatcactcaacaatgcaatacatttctttgccaagtatctcaacacaaactgaggtcatgcctggtgaaggcaatttaaggctctatgaaatgtcagccacgccactttatacttggaacacatctaaatacaaaattacatgttttcctatgcctcagtgcgcacaatttgcccaagtgaatgaaattgtgcctccacaaggctgtccattctgaaggtctcagggtttccttgggggcccaagggccccattcagggaccccaagatgaggcacattacagggcctcgaatttagggacctaagaccgcctgttcctgatgcacccggccaggccctgtgagggcaggtggctcggccgccgcaggctgcgctggcgtccgcgtaggctgagtcccagtcatcgatccggggtcaagccccagttttgattccacttctgcaaatggggacgggaagggggttgggtgtgtagcaaccaggcggccaggcccagccagcacaggctcagtgccctcccgcggcttggaggccggcagggccggggtggtccccgcatcagtcccgcaggagcacacccttgctgggccccagggctccgtaccaatgcagccccgggacacttccgtgttgaacgagtccctttaaccagatggcggggccgggccgtcactcaacgccattccgccaccaaggccgcgctacgctctccgcgagccggcccaggaaagtcctgcggcaggggttggtaccgcctcccgcgcaggtatgtgacgtcatcgcgccgacgaaggcgcccgctaggccccgcctgctctatttaaacttctggactcaacctggccgctagaccggagcgtcctccagcgcaggcaaggattcctcgtttagagtcatgttatcttcgagtacctagagagacattttaacccacaccctagagaggcgttgtaatccttacgtgtcttttaacgctacttggcccttacctgcgagcaactgacctttaataatcctcattttctgtgccccggaagtgccttaccctcttcgcgtctgtttcccggaagtggttcttctccctctccaccctttcgcccgcctgggcggtccagctgcccctaggggccaactccagcggctattttggggctggacatcccgcagcttttcaaggcgtgcctttggtttttttaagaagtgctatctaaaggaaaagctggactatgactctggggaactttcatatcctcagttgaccttaggctgtgtgaccttgagcaggtagcataacctctctgagtttcccgcgtgccttatgtgcagattgagatgctaaaatgagagagctaaattggaaagctttttccacatagggggccgtgagcaggtggctgttttgtcctctggcacctttggctcagacttaagcagcttcaacgaccgccaagatgcctgccatgcccaccaagatttaaaggactctgataattctttctctccccaaacggtgttttccttatctaatcctaataaccaagcctggaggaatccctgacttcgtgattgaaggctctccaggtcccctagtttaagggcagagatttactttctctgaggctacaaaggagcgtctgcgagaatgtctctaccttagacaaaacagggaggaggggtggagctctccaaattgcctctggtttgggctttttctttctgttttggtgtatcgtctctggccaacaacacctgtgagtccttgatgtgacgattagggaagatgtttttaattcacataactattctttagagaaaattgatcctgaaacaccttattgccttatcgtagaatgactgcattactcagaattctttacctctaccggaatttagtgaagggaaggcacaacgtacattaggaaaatacaggacacactccagtccttaaaccttccacaatcttctagctctttaaggtcgagtgtgatcctccccagaactgcatcttccaggaagctcatgagaaaggaaggatcccaggtcccatctctgatctgagtcggcatctgcgttttaacagaatcctgaagcagtggtctaactcctttggtggtgttattgtttgcatgtatacctccaaaattcacatattgaaatactaacccccaaggtgatagtattaggaggtggggcctttgggaggtaattaagtcatgagggtgaagccctcatgaatgggattagtactcttagaaaagggaccccagagaggtctctttccaccatgtaaggataaaagtacacggagaagatggcaatctgcaaactggaaaagggccctcctcagaacctgaccatcttggcaccttgatctcagacttccatcttccagaactgtgagaaataaatttcttttataaacactcagtcaatgctactttattatagcagcctgaatggattaagacaggtggtctggtttaaagtgatgtggtggcatcagaagtttaaggagagactggatttacagaaccagaatctgggatgctgtttacagagcaagttatttcctgcatttggacactgtcagcaggtcgattcaggagacaggtgaaaactttatcaccgggcagcctggatgaacaccacaactttgatatctttcacttaaaggaaagataagggcatccactatttctacacctggctggcagagtgagagctcaccaaaggtaagtctctttggagcagcaaaatgctccataatttaactcttaaaattttaaatttatttcctccttactcccttcaatcccgtatcatatctccatgtaactagttaaaagttcagctctcagctgggtgaggtggcatgtgcctgtagtctcagccactcaggaagctgaggtgggaggattgcttgaacctaggagttcatcttcagccagagcaatgtagtgagacctcatctctaaagaaaaaacaaaaaacaaaaaaagttcagctttctaatgtaaggaaggatatattcattcacatttgtctttgtcatctcatcgccaagcttagcacttggcccatagtatatgatcaataaatatttgttttggatgttggatttatgtaaattaccattgtgatctgaatatatagtaatttaattgctctttgaaacttttttttctgtaattaatttgcttatttttgctcgtctattttccttagtaatttagtttcaaacgggtttgtttatttagccatttacgtaattattaatcatctgttgtatagcaagtgttacgttggtacagggcatacacagttgaaagaattcagcccttatcagggatgcagagtccagtggatagggagacatctgatgtgtaattacagaggcgtgatgatgtggtattgcaaagccatgcacagatgccctggttgtgcacaccagctacggagtaggaaacctttagcttcgggaggtgcctacagtagcacccagcacagaaacaaaatgccccagcttgatggctccttttcctctccagtgcttcctctcaggagattttatcctgtatcccataagggaggagaaatggacatgggtaagtgttgcttgtccacacctctgctccagggaaaggaccatatctcagaatctttgagtctaatcagttctttcagtctactctccttgtggtgttatttcattttccagtcttggcattttttttttttttttgagacagagttttgctcttgttgcccaggctagagtgcaatggcgccatctcagctcaccgcaacctccgcctcccgggtttaagcgattctcctgcctcagcctcccgagtagctgggattacaggcatgtgccaccacgccctgctaattttgtatttttaatagagacggggtttctccatgttggtcaggctggtctcgaacttctgacctcaggtgatctgcccgcctcggcctcccaaagtgttggaattacaggcgtgagccactgtgcccggcaggcatcttaacacctcttgtcggtcaacgttacaagtgctttggttttttaaaaaaacaaatctcttgtcgtgtattcaatatgctttgcttattctgcctcctgcttgataactgctcttctttgtcacttcctccccaaatcttgcaaactgatcccgatgagctgtggagcttagatacatgcactttaatttcaggggagtgtggcaacactgctggagcactgccctttccatgggggcttcaaagtgatactcatgataacatgccctctgtgcctagtttaagcaatatcttgtcttgagaccaccatggagttcagagaaaggaacttttgcaatcttggagtagaactgcccatccgaaaccatagaaagaggggctacttccttcctatagatcaccatctctaggaacacagtgagggaatagatgaagaaggtcatgtgtgaatgccactatgtggagggagccagcctgaaaacagaggcagcttagagggatccagagctgagaatgaggtagagagagagagacagacagacagacagacagacacagacaggcacctaggtgtggttgcccctcttgagcctgtggatgcaaatgtaatattatacattgaactgaaaaatagagatggtaaggatttcctgagtatttctgttatcgtattagaattccttaattacagtgcttgtaactggtgttctagataaggtagagccggtaagctttcaaaggtttcatgcataaacaatatattttatattcctgactcgctttccccactacacctacccttttctatttgttaagttagttagcattgagtttctaaagcttgcaaaccaaaccgttcttactaatgtaagtgctttttacattgcgcatggctgttttccattagaaatatgctacaaaaactgactacttaaaggaacactgggtaaattctttctaaatgtaatatactttcaaaaaatatgaattttatatatataccatattatatatattacattattacatatttctgttatatatatgtttacatatttatataaaacaaaataagacttttctttgatagcatctgtgttttagtctgttcagactgctataacaaaatacccaaaaccgggtggcttatgaacaatagaaatgtgtttctcacagatctagaagatgaacattccaagataagtcactagcagatggtgtgtgttgaggtcctatttcctgattcatagatggcacctttttgccctgtcctcacatggtggaaggggcaagggagctctctggggccactttgataagggcactaaacccattcatgaggctccaccttcaggacctcctcccctcccaaagaccgcacatcctaacaccatcactgtgggggataggattcaacaaatacatttttgggatgggacacaaacattcagaccatagcaatctgaaaacataattcaaaatagccatcctttggaaatataatttatttatgactcagtatatctgataatatatgataatctttagatcttttaacatggtgttgaaactaaatatcagactatttctattaaagagaaacattttaaaaatgtgacatttattttataaacttcattttaatttaatatgtgaagggttccaaatgtaatattatgcattgagctgaaaaacagagatagtaaagtaggcaagctttcagagttcttatacttaaacgatatattttatagaaaacgggttcagatccttgatagccaggtggtgagtatgtggtaccaaatgtacacataatcctaaatattttttaaaatcccagtcaaagaaaactggtattctctgctctgtgtacttcatcgcaaagcaactgtacagtggacatggctgctaggggtccaccaattgttcagacataaatagtcctttctagccttcaaatatttttcttatcatggagccgattactgaggaaataatatcaatatcaagtaagtaatattgttgggtgacaggtggacagcttcagtgccttatgctccatcaaattcaccaaaatactgtattttaatttggagtacaagatctagacattaccagtgctgttatcaaaatgaacaccgtaactactaaaacatttaattatctaatcacctcatttcaaagagacaaaataaagattttggtctattctttgttagtaaaatgccttgctttcctgagcacccactcctattattagaatcttattattaatatttactacacttattgtctgcccactccatgccagtcctttatatacattgtctcatatcacttgtacaatgttaaaagatagaaatatatgggccgggcgtggtggcttacagctataatcccagcactttgggaggccgaggcaggtagatcacctgaggttgggagttcgagaccagcctgaccaacatggagaaaccccgtctctactaaaaatacaaaattagttgggcgtggtagcgcgtgtctataatcccagctactcaggaggctgaggcaggagaatcacttgaacccgggaggtggagcttgcggtgagctgagatggcgccattgcactctagcctgggcaacaagagtgaaactctgtctcaaaaaaaaaaaaaaaaaacagaaatatataataatatataatagatgactcaaataaaaagagaaatatataatagatgaaagtttaaggtagcctttccatatctgtgctgagattataaggccaggttgccctgctctaaagcctgtgcacaaattagtaaaatactaagcttttatgatgtgccaagctttgtgttatttggctactctgagtctcagaatctttcttcctgtaattctttctcaggttagaatttgtgattggtttcatatctggatgtttataatttaaaaatggtaaaagtcttaatagatgttatatatgagtttatagcatttaaagaacttgttcgcgtcttgaaaagaaaaataaagcaagcctagcaattaattaaaactacccttctctattgatcatttgcagcagtaactcttttttatgtctccttttcctggaagctatgtcataaagtaggtgattgtaaaacaaacataatttccattaggagcaatgttataaaaggggattatgttattggctaaggtcttaactacaaataaattatgtatctattcatttgtcttcacgcctttgctctcattagataaactttttgtccaatatatgaaaagagctgggctaggcattacaaataaattttaaaagaatcttaaggtaaactgttcctttagctcactgtattttcttgttcaaatgtcctttcatacttctgtgtcccattaagccctactttttcttcaaggcctaaatcaaactctacttgtggaatacattcaaccacctctgttaatcttagccacaccctcatctttgttactatgtgtacattattgctgtagcatctctgaccttttatttcagttagggatatgctcgccaccactctctaggttcagagttcatttggagcagggactatgacttgtactttttggctttctccagcacatagaagttagctaaagcataggaaatgagtaaatgtttataataagaatctttaaactgggctgggtacacgcctgtaatcccagcacttcaggaggccaaggtgggcagatcacctgaggtcaggagttcaagaccagcctggacaacatggtgaaaccccatctctacttaaaatacacaaattagccaggtctggtggtaggtgcctatcatcccagcttctcaggaggctgaggcaggagaattgcttgaatccgggaggtggaggttgcagtgagccgagattgcgccattgcattccagcctgggtgatggagtgagactccatctcaaaaaaaaaaaaaaaaaaaaaatctttaaactacatgtttcagatatctagctagctttagcagaggaaaatatgctactttaaataatcaaggtgctagaggtagtgctaactgcagatatggctcggtcaggcactcagtgaatgctgttagggccatgtattagtctgttctcacactgctataaagaaatacctgagactgggtaatttataaaggaaagaggtttaactgactcacacttccacatggctgggaaggcctcagagaacttctaatcatggcagaaggggaagcagacatcttcttcacaaggcagcaggagagagaggagtgagcgaagggggaagagccccttataaaaccatcagatctcatgggaactcacttattatcgtgaggacagcatgggggaaactgccccctatgatccaatcacctcccttccttgacacatggagattatgggtccctccctcaacaggtgggaattataatttgagataagatttgagtgggaacacagagccaaaccatatcagatcaccattttgccacttcctctatatgtttctcttcttagtctcattctgcaggcagcccctcatcttcttagcttatcagtggaaaagtgcttttatcactatctccctcccaaatttagaaaaagattcctgttggttctgtttttattacatgcatgtccttgcaataatcaatgtgaacagcaaattatgatacatgatggtttgagcccatgatgagatgagcatgggctgtgcagacagtgggtaaatatgaatggatgcactgcgggtccagagacagttgggtgggaaagccctcctaggaagaggcctggcagactcaatccacctgtccactgcagtatttgataaatatttgttgaattcaatgaaagcaaaagggcggctgtaatctctgtataaaatgggacaatttgctttactccttttgatacataaaactatatagtacatatctaattggcacacattccgcctaagcgaataggaacacaagtatgatgtttagtacaaccaaaagttagttgcaatattagatatgttcaaattaacagtgtgttacttggcatcagtgttgtccagcattgaattaactatagggttacttggcttctttgaatttcatgggctattttggatgtgagagggggcataagacttgctcaccaagtcagtgtaaatgaatgatttttcactgtgataaatttccccatagggagctgtgctacttagagtggtggcaagaatcttatcttacacatgggatgaaagtagatgctaagtaaatgtttgtttttgacatcagtgacaataatgataatgcttttctgccaaaaatttttaaggagtaggaggagatcccaaggttctctccatcatctcttactttagaacatagcatcataaggcattttgaaaaagagaatagtcaccatttagtggacatcctttaaggtatcatattttgtgttaaagccataaataaatatactattgacataaactttcaaaaatgttctttacaacaacttcactaaatttctaacaaaagtaacataataccccaacctatacagatgcattccccatttggaaaactacaaaaagaataggtaaaagtgggccaggcatgtgagttggaagtcacagtgaaattccaaaagggccctggctgacatgtagaaggtggctgtagtttcaggctctcttattatgacttgaattctcagaaaaccagcagagaagtagggggctaatagaacccaataatatgtgggacaatatttgttgaattgtatggattgattctattattcctggtgaaaaaattcccaagctctaatgaactgtcattgattcctgtaagcagctaaatgtaaaataatgaaaacacagaattcaccctctgtgaacgaaagagatggcaagttcaaagtcattccaacagcattaattacatgggaaagcctatccccaggtatacctgcctaagatgtgttttgcatttttaaaattcccaggtggaagctggagagccctatctatattgtccttttaagcaccaagctttctttcctatattttattctctcacctcatcttgagggagcatgatcccactcttaagatgcactagaaatgtcatattaagacagtaaacctttcataatataaacatttgagtagccatatagcaccttcacatctcacttaaaaagcaactgtagaagccaggcatggtgactcacgcctgtaatcccagcactttggaaggctgaggcgggcagatcacttgaggtcaggagttcaagaccagcctggccatcatggcgaaaccccatctctactaaaaacacaaaaaaattagctgggcgtagtggcaggtgcctgtaatcccagctactcaggaggctgaggcaggagaatcgcttgaacctgggaggcagaggttgcagtaagctgagatcgctccactgcacttcagcccaagtgatggagtgagactccatctcaaaaacaaaacaaaacaagacaaaatcaaaaagcaactgtagaaagcagaacacaccataaatataccataaggttaaggttcttcaaaaggctcattatcattctggaatttagttttcctgtatcttcatgtatatctacaccaaaatttagaaaattcactgagcaccaaagatgaggacatttttctagttttatcagagaaaataattcagattctgtagggtatagaaacatttacaagataatattttaaagagaactgagcttcatttcaccattctgtgaacctaggcaaaagttacattcacttctgttggaaaagaaactgaaatgacatttttgcttaattgttaaaagagaagtaccttctgttaatgcggacaaacacattggttcaatgaccccaattttacttacacttaacatccacccaaactaaattttcattaactgttgatgtgattgttgaaattgcaggccattttccatcacttagatgttttcaaatatcttttctttttttactttctatactcattttgttttttactttgtatactagaatggcaaattactatgatactgtatgcaacacaaaacctctctgtatgtacttttaatttaccttatattttatgttgttagaggaaagagtgttaagtttatgtttttttaattaacacacacttgcatggtgtttactgtgtgtgtcttctaaccaccttacagatatcaatgcatttaatcatcttaataacgctgtgaggtatgtactgcgctggcactaacattttaagagtggctaaatggtctacaaagagactaagtaactttctcaagatcacacatttgatcagtagcagagccaggattcatttctttaccattttgccatggtgcctccccaatgccaaagtcaaaagtagcaaagtagacccatgttcacaggttgtttatggcaggcattttcgtagagacattgataagtgaattgagaaatgaggctgtccagctgtaccccagcaggatcttgagaggctcatcctcctctaccaagctattaaatgtcgagttatcaagacttagacttggggtccatttccttgtgccaactaggggacaccattcctgcccaaagctttggtgtggtctctcagcctccggcctccacatcaggtagtgtggtaacacgaggactcctaatttggactgcctacctgtgcataggggccaactcaggatataactcagggaaagcccctgcctaggtgaagggggaaagcccatcctgcccactagcacagtcgaggtgtgggagaaggaaaaagggctaccgaggcagaaaattaatgtgctacttcccccaccttcatggttctatgttgggagtgctcttgtagacgcacacaggaaggtaaagggcatgcctgttttcccacacatggccttggggagctataatactctagtacagtggttctcaattctgctgcttttgatgagtttaggatggagcccaggcatcaatattattttggtggtggggagtcggcggggtaggggtggcggggggagttgaggggacctctcaggtgaatctaatgtgtagctggggttgagaaccactattcttagagaagttctctggttggtcaacatgacaccaggactataatgcaggtttgggagaaggatatgcctggatcctgagctaacataagcgtcagcctggtgatcaagggatctggaagattctgcctaccccaatgaggagtgacagaatagctgagcaaatccaggccggcctgagatggggatgcagtcctgggggtatagagaacagaggcaaggaccaggaccatggagtccagcatcaggaacatagctggtgccacacgtgccaggtgcaacctcagggaacgccagtccaggaaccacccagaccagcagagacagcacagagccttctggtacttgatcacacctcccatttcttccccgttcacaaagtcctaggaacagtgctggatacacaatttgcagggtccagtgcaaaagggaaatgaagaacctgtgcacaaagagcaggaaaaaaaaaattgccattactagctttttccttatttctgtggcctatctccctcaatttgttaaagagttttaaatttgctatttgatgtctaagtaaagaaaaaatggtaaataattagcatgaaacttcatcattcatgtttatattgcatgatgccagttttacagacaaatatcagagcatttaagtaggatgtgggactatcacaatcacacaacccatgttttgtagcctacacatgcacatgcgtttcattctggcctgaatagtgaggatgccgtgcaagagtagcccaactcttctgattccacttcttgatatgcacacattgaaccaacactctccacctgctgagtgaggaaggcctgaaaggaaaagaattgtgggctcctctatcttttgctttcctctgtgtcatcattttgagcttaagtggctggccaatccaggagatgacatggataggtaggaaaggttataacaggcttccttggtcacatgtgtttctttagtatacatttgctttctctctgctttcgaagaaaattctggttcaaatgggaaaatgtggcatctgaggctggcagcatttctcctaactcagccatgagtataacactgtcccttggtacttgctttgagactgtgatctcccacgcattgtgggtctattgttcttctgtgctcatgaagcatcatagaccctatgtgtacgaagcaggcagctgggaacagcagacgtgcacattgccagtatctcctctgctcatgtttatacatcagtgtcccatcagatgtcccttagaaaacacaagttcaaacataaaattactacagatttcaagatggccacagcagagcattaatccaagtatggggtccttctgagcatggggtcctttctgagcatggggccctgtttgactgtgccagctacctccccatgaatctggtcctgctcagggatgctttccagtattcccagttaacatctcacagaaaatggggagagaagaaactttttgctctgcatgaaatgagactgttgtgattattagatactagtgataacatgaaagaacaaaataatttactcttggctgtttgtttaaaatttctattcctgagattcattgccttagttaagactgctttggttgctgagagaaaaagcagaaattatatgtggataaagaagattactgttagaatatacttgctaaaaaagtagatttcaagtgttctcgtcacaaaaaaatgataaatatagagataaggcatgttaattaagttgatgtggcattccacaatgtaaacatatttcaaagcatattatacgtgatagttatataaaatttttctttgtcaattaaaaaaataatacagaacccagggaaggggggatgtctaggggattggcactaggaagtggaaagccaccggaaaccatgtgtcctctttggatttccagggtcttgtggattctcacttagcatctcttgcttccattccaggagatccactttctctgattctcagtgtgcacaccataaccaaacgtggcagccttcagctctggagtttatacaacctcagctcaggcaaacagcacagacagtgtagagtctcatttttcctagtccatatttctggcagagagaatgtgattggacagatgtccctggtcctagcagtgatgaatggtgagggctggggggccaggacttggaagctcatgggatggacaacattcctgaagttttctactgcacccttcgtacttggttaaatgtcctggtcataagttaactttataatagataaatcatacatctagatctagatatctgctttttctcttactattgtttacatttctttttttggtaactggatcaatacagaagatgagcacaacattttataaataaaagataataaaaataatctgggagcagttgcagagcccacgctgtgtgccagtatctttgctcatcgcgttgtattcattgtgtcagtgtccacaataagcaccctggagctgggtaaagtcactcaccccaaaatgccaaggcactttcccaggggcctggacaggaaggaagcagagccaggaaagaaatccagattcaaatcagtgctgagcctgtactctttttactagaaaataacaaacacgagctggcttgattatgtactcttttgagaaactatcatcattatcattatagccctcactttctccctggttattcattgactgctgtcagagttcagacaacttctgatgcttgatttttttcaaggaactcaattaaaaagatagtagcaattaagcacagcagattgtcagaaatgtttgcccttagttaatgagtgactttcagaatagtgctagtgtgtcctccaagattacatgcataatcccacaaaaattgatgccaggtgggcctgacctgcgtgtgaaagtagatttcttgtgttttcaagatgtttttctatagccgtttccagtctgccctctgctggctcatgagaattggatattgcaaatcacagacccaggcaagtaaatgccagagagaagccacaattccctgggttgaaagagccaaggaggtctcaatctcataaggccttagtccattcagaaaccaactgactctcccactacctgtattttaccctttcccaaaccaactccaggaaggcatcaggaagttttcagatcaatgttatcctctgcttgcatttacctgtgctgcatggcaaaaggctgctttatgttacttatctgagtcatgactgaaatgtcagtgcaaaattaaattgataaagattgaaaagagaataacttagattagtgttcatcatctttgtgtctcttgtttcatgcatcctttaccttgactctgcggagctcttactgattttgaacatagatgaatttgattttgtccagaattaaaaaatcaaacagtcatagagtatagctacttgttcagactgtttttaatttttatttttatttaaaatgttcactatattgccaaatagtaattactttattaagcccacttatggattcattttatttttttggtgaagcaaactaaaggttaaaagtgaacataagacaatttctacattaagtagcataattattcattagatcttaaaattaaagctactgctaatgtaacctttaggatatgaagctaggctttagaattatgtttgtgtgttgatacacacacactcaatggggactattcatttcacaaaccaaatatatgttatttctattcttgttggaatttagttttaaaaaaaattttttttctgatttccaaagaaatgcatgttcaccatagaaaatttaaagaatacaaacaggaattaaaagactacctatataaaattatatgtatgatatattcacacacatataggtaaaagcattttgtaatttactttgtagaaatttctatgtcaaattttaacacaaaacattatatcaaaactaccaatatgttataacctaataaaagagctgccagtaatttaagttcttacatagtaagttacctaatattatgaaatatacacgactcctttttacatattttgtttccagacatcaataacctagactcatgaatatcatttttgcacataatagttatggataggagactaaagattgtattagatgttggtgtttgattatttactaggctttgtcaccactgaaatgacttctcacccactgtttttaacaaccttgctggtggaatttgtgtcctaataaatttataaattatgacatgccaggggcctcaatactagaaacattaaatgcatgaatggcgaggatgtctataaagtaataggatatattttttaacacatctgtcagtactcatactttcaagcaagtgttttcgtcaacataggttaagagcttaccaactgtttccataattgatgaatgtgtttccatgaatctatttattcatcaatatcaactgagagtactctgtgtcttggcattttcataggcactgtggacataataatgaatgacacaggtagtccgcagtctaaggatgggggcagatgatagcctttgcaatacaggaactaagctgtaagtggaaggtggtacaagacaatgtgggatcttacccactccagtcccaggggtcgggtcacatgtgaaaacaacatgattcctatgctcagtcttggccattggaattccagggcatggctaaacagttgagaaggtaccttaatcaggattgtatcatagtcccagaaaaaggagagagctgttttggaattgccttcaaaggtttagggtattttgttgaatagcctatagggaagtaaatgataacatttgatgtaatttgtattctttttctctaagctaaagtctaacgtaataccggctgctaggtcagtgtagtattagtcacactgaccttttaatagctccagggttttaacagagggacaggcatgcagtagatgctcaatggatgcttatcaataactgactacaagacagctaacaaaatgattgaagcacaactggaaaattctagtctaaaaccagatagatgtgagtgctgagacagatttgcttgtatagcttgctagttgattatattgcttccaggaactctcctgcagtaagagactcatttgaacaagttagggcaggttgccaatccgagtattggcagcctgaatatgccttgactattcaagttgagtacttcgacgagggctataagcatttggattttaacgttctgatacactttaaatcaaacaattaaatatacctgtatgtaaatatatgtatgtaaatatatgtatgtaaacatgtgtgtaaatatatgtatgtaaatatatgtaaatatatgtatgcaaatatatgtatgtaaatatatgtgtatgtaaatatatatatatatatatatatatatatatatatattgttcactttaaaattactcagtttgcaagtgtgttgatacctttacatatgtacacacattcacagactgcaggtttaattgatgtgacttaagtcagcatttgcttttcttgattcatgcagattacctggttcaaatccagactctaccgtctatggctatgttaccttgggaaggttacttaacctctctgtgcctcagtttctttcttttcaaaattttttttattttcaatttttgtgggtacatagtaggcatatatatttatggggtacctgagatgttttcatacaggcatgtaatgtgtaataagtacaccaggaaaaatggggtatccatcccctcaagcacttatccattgagttgcaaacaatccaattacactctttattttaaaacgtatggttattattgactgtagtcaccctcttgtgccatcaaatattaggtcttattcattatcttgttttgtacccattaactacccccacctatctcccaccccacccccgctaatcttcccagcctctggtaaccgtccttctactctctatctccatgaattcaattgctttgatttttagatccacaaataagtgagaacatgtgatgtttctgtgcctgacttatttcacttaatataattatctccatttccatccatgttgttgcatataactggatctcattcttttttatggctgaacagtactccattgtgtatatgtaccacattttctttatccattcatcggttggtgttggtggacacttaggtacttccaaatgttaggtattgtaaatagtgctgcaacatacatgggagtgcagatatgtttttgatatactgatttcctttcttttgggtatatacccagtagtgggattgctggatcatgcagtagcccaaattttagtttttttagaaacctccgaactgttcctcatagtggtggtgctaatttacattcctgccgatagtgtacaagcgttcccttttctccacatcctcaccagcatttcttattgcctgttttttggatataagctattttaattggtgtgagatgatatctaattgtagttttaatttgcatttctctgatgatcagtgatgttgagcaccttttcatatgcctgtttgccatttgtatatcttcttttgggaaatgtctatttgaattttttgcccaccttttgattggattattagattttttttctagagagttatttgagctccttatctattctggttattaatctattgtcagatggatagtttgcaggtattttctcccattctgtgggttgtctcttcactttgttgattgtatcctttgctatgcagaaggttttaaacttgatgtggtcccatttgttcatttttgcttttttgcctgtgcttgtggggtattgctcaaaaaatttttgcccagaccattgtcctggagacaattcctcaacgttttcttgtagtagtttcacgatttgaggtcttaggtttaagtgtttaatccattttgatttgatttttatatatggtgagagatagggatctagttttattcttctaaatatggatatccagttttcccagcaacatttattgaagagactgtcttttccccagtgtatatgcttggcacctttgtcaaaaatgagttcactctaggtgtatggatttgtttctgggttctctattctgttccactggtctgtgtgtctgcttttatgccagtaccatgctgtttgggttaccatagctgtgtagtataatttgaagtcaagtaatgtgattcctccagctttgttctttttgcttactatagctttggctatgctgggtcttttgtggttccatataaattgtaggattgttttttctatttttgagaagaatgtcattggcatattggtaggaattgcactgaatctgtaggttgctttgggtagtatggacttcttaacaatattgattcttccaacccgtatacatggaatatttttccattttttcgtgtcctgttcagtttctttcatcagtgttttatagtttttattacagagatctttcacttctttcattaattcctaggtattatattttatgtgtggctattttaaattggattacttcttaaatttctttttcgccttgttcactgttggcatatagaaatgctactgagttttgtaggttgattttgtatcctgcaactttactgaatttgtttatcagttctaatagttcttttgtacagtctttaggtttttctaaatataagtttatatcatctgcaaataaggataatttgacatcttcctttccaatttggatgcccattgtatctttctcttgtctgattgctctagctaggacttccagtattatgttgaattaacggttgtgacagtggtctgattttcttttctgctctaatagaacagcactgagttaagtgctactgctgtggggcgtggggtgagtggcattggtgattcaggactgtttttttctctctttagtgcctctttcagtgatatgaagttaaaaccaggccctatgagtgctcatctgatatttagttcttatgaaggtgtttttttctgtgtaaatatttgttaacttggtgtccttgctgggggacaatctgtagagctttctgttctgccctcttgttctaccttgtggagtcctgataagtaagcaacaacaaggaaggggctccaggtcggggaggttcccagattggggagggcccctagtgagagtgagcaatgaatttgtattgagagacagccaatcacaaacaacccactgacacaactacctccctgcgcacataaccccaacagcatgacctcattccactggtagccccctccagcacaaccctgtaagacttccctccaccccctgcctcttggcagacagccccttttctgctgtgctgcctgttgcacccttgtaatgtattttcatactttctctaataaatctgcctttctttacctacagctgtcttggtaaattcctttacctcacgcaacactggccccagcctattgcacccgcgacgtgcctccctcagtttcttaatctatggactgtggataatgattatgcctaaattatagaatgtttatgaggctaaatgacctaatatacgtaaggagcacgggatactatttgtcaagtgttcagaacagttgaactattgtattgttatcctaaatcatgacaagattaacattaaaaacatttaacttagtagatcagagtaatcaataaaatgtgtgttaagaggataatgattatacttaaactttaaaatgtatctaaggctaaatgagttaatatatgcaaagagtatagactactgtttgtcacacagcaactattttgttaaccttaaaaatatttatattaaaaacatttagattaccagatcaaactaatattttgaaatactttactatttttatttagcatgaagctttttgattatctttaatgttttaaatatgttgaaaaataaaaattactaaaacaagaatgaaattcaatggttaacatgagcagtaatttagaacaccttttctctccccagatgaaaaatgtatcttcaagtaatccaattccttggaactaaatacattttgaaattctaattcactttcctataatttatagatctaacattattaaaatattcatatctttgagctaatgtggcttaacaaatttaatttgcaaaacaaagatgacatgaaaagagcatgatccataatcacttttttcctaagccatatgtggtaggcacgccattaaaaagacaagctagtcaaccttataactccatagaactgtcaaaataaataagctattagaaaaccaggaaaataacagaattttggaacaaagtgtttccctagaattttttttcattatttctcaaataagcagagtacaaccttggatagggttgtttaagatgtgtggagatgtttgaggctgttattttgcacctggggggcttttgaccacggtgcagtctgaaacctgtaaagggaagtgggagtggaggaagattggataggaagatcctcaggtgtcattgtgtctccgaggaaggttcagccagcccaggggtctccagtgcgaaaatcattcatagggtagcaacacagaagacagaaatgggcataccctactgtttggtcaccatactccaccttggctaggagctcccacaagaagagtgtgacttccacataaacacagcagctgatcttgaggcattgcagctggaggctaccagccagctgtagtccctgaagctagtaaatgacctcttttccaaagggagcttctggtggcacatctccaaggctgccagtcacctatgtttctaaatccattcgagtatctgtatagagtctgttcctgtgctataaatgccaaggattgccagagttcggtattgctacatttctgggtgtttgtttctctacattgtcttacttgaagactgttcatgtgtggtttgttttatttaagagtgtgtgggagggggggtaaagacaagcacaaagggcttcattgtaattaagcttgtttagttgaagggacacttattgatattgtttggctttgtgtccccatgcaaatctcatgtcaaattgtaatccccaggtattaagggagggacctggtgggaggtgattggatcatgggggtggttccctgcatgctgttctcatgatagtgagtgagttcttaagagatctgatggttttataaggggcttttcccgcttcaccctctttctctttcccaccaccttgtgaagaaggtacttgcttctccttctccttttgctgtgattgtaagtttcctgaggcctccccagccatgcagagccgtgagtcaattaaaccttttctttttaaattacccagtcttgagtatttcttttttttcctttttcttttctttttcttttctttttttttttggagacagagtcttgctctgttacccaggctggaatgcagtggtgtgatctcggctcactgtaacctccgcctcctgggttcaagcaattctcatgcctcagcctctcaagtaactgggactacaggtgtatgccaccatgcctggctaatttttgtatttttagtagagatggggttttgccatgttggtcaggctggtctcgaactcctggactcaggtgatctgcccaccttggcctcccgaagtgctgggatttcaggcatcaggtacttatagcagtgtgaaaatggactaatacacttattctgcctataatactgtcttagtctgttcaaactgctataacaaaataccataaactaggtagcttataaacaacagaaatgtatttttttttttttttttggagctttggaggctggaagtccaagattaaggagccaacagatttggtgtctggtgagggcctgttgcttggttccgagacagcactttcttgctgtgtcctcacatggtagatggggcaagagagctctctgaggtcccttttataaggacattcatgccatttgtgaggcccaatcctcattacctcatcacctcccaaagaccccatcaccttggtagtgaggatttcaacataggaatttagaaggagtagggacacaaacattcagaccatagcaaacagggattatattatgagttctaatagtagtagtaatgatagtagtatggtaattacagtggtaaaaggaaggagaaagagtggaggaagagtagtaatagcactaatagcagtgattgctaatatttattggacatagtacaaagacatttcatgtaatacctcatgaaatactggcatcactgtgaagcaaggattaatattattgtgactttagagataatgtttaggttaaatgacttgaaccaatctattgagctaataaagagacagaagtagaattcaaacccatacaggaagagggccaggcaccttctcttatctgccaccatttagaatcaagacatgggcttgattattccatttgctctttgtataacttaaatctgtatatttacactttgtaagcaatgatttcctctcctacaaaaaattgataataataaaccaacctgactttctcacagggttaaggttagaacttaaaaaaaaaaaaaggatgacactgagaaagtgtttttgcaaactgcaaaccacttttgcagtaaactgcaagccacttttgcagtaaactgcaagccacttttgcagtaaactgcaaactcttcctaaatgaatattggttattatcttactggtattcagtagttatgtgttctagatatgagaatagtttgcagttacacaactttgccaatagcaagtgccataaatttatgctcagaaattatgatccctgaatttgaaagccagaaaaggttttagagatgatccagttcagtgtgtgtgtgtgtgtgtgtgcatgtattctcccaagatgattctaatgtatagtcgggggacaaaaatgactgaattggaccaacacacttctttctgataattacgataactgtatatttacctagggcagttacagttgacacttgttgctcagtgtcccatctgatggtcctgccctctttcactctcaggtgtcacagtttggatgataaattgtgtagtccctctgctgataaggaactgagacttagagaagctgtttcccttctaaaaaggaactaaatatagtgtctgacctgggctttcagagactcccttggagtcatgttgaacaccatgtgggtatgcaggctgcttcttggtattcttaaagtgagagaacttcttaatttttctgtgacaataaaactgttaaaaatagaaatatgctgtgtttccctgtcactcaactaagtaatgcaatactgaggtctgttatctgacccaattcctttatgaggacatttgattattgcttacagttgctggaaaaatcttctcatgcatgccatcaattgttctttaggaaattctgtttagaaaacaaatcaagagctttatcaactgccttgacactggttttctgaatatcatcatgcatagcaatgtggatcctgctgtatgtgacatgtctaatgatgacatttaatgaaacctctaatcaaaagacttgaacacgcaatttggacgtggtgatgcagtcttcttggttgagattttgcagccaatgtcaaatttaattttagcatttaggtcatcataatccattatgtgcatttctcagaataatgaagatacttttaagctagtataaaggaagtttgtattctgttcgcatcaaaatctattgatatgggcacatttctagagtaatagttaagtgtttcttttcatcattgggcatattgttccagtttgacccaatcagaaatgtagatcttgaaaagtgaaggtttgcctccagaggtgttgccattgaaacccatcagaatgaaactaaggacagaataagttcttttcatccagcattaatgacttcacctacttggggaatccagggattgtatgatattccaaggatccaatgtgcatcaccctggtggagactagagtattcacccgtcttgctcatcgacgattgtgggtgaaagtcagaaactgattgagtagcagagattctttctattacaaagtctcaagaaagcctttgcaaactacgctgggacttcctttgatgtaaacagttccatagcctcactgtgaatgttgggaactgtgttatagctgtgcatatgtggcccctcaacaaactcttgttatttgccaagtgtattttctaacattgagatttagagtctgggaaatctatattcttataattacctaatttaaaaaagaaagatcaacagatttccctagacacagaggaaatgggacacttgaaagtgtttttcctggttcattcaagccttgttgagtgcttcttctctgtattcctagtgcagtatgcacatccctttatcgtgattcatagcacattgtactgtaattatttgtttgtgagtctttctctattactagactggagagcagaaatcaggtcagacgtatttgcatcccccgcacttagcaacaaaattggaacacaatggatattcaaaaactttgagtgaattaataactgcccacaaaatgaagagcaccttgagtatccagtcaagccgtgtgacctcggagtccttccacacacactcagggagctataatatttaagctgaagccaaaatggtaaaatgaaatttcctatgaatgagacagttaaactcactcaatgtctagagagaatcaccatcttactatacctgcttggaagagcaagggaagtaagaaaggcttaccaaaatctgtttttgctcaaatggaacaatttaatttaataactcttctgaggatgctgaaacagtcatgcccatcaaaattcattttgagttaatccaatctgtgtggaatgtctttcaacctggaaatgcccaaagcttcattgataccctttctagaacaatgttattatgagatcaaccgaggatgacctaatgggaagattttaagaaagcctagaaaattctgactcactatgtgagtgaaaatcactgcacatatcagaaacaaggctggacacagtggctcgcacctataatcccaacacttggaagctgaggcaggcggattgcttgagcccaggagtttgagaccagcttgagcaacatgatgaaagcctgtctctaccaagaaaaaaatacaaacattggccaggctgtggtggcacgagcctgtagtcccagctactcaggagggtgaggtgggaggattgcttgaacccgggaggggaggcagaggttgcagtgaccgaagacgacaccactgcagtctatcctgacggagtgagaccggtctctgtctcaaaaaaagaaacaaaagtgagttactaatcctactatcacctgcctcatcagtgacagccctttctaaagaggtggttcagctgtcaactccaaaatgtaagagctctgagtctgttagactttccatgtgtttttcttacataaaggtgccacctttgagccactgcatcccctacatggtaaagaaaaaatttaaaaaagtatagagagttggattcctgaacagaaagctgctttttgtaatgtcaagcagttactgatttccaagcgtgtattcaagagtataaaccagctggctgagttcagttgtgcctatccataaaatgccagatggccccgagacaccagttttgcttactaatcaaaagcgatgtcatgtatataccagtataatgtgtaggttgataaagttatgcaattctcgtgggagtaggggagttttataaccgaaccagtttctacaccttcacaatttgtaatgtttacaggctgctttgggaatttttctccaagtataaatcaatccctttaatctcgttaccatctatacatcactgaggtattttgctctgtgcttttgccagtttgcaggatgatgggaactcttccttctggatgccaaaccagcatatgtaaggagctgctgggcaacctcagactactggaagccccctcacagtctctaatccccgacccaccaacattacaaaataacagggatttggaactgtattgctgtccagaaaacagatttagagaaaaatttccctgaaattagccctagcagaggtggcagagttgactaattcatctctcctttcttcgagtgtcctttgtttgcctgtttgcttgggaagggtagttgatgtttactgctaaccactatctgccttaaagaaatcctgcaaaataattaacttcacaatttactgatgacagaaactatttcatgtgacttggataaaagtgattatgtttctgtttttctaaaaacacaggagagatgttaaattataataaccttggacagcagtattacttttaacaggaatatattatacataagctgcagtgaaagaataattacctcatatgttcatatgaatattgtttgtctcatttctatgtgtcagttcttcatttttttaatctaatgaaatcaggtattttagaactaggagacagtagttctaattttcaggacagacatttctgaagattatgaaaaaaataatatttttgtctttttcataagcaattgaattacttttcccaggaataaaaccttttttccataaaatctgcaccctatagtcgtgatagtattaattccagttttcaaaatgatgaggaaatcagcatactcaattaatttctaaaggtgttactattagaactttctgccactgtattaattctaactgtgtgaactctttctgcagtggaggttagcttccatttttaaaatagctcgataagagatctagggtgaatgcaagacccagaaatccatttatattttcagccttttaatacagttgtagtagagagatgcagcttctcagtcctagagaactaactgtaaatgacccagaatacttgtgtctgtgtctgcttcatgctctttcttgcaataatcatgaatatccttttgtattttatagacctgcctgctctgcttagtttaagttttcagacagtgcctaataaaactttttgcagtatttggtgactcactggggctactggcttgtccttgtccaaactgtcaggaaaccatcagtgcctcttcagatcagagtgtttctgcccatactccatgcaggtgatggcagttcctgtctgaggtggagtctgactggattgccacccttgtctgggcaggtgatctatctgctctgaaatctcatgaagcccaacatcctaaggagagcaaaattctgtaactgcaaacacagcttcttatctctcaaatatatccagatatttatgttaagctgcaaggaatctccatcagttaaaactagcaattacattccaatgtaacatgactgatgatttcaagagattagggccttacttgattgcatctaaatgcaacttaattctcttcttgttcaaatatcctgtgttctctatcttggtttattgcatagttcctttgcagaaattctgactcaaagcccttatttaatgtgttattttgtgaagccactctgtatcctaggtccagacccctttctgtatgctggcatagggcagttatctacaagatgccctaccttgcaggcacttatttgaactgatactccagaatccactagaacccatatttctctctttttatccaaatgtgtggagttttaataattttctaagtacccactatgtggcaggtatacacactagacagcattttatcatttaatctacccaagagcctgagtgaaagatgggcagtcatttgatccccattttaagatcagacacttaaagtttactgaagttaaattaatttcttaaggtgacatagctagtgattcgaccaaccagaatcaaagatctgtatgattccaaagtcaatacccttcacatccacgatgtctcctggttaagagctttgcttccatcacttactttctaccaggtctaatgaggtctgattggctggggcacccggccacattttcagcagcagcacccagtgcctctctctctgagtgtcctacgtttcagtcagggttgtgttctttcatgcattccttatatgcacacacagctccctgtgtttttctgccagtttccctctgccctgaccattttgctaactcctcctcacctgcatcacccacttaagcattacgtactgtctatgactttcttgacttccctcctggcttcatcattctaagctctgtggcatccctccatatattgaattgtggtgacttcgggtgtgtatctctctgttctactatgaattccttaaaaacagtatcaggttttaatcatctttgtgttctcaagatctcatacagtggtaagaccataataatgatggaatatatacttacttatttcatttgaattaacatttcctgccactttgctcctacagccctgttctgactctgatttttagtcacattaccacaggatcttaccagctgggagcatgcttccactatatcttctccactctcttaaaatggacccatcaacatctcatcccttctggcgtggggtgtgggcatgttgtgaacaatctgacctcaaactcttgttcatctgattttccttgtctagaaactcttgtcctcctgcttcacccacctccatcaaattccacatgtcctacttttacatccatgtctaccttgacctcatgtttgccttgtgcttcccttgaatggttctcagtgatgcttatgactgcatggttagtttacttgcatggatgtaaggccttattatacttgactttctgctttcccagagggatacaggagctttaagaacagaaacacctgtgtgtttttcacctcttggtggaagtctttatgaggaataattatattccccatgccactcctcaataagtcccaataactgtgtattcagcacctgatgagttattgtcagatctctataattcatcctctctccttctctccatctctgagtctctttctcttcatctctgtatatctctgtctccccttctgtctctttatctctcttcccccattcattcttctctgtttcttcatttttcattttaaatgttgatcttacaccttcaagttaagagaaatgaggaggaggaggagcaggaggcattgctgagcacttgtgagaagagctccttttttatgcccctccctgactctagcactgctgagaccagctcggctggggagaccctaacccagcggcactagaggaattaaagacacacacacagaaatatagaggtgtgaagtgggaaatcagaggtctcacagccttcagagctgagagccccgaacagagatttacccacttattaacagcaaaccagtcattagcatcgtttctatagatgttaaattaactaaaagtatcccttatgggaaacgaagggatggaccgaattaaaggaataggttgggctagttaactgcagcaggaacatgtccttaaggcacagattgctcatgctattgtttgtggcttaagaatgcctttaagcagttttccccaccctgggtggaccaggtgttccttgccctcattcctgtaaacccacaaccttccagcttgggtgttagggccattatgaacatgttatggtgctgcagagattttgtttatggccagttttggggccagtttatggccagattttgggggtcttgctcccaacatagcactatctctcttcacctgccaccctcccatatgtcaagtgcctaatcaacctatattctcaatttgcaaggatcataagttttcttgtgcctctctgcctttgcacaaactcttcacctcactgagtatgccctcatattagtctgttctcacatttctgataaagacatacctgagactggtaatttataaagaaaaagacatttaattgactcacacacagttccatgtggctggggaggcctcacaatcatgatggaaggtgaaaggcatgtcttacatggtggcaggcaagagagaataagacccaagtgaaagagaaaccccttataaaaccatcagatctgatgagacttattcactaccacgagaacagtatggaggaaactgcccccatgattcagttatctcccactgggtccctcctacaacatgtgggaattatcggagctacaattcaagatgtgatttggatggggatccagtcaaagcatatcactctcccttctcccctgtgttgtttgtttgcctggaatctccctactggtcctttggaccagcgaaatttctctttatttgagttggcatttcaacttatgtccttcctacataagggagaaatagaagtcttcttgatactctattataatgcttatcaattggttcattactggttattttcatatacatgatatttatgtaagtcactgctgatttacatacatgaacctgcccagattttggattttatcttgttcctccttgtgtcttaatagtatgcagtgtacctggtacatcctaaccacaaaataatgactgaaagcacttccactgcaggcagacttcagggacttgactatgtattcagccttgggcttcctttgattcaaaagaaggggactttccttcatgaacaataagcacagacattagtatcaataatttttattttaataattgagttgattatttttaaaatacatcctatttttataagcttgtcatatcttgtaaacaagctagtggctctcatccagactatcatgagagcactgctaattttctttaggtgtgctttgaaagcatttcattaggatggagttatactgctctttcaaaagcaagtattatgaatgtggagtgctgtggagggtcctgttctgaggagtttcagagggccatggtttagtggaatcagattaggctagttttggggcaactgaagttggaatctcagttttgtctttaacctgatgtataacctggtcatgtcccttgaatgtatagttccctcgtttgtataatatactatcttatgccagaattttacaagaaataatttgaaaatgcttaagcataaagcagaatagaaacataagggtttaatattgggaggcggaggttgcagtgagccaagatcatgccactgcactgcagcctgggcaacagagcaagactccgtctcaaaacaaaacaaagaaacataagagtttaataatattgagttacttaaatttatttcactgtattttcctatatatatatatatatacctcttcttattattattgtgatcttatttttgtttcttcttcctatttcttttcaccacctcctcctcttcccttttttctcttcctcttctccttcttctttctctcttcctccttcttctccttgtccttctcttatttctttttctttctttcctcttcttcctacttctcttctccatcttcttttttttctccttttccttctcctcctcctcttcctcctcctcttgtcatttaaggtgatgccttctattgacctgtgctcccttggataggaggtttttgttcgacagctcagtaggatgctccctgcagtgaagaacttcaggaatttttgtttgaatacatttttctctagaaaggaaaaacaaaagatagaaggcaaacagtattgatggggcaactgtacgtcccagacactgttcctgctgctttccacagtgattcattcgattctgtcaatagtccttacggtagacacaaccagtttccttttataggaagttatataaccagccagtgatgggacagggtttcccctatgcctgtaaaaccaatagcctgtgcaaaagactttaatacatgcctttgatacacttaaccatagagaggtactcagagagtagtttgggggtcctagttaaagaaaacaaaataagacagaactcagtctgcacttctaacatctgtacttgggatctataccaatatatgtcctagacgcacccctggctctgctgtataatattgggtcccagtaatttgttctggctctccatgttgccacccctgataagcttagtatttagttaaaagaaaattcctactgagaaaagtattactgacagtgggtctactattttgtgttctttcatttctaatatctttgttttattttgactattttcatgtgaaatattcttctaaagtaaaatatttaatttccttgaagataattctttacaaggaaatgctgttttctttggggccttttttctattactttaccttgctgttgctttgtaatttatttacagttctgttctttgtttgagaacattgctttgccatatgtttatgactttgtttttcctgcagatggcttttttcccttctgtttaatttctctgagacagtcgtgtcctatatattttcacatgcacctcattgttttttcatggcacttcataaaccatgattcatgtcacactgagcagaatcactacatgaattttctaaatctgttacttgcatcacaaatgtgtgtatccacttgggaattctgtggaatgtctgatattgataaggttggttgacacttcaacaacactgcttttcaatttttttccctaaatgtttacaaaaactcataaaaaacaatcatgcatagcataatatatttttatttttctccttaaaaagattgtctcgtctattggatgtgacatgtaccctcgtgagtcagttccctacgtttaggtcttctacagcatttgttttgaaaacaaaatctacagattttcaaagatatttagttgggaaataaagcagagatattgtgaaaatatgaggattttagctattgcagatactcagctacaaagagtagtggttctaaattttaccactttgctgatgccctgtttttctctgacttcaaactttgtccgtgcacctcattcttccctaagggcagtcaataaagtgggcaactttgaaaaagtatttgcttttcagctaggagatgggaaatacacacacatgcacatgcatgcacatatacatatacatgcacatatgcacacacatatccacagatgaatgtgtctgtgtatatacaaacatatatgtaggatggtaatgcatggtttggctgcaacttgactaatttagttgacagtaggatctgtgcagaagcgaagaggaacagaagagcagaaaagtgaagaagcctctatcatcccagtttttggctaatttgagggcaggaccgagcatgaacctagggtgtggggcagtgggtaaaagggctttttggtagccacagtggatagaagttgccattgaagtttagagatttctatcaaggtttaggcagtagaatagaaatcaagtccctctgggaggtgggaagaatgctagcaggatgagtccccatggtttcgttgccagagccatctagcctgaaatttgggcttatttcctatttccaataaggaactaagttggaaagcagaaattaaggcagagcacggcaggaggacccaattgtaagtggcccatagctcagcagtttctgaactttcttgctatcaaggcaatgcatgttcactgagaaaaacacatttctaaacagataatgaaatggaaaataacactcaagtaattatcaagatttacattcaagttttattttttcatttattagagacaagtggacattttctctttggggtaatttatagatgtgccatgtcagaaaatcagggttgtgtaccattgagggagagctacaggatgcggatggactcagaccaggggaccagcgcaacatcagctaaagtgtttggactgggcttgtgagcagcaggagacatgtcacatgcatgaggaaggtggggatgaggagagctgaactggtaaaatgttaattgtgtgtggaggtgtcaaggattgtgtgaagcaaaagtacagggagctgacaagttagctggtagtttgggtcagggagagttaagagcacctgaactagaaaggtgaaggtggacatgaagagaagagaaggatttgagagctctcaggaagtagaatgcaggtaacgtggcacctgatgagagctgttgggtgaagaaggacagacattgcgagaaatgaagttctgtgtcccattgaccaaaatgagtggaagctgacagttctcacatggatttggctgggaggcaatcataggcctcagtgttggacattcaggggaatggagaagacatgggaataggctgtggcaggctaaggaactgacttcattttggaaatggcttcaaggaaggtggcccataatatattcctattgttcatacaggtaccatcatttatttcatttctacctactccttatgatcaaaaatcaaggcacaatgtcaaaataatgacctggttaatgagatctatattttcacagcttttcagattcctttgccatctttcttgggttcagcattcttagagcagtgttcaaaagtctcaggttggtaattccagttcatcagggaaagctgacgttacatccacagtccagtccaagaaagatgctagagttgaaagctattataagagagtcagaaaatgtcaagaggaaaagatcaatgtgcttaagtacaacattaagatacattctgcatggtgtttccaagcagctcttggaagtaacagatggcttctgtaagggaatgatataagaaaagtacctaagtcattttcacctttggcatgcggggatttttgagtcactaaatataaattctgttacactatgacagattataatctctaacatcaagcatgatgctagaagggaatttgaaagaaggtcctccatttcaactcttctatttttaaatcctaactgtaccttttacgacaggatttcaaaggaacttcttaattcaacctggtctgttatacaaggcgcattgagagagtcatcccccggttctgtggggcaatgtagaaaaggggtagatcctgaaataacagtgctcgtttgttgggtgttttatgctcagattacacacaacactaccctgacaactcattcacctcagccttctccgtcttgcattatgtttataatatctttagttaggcaagcgtggtaaatagcctaaatttctaaagtctctgtaggtgaagatgaaaaaattggtaactggttataaagtagattgcaaatataatcaagtacaaaatcattacatcaagtccttatgcttttagcattcaaatataagtgaactagccatcatttttgaagttaattccaataaacattttatgaattttaaaaatggtagaaaaacgggtacaatgatggagataatttgtctcatgcattttccacaagagaaattttttgtaagttaatttttaaatgctttgtgaaagggcataaaattttgaattagaagtcttgtgtttgtattctgggtctaccatttaactctcattcacagaaagttcattttcatgtaggaccttcagctaaatcatctgtaaagaggaactgctaatataaacccttctgttgagccttgcagatagctaatgtgtgtgaaagaatgtagtcagctgcagagctcagtgcaaatttacagatgtcataaaagtatatagtcattgccttaaatagcaatatatatacatttttcttttaaaactttattcatgagaaattaagtactccatgagtagtaattctaactccttgaatagtaaaactgaatgcacttttcctgtaatacgccgtttgatatcaagacaataatgtttaagactttcctaggtttaatggatagtggagattagagctctttttaaaaatgatcaaatttgtcctagaatagaaagacactgcagtcaaatcactattcagtttgcttgtcttattccaactttctaagctatttcctagagaatcattgaatatttgccacctcttttgaaattcacaaatgatatttaggaaagaattttcattttagaaagataaatggtaagcagcattgaatgagtacatctggtgtgcagaatatctagataatgctatatgacaggaggtctgatgtggctgaaaatgagaataatagagaattttcaacactagataatgcgttgacctccccacccaccttcaattaatttgaatcagctgatttatctaaggacctagggacactgggggcaggacaggaagcctcagttagggccaacaattgcaatacatagacacgtgtgtggtggctttcagggcaggagtcaaggagggagaagataccttcaagagccaaatccccacagtgggaggtgtatcccctgaagacacactcatcctacaagaaggaagaactcagcaacactgtaggagttttttaagggaaacacaggtttacccactatcctggcttttagaagaactcagggagtaagagataaaacagctatttctggtgctaacagccagtaggaagcaattgttccttctctcctaggtgatagccagtctgcctgtggtgtgtagaattgtggttgattctcttacgccatgaaagatgaggacgtctctgggccgctgcagttgctacagcctttcccaggcatttcctgttctacaaaattgtaattttcctgactttgaaagcggtttggagttaagatttcttgatatacagtggaaatcgtgctggatgataaaaatccctcttctggaggaagagtcagatattagaagacccagggaaaaatgaccaggatcatttagcattgcttgaatcatttccactgctttctgtattgaaggaaagattgggggatagaggagataggaatcatggcattgcttctctttgcctttcctttggtcagcccctattccttgattctgtctcatgttcccattttaaaggtaagcaatattggttgcctgaggatagtttgtcctatcacaaaccttagataattaataatacatatgcagagagaatccattgcatgaaaggtgagactccagattcctgggaagccataaatcaatgagtaaatgtggcatcttttaccaaaaagctcaaaggaaaaacagagaaatcttactgggatgagaatgttcttctgaatgaatttaatattctcaaaggattttcttggaaggatggctagggaaagcatgccgcattgctggcacatgctcagaggcatggaagagatttaagaatcctaggagaagacaggactggattactgtaacataatactcattctgcaggccaggagctcatgcacatgcatcacgtgaaaaataaagactgtctcaaacacaagataaaacgttgccgagcatcctgggccatcttagaatttgcatgccctgggaatgattccctccagtttccatccagtgctgcgattctctgcttgaacctagcttcggcagaactttttcttacgcccagggtgtcagaattaagctcagggctgtgatgtttgtcttccaggaagtcactggcacatgcccactcttgatttgttttcagatttgtcactcggctgacttgcaagcctgtccatcagccagaaatcaggaagcctacaagtcacaactggatccattggtgaaacaaagctcagctgccagtctcagcagagaaagcatgttctgctcaggagtcacatttaattatgcagaatttatgcgttttatttttttgtaactcttgagtgttaaaccataaatgtgagctaatgaaagataatatatgtgaaatacctagcagggttaggcagagaggagacacaaaatgaaatccgtcttgttcgttcctcttgtacttctctctcccttactttacaagtagagtaataacttgttagaggtggttaattaatataaacttccaaaaaaagtatcaacacaaaatggtgcacatatatttgtgaacgaagatagataggaggatacgattagaaaaatgtaatctactgtcctcaaaaaagccaagatgaatgtccattggtacattttcttttttatttatttgtttatttaattatactttcagttctagggtacatgtgcacaacgtgcaggtttgttacatatgtatacattcgccatgttggtgtactgcacccatcaactcgtcatttacattaggtatatctcctaatgctatccctcccgcctccccccaccccatgacaggccccggtgtgtgatgttccccttcctgtgtccatgtgttctcattgttcaattcccacctatgagtgagaacatgcggtgtttgattttttgtccttgcgatagtttgctgagaatgatggtttccagcttcatccatgtccctacgaaggacatgaactcatccttttttatggctgcatagtattccatggtgtatatgtgccacattttcttaatccagtctatcattgatggacatttgggttggttccaagtctttgctattgtgaatagtgccacaatgaacatacatgtgcatgagtctttatagcagcatgatttataatcctttgggtatatacccagtaatgggatggctgggtcaaatggtatttctagttctagatccttgaagaatcaccacactgtcttccacaatggttgaactagtttacagtcccaccaacagtgtaaaagtgttcctatttctttgcatcctctccagcacctgttgtttcctgactttgtaatgattgccattctaactggtgtgagatggtatctcattgtggttttgatttgcatttctctgatggccagtggtgatgagcattttttcatgtgtcttttgtctgcataaatgtcttcttttgagaagtgtctgttcatatccttcgcccactttttgatgggtttgtttgttttttttcttgtaaatttgtttgagttctttgtagattctggatattagccctttgtgagatgagtagattgcaaaaattttctcccattctgtaggttgcctgttcactctgatgggtagtttcttttgctgtgcagaagctctttagtttaattagatccgatttgtcaattttggcttttgttgccattgcttttggtgttttagacatgaagtccttgcccatgcctatgtcctgaatggtattgcctaggttttcttctagggtttttatggttttaggtctaacatttaaatctttaatccatcttgaattaatttttgtataaggtataaggaagggatccagtttcagctttctacatatggctagccagttttcccagcaccacttattaaatcgggaatcctttccccatttcttgtttttgtcaggtttatcaaagatcagatggttgtagatgtgtggtattatttctgagggctctgttctgttccatcggtctatatctttgttttggtaccagtaccattctgttttggttactgtagccttgtagtatagtttgaagtcagatagcgtgatgcctccagctttgttctttttgcttaggattgtcttggcaatgtgggctcttttttggttccatatgaactttgaagtagttttttccaattctgagaagaaagtcattggtagcttgatggggatggcattgaatctataaattaccttgggcagtatggccattttcacgatattgattcttcctatccatgagcatagagtgttcttccatttgtttgtgtcctcttttatttcgttgagtagtggtttgtagttctccttgaagaggtccttcacatcccttgtaagttggattcctaggtattttattctctttgaagcaattgtgaatgggagttcactcatgatttggctgtttgtctgttattggtgtataagaatgcttgtgatttttgcacattgattttgtaccctgagactttgctgaagcaagtccttagagacctacaaagagacattgactcccacacaataataatgggagactttaacaccccactgtcaacgttagacagatcaacgagacagaaaattaaaaaggatatccaggaattgaactcggctctgcaccaagcggacctaatagacatctacagaactcttcaccccaaatcaacagaatatacattcttctcagcaccacatcacacttattccaaaattgaccacatagttggaagtaaaacactcctcagcaaatgtaaaagaacagaaattataacaaactgtctctcagaccacagtgcaatcaacctagaactcaggattaagaaacccactcaaaaccactcaactacatggaaactgaacaacctgctcctgaatgactactgggtacataatgaaatgaaggcagaaataaagacgttctttgaaaccaatgagaacaaagacacaacataccagaatctctgggacacatttaaagcagtgtgtagagggaaatttatagcactaaatgcccacaagaaaaagcaggaaagatctaaaattgacaccctaacatcacaattaaaagaactagagaagcaagagcaaacacatcggtacattttcatagtgggctaggttaagctatacaaaataacaagagccttctaattataagaatgtaacatgttttatagaagtataactcactgcccccactaatgctatagcaaaatctaacaactaatctcgtttcaaatataattttagaaatagcatctgaagtgcatgcagaacaagtaaggaaactaagatgatgcgttgaacatctaaacagctccacagccagtcggtaggttttggaattcaactctgacaactgcaccaatcctttaatcttcttcccattgtagattttccatgatcttattcagaatgtagaaactgtgctcccattgttagtatagaggaagaaatagataaataaacattataagctaaaaattcacacagtaaacagaagaccaacagaatgggagaaaatagctgcaagctatacctctgataaggaacttgtattagtccattttcatactgctgataaagacatacccaagactgggcagtttacaaaatggctggggaggcctcacaatcatggcagaaggtgaaaggcacatctcacatggctgcagacaagagaagagagcttgtgtagggaaactcccctttttaaaaccaccagatctcatgagacttattcactatcacgagaacagcatgggaaagacctgcccccgtgattcagttacctcccactgggttctacccacaacatgttggaattcaagatgagatttgggtggggacacagccaaaccatattagaactaatacctagagtttatagggaactcaaatccgcaagcaaaaaagcaaataatcccattaaattggacaaactacatgaacagacatttctcaaaagaagatatacaaatggccaagaaacataggaaaaaatgctcaacatcactaatcaccaaggaaatgaaaattaaaactacaatgacataccaccttaccccagccagaatggccgttattaaaaaatcaaaaaacaatagctgttggcatgaatgtggtggaaatgaaacacttatatgctggtggtagcagtgtaaatcagtatagcctctatggaaaacaatatagagatttctcagagaattaaatgtagatctactatttgatccagtgatcccactactaggtatctatacaaaggaaaagaggtcgttatataataaagaacccacatacatatgtttatcgtagcacagtgcacaattataaagatatgtaatcaacctaagtgcccaccaactgatgtgtggctaaagaaagtgtgttttatacacatacacacacacacaccatggaatactactcagccatgaaaaaagaatgaaataataccctttgcagcaacttggatggaattgcaagctattatcctaagtgaagtaactcgggaatggaaaagcaaataccacatgttctcacttacaagtgggggctaagctgtgactatgcaaaaacatacagagtagtacaatagacattggagactcagaagaggagagaatggtaggaggtaatgaaaaattacctgttaggtacaatgtatgctatttgggtgatggatgcactaaaagcctggacctcaccactgtacaattcattcatgtaaccagaaaccacttgtacccccaaagctattgaaatgaaaataaataatggaagcaaaatacagcatgcggcataaatgcacagagcatgtatgtgatgcatttatatgattttagccatatttgtatttatatgaacttttcaattgatggtttggcatatgagattaggaggcctttaaggagaatatacctggattttggagacgtgagttctgtacttcctgtgtactatgaaatttctggactcaaaccttttttgattttgcagtacacagcaaaatagaactgtcttttctgggcacatgacagaaattaaaaggagaaggggctaagttcaaaggaatataattaatgtcctaaaggggttaaaagcgtaaacttaatcattgcatcatcaggtgacctgtcagcatgagaacattgcttaatcttgtacaagttaccttcaggagaaagttggtaattcttccatgattagaattacttgtcaggttcactttaaaaatacgtaaatctgagtttttcccggtgacaaccagcccaatcaaagaaagcatgtgttaaatagaatgaaattgcattgtaagtcaataagcccaaattagaatagcactgtacaacttctctcggtgttgcgatcctaaagatttgttatacaagtgaagttagggacagatcgaaagacagagatcgcacatgttaaagaatggttgtgatggaggttactaaagagctagctatactgataaaatgcatcagattgtttaaacctaaaatatatggaaataaaaatgttggaaacaaacatctcagtgaagctttcttcaatggttttgtgtgactccatttaaacagagattactaaaaccactataaactagaaagtacagaatctctaggtaaaagctgaagaaagcactgaaagggcataattcacataaatcatgatctaggaccatcacttaaagaatgtaacagcattttcttatcacagggattcttgcccattgatgaacactgaagctttctgaagttgtaactgttctttccattctttctacccttttatcttggaatgcagccaaggatacttggcataatgtgttgcacagtgaccattccacaaattgtgaaactgactttacaaaaattatatcaatgagaaaattatgacagtgaaagagatctgagctcatccactccccatcttacctttcccttaattattcctgcattattggacctagctgatccatcaagggcagggtctgcaaaatatctcaagaattgatcttaggttttacaatagtggtgttatctccaggagcaatttggggaggttcagacacttgaagcaagaggttgcatgactcctaaacagtaatttataatcttaaagctactttgttagtcctacaaaggcagactggtccccagacaagaaggggtctatttgggtaagggccattatcaattttgtttcagagttaaatgagaaactaaatttcttcccaaggttagttcggcctatgtccaggaatgaacaaggacagcttaaaggttagaagcaggatggggccagttaggtctgatttctttcactgtcataatttcctcagttataatttttgcaaaagcagtttcaaatccacacttacttttatcagggaattttgtgaagtcttgttctatgatttcaaaatactgtgttagctttcgacagcttgggaacatacccattctataaattatggcaaactgtacttgctacggttttatattttattatatcacatgattatcatgacagtttgtggacttattttcctttcttttgagatttcttgttaggacttgggtcttttggaatgtcaatttcaatgatatttattgactgcttactaagcaggtattatgtagagcaactaaaataagcaagcatctaacttggaaagagcaaaatataaaccaaatgaagaaaatgcaataggaaaagggtgtaaaaatgcactaaatcttttcctgaactctacattcattgtccttatttttctttttcactgtttgtataatacagggtataattaattggaatttttgttttgttttgttttgtccccattccaattctgcccctgaaaccacctttgcaaaattatcactgagacagtgaaagagatctaacttaatcgactccatcttgcttccaaactccaagctgtccttgttcattcctgggctcagggtgaaccaactttgggagaaactcagtttatagtttaaactaaggatgataacaaccctttcccaaaggaggtctccttcttgcctggggtctagattgcctttgtaggactaacattagccacaagattagaaattgtttcttaggagtcatgcagctggaggctacaagattctgagcctccctaaactgctcctaagatcagtgcctgagatattttgcagaccctgcatgtgacagatcagctggcacctcccagatcagtaaactgggtcatctgatcctgtgcccctgacccagtaactgactcagtacaagaggacggcttcaactccctatgatgtcatccctcaccaattagagctcctggctcactggcttcaccccacccaccaagttctccttaaagactctgctcctggagtaataataaaactctgatctcctgcacagctggctctgtgtgaatttctctttctctattgcagttcccatcttgagagatcgactttgtctgggtagcaggcaaggtgaacctattgggagattacaaatttgggtgctcatctgagattgcccttatggctacttctgcccatggtttgataccagccttggtaaggtttcccttttaatgaaaagaagcccccaaataatttcttttctaacagagagcagcctgtaaaattgagctgcagacatagataaccaagctggaagcttacacgggtgaatgccggcagctgtgctaataggaaaaggctacctggaagctaggcatgtccaacatggtggctccatcttcccctttccttgccaaccacatgtgcagtagggagcagacaacatggcactcactagcccactagaaaacccatttgcataataaaaagattagcatggggcagccaggttctttgcgtgctatataaacatcacacctggtccaaccaatctttgagtcctatgtaagttagacaccgcctcctcaagtcagtcgtaaaaccccatgcacttcaccacaaaatcgaagacccacttgggtagcacccctctctctctgcaggaaagagagttattctgtttttctttcgcctattaaacctccactcttaaacttactcctcgggttgtccatgtcctttatttccctggcatgaggcaatgaacctctggtattacccagtgaaggatgccatttcagtatcacagagaagtttatcccttcaatggaaactgtgttatgtggactattagcaataataaatgggttactacctggtgaaaaaatatgttattttataatatcagactgccagtttttttctgtctttgctccatcttgaccttaagatgttcatcaactcatttttttcaagcaaagtacatgactgatggaactgccataataataatatttcactgaaatctggcattacaaaatttaagtgggtatttggaggtccatgcattgattacagtttttaaatttgaaataaataaccagcatcctttgaatatgaaaagctgtttccttttgacatttaatttaccctgtttaaaacgtgagatgtaaagcggtggttagtcagtgaactagaatttttgttgtagagtatccaggacttggaagagtatcatgaaagaattctttttggttggtgaagagtgtcaacttgaaaaataaatcgctgtgttccaaaataaaattgtgtcagagactgtaagtagtgcgtatttaatcttaataactcaagattgatgtaattactggaatattttatttgaagaaatgtgtatcacacttactaaatttcgttttttaaaacagctgcagcaagagtggcagttattcagttgtctctttaacctctgttattctgatgactgaaggaaaaacttgaacctatgttatgtgatataagcataatttgagctacactgaaccacatgacagtgctttgataatcttgtataaatcagtatatctcttctctcattagtctgtttgttaaatgccagaccttgtttctgtcatcttttgaatgaaaccaaggtagttctgtgagaaagcagcaattgcagaattatacacctggtgaattaaattttaacattaaagataatttagttttagatttggcctctgtggatctgtatcagttccaaaaatgtagaaagcacgggcatggtaaagtacatttttctgtaataaaaaaatacaaaacctattttatctgtgcattcttttgtatttattcattaggttaaagaggcaattccaaagaaagtatgacttcaaaaaattatatataatctatggccttaataaaattattaaaagcaccttaacatctgtgttcttgacaaaaaataaacaataaatgattaactgtgatggttaatactgagtgtcaacttgattggattgagggatacaaagtattagtcctgtgtgtgtctgtgtgggtgttgccaaaagagattaacatttgagtcagtgggctggggaaggcacatccacttttaatctggtgggcacaatctaatcagcttccatcgaatgtaaagcaggcagaaaaatgtgaaaaggcgagacaggcctggcctcccagcctacatctttctcctgtgctggatgcttcctgccctcgaacattggactccaagtttctcagttttgagactcggactggctctccttgctcctcagcttggagacagcctattatgggaccttgtgattttgtaagttaatgcttaataaagtcccctttgtgtgtgtgtgtgtgtgtgtgtgtgtgtgtatgtatatatattcacacacacacacatatatgtgaaagagctgaaattgtggaaaaacagacacaagctcttatcacgtgaggggctgaccttcaatgaaagatgcatgcacagcctcgccagatgtctactgttaaagtgagggcattgactggaaaagaatgggaccctgcaacttggaatggggacggtgagggaggaccctgatgaagctggggacactgagtttgtaaactccaatgaacctttttttgccagaaggaacagcttccccatcccctgtaatggcaacatcctttccctgacccatggctgccatcagcctttccacctttgtctgaggagataaaccctgtgctgcctgaggcaacagtgatggcctcccctgaggcagttgccagacaaaataatgttgattctcctcaggagccacccctaacacccctgtttgcttctagatctatcactaaagtcccagcaggcccctagaggtgaggttgagaatgtgacccatgaggaggtgcgctacactcgaaaagaaccatttgagttctataattgatataaacagaaattttggagaacaggcatgggaatagatattaagggtatgggataatggtggaaagaacatagagttggatcaggctgaatttattgatttgggcccactaagtagggactctgcttttaattttgcagctggggagttaaaaaaaggttctaatagtttatttgcttggttagctgaaatatagattcaaagatggtggtaaaggccaaatggaagccattagagctgctcctacctagaaaaatagtgaataaaaacagtatcccatccctggagggattgtggagattagtgtcaccatcaatgcaccttgaaagatgcagggatggtgattcccaccacatccccattcagctctcttatttggcctgtgcagaagacagatggatcttggagaatgacagtggattatcgtaagcttaaccaagtggtgatttcagttgcagctgctgtaccagatgtggtttcattgcttgagcaaattaacacatcttctggtaattggtatgcagccattgacttggcaaatgcctttttttccattcctgtccataaggcccactagaagcaatttgcctttagcagcaatatacctttactctcctaccttaggggtatatcacttctccagctttgtgtcataatctcgtttggagagaccttgattgctttttgcttccacaagacatcacactggtccattgcattgatgatattatgctgattggatccagtgaaaagaagtagcaaacacactggacttattggtgagacatttgcgtgccagaggatgggaaataaatccagcgaaaattaatggaccttctacctcagtaaaatttttagaggtccagtcgtttggggcctgtcaagatatttcttctaaggtaaaggataagttgctgcatttggcccattctacaaccaagaaagaggcacaacgcctagtgggcctatttggattttggaggaaacacatttttcatttgggtgtattattgtggttcatttattgagtgacctgaaaggctgccagttttgagtggggtccagaacaggagaaggctctgcaacaggtccaggctgctgtgcaagctgctctgccacttgggccatatgaccagcagatccaatggtgcttggggtgtcagtggcagatagggatgctgtttggagcctttggcaggcccccataggtgaatcacagtggaggcctctaggattttggagcaagtccctgccatcttctgcagataactactctccttttgagagacagctcttggcctgttactgggctttggtggaaacttaacctttacctatgggtcatcaagtcaccatacagcctgaactgcctttcataaactgggtgctttctgacccacctagccataaagtgcgtcgtgcacagcagcattccatcatcaaatggaagtggtatatacaagatcgggctcaagcaggtcctgaaggcacaagtaagttacctgaggaagtggctcaaatgcccattgtctccactcctgccaccctgccttctctcccccagcctgcaccgatggcctcatggggagttccctatgatcagttgacagaggaagaaaagactagggcccggttcacagatggttctgcacaatatgcaggcaccacccgaaagtagacagctcaagcactacagcccctttctaggacatccctgaaggacagtggtgaagggaaatcttcccagtgggcagaactttgagcagtgcacctggttgtgcactttgcatggacagagaaatggccagatgtgcgattatatactgattcatgggctgtagccagtggtttggctggatggtcagggactttggaagaagcatgattggaaaattggtgactaaaaaatttggggaagaggtatgtggatcgtcctctctgagtggtaaaaaacaagatatttgtatcccatgtgagtgctcaccaacaggtgaagtcagcagaggaggagttcagttgtcaagtaggtaggatgacccattctgtggacaccactcagcctctttcccgagccatccctgtcattgcccaatgggactatgaccataatggccatggtggcagggatggaggttacccatgggctcagcaacatgagcttccactcaccaaggctgacctggctacggccactgctgagtgcccaatttgccagcaacagagaccatcactgagccctcgatgtggcaccattcctcggggtgaccagctagccacctggtgttagattgattatattgtacctcttccatcatggaaagggcagaagtttgtcctcactggaatagacacttactccagatatgggtttgcctatcctgcatgcaatgcttctgccaaggctaccatctgtggactcatggaatgctttatccaccatcatggtgtttcacacagcattgcctttgaccaaggcactcactttgtggctaaagaagtgcagcattgggatcatgctcatggaattcactggtcttaccatgttccccttcatcctgaagcagctggattgatagagtggtggaatggccttttggagtctcaattacaatgccaactaggtgacaatactgcagggctggggcaaagttctccagaaggccgtgtatactctgaatcagcatccaatatatggtactgtttctcccatagccaggattcatgggtccaggaatcaaggagtggaagtggaggtgacaccactcacaatcacccctagtgatccactagcaaaattgttgcttcctcttcctgcgacattatgttctgctggcctagaggtcttagttccagagagaggaatgctgccaccaggagacacaacaacgatcccattaaactggaagttcagattgccaggacactttgggctccttctacctttaagtcaacaggctaagaagggagttacagtgttggctggggtgattgaccctgactattaagatgaaatcagtctactactccacaacggaggtcaggaagagtatgcatggactacaggagatccattagggcatctcttagtattaccatgccctctgattaaggtcaatgggaaacgacaacagcccaatccagacaggactacagatgacccaggcccttcaggaatgaaggtttgggtcactccaccaggaaaaaaactatgacctgctgaggtacttgctgaaggcaaagggaatacggaatgggtagtaaaagaagatagtcatcagtatcagctactaccacgtaaccagctgcagaaacaaggactgtaattgtcgtgagtatttcctcctttttttgttaaaaacatgtttgtatgcatgtgtacacttgttctaagaaaatatcttcattttttcccttttctttatcatgtggcataagatttattgacattatatcagcatttaagtattgttaactttatgtaatagtatttgggttggggattggtgtgtttccggttgtagaaagaatagttgtattatggtaggcataattatgacctcattattgtctttatttgaagattatgtatgatctcaggagatgtgtatgggttcaagttgacaaggggtggacttgtgatgattaatactgagtgtcaccttgattggagtgaaggatacaaagtattgatcttgggtgtgtctgtgtgggtgttgccaaaagagattaacattagagtcagtgggctggggaaagtagatccatccttaatctggtgggcacaatctaatcagcttctagtgaatataaagcaggcagaaaaacgcgaaaaggcaagacaggcctagcctcccagcctacatctttctcccgtgctggatgcttcttgctcttgaacattggactccaagttcttcagttttgggactcggactggctctccttgctcctcagcttgcagatggcctattatggcctcgtgataatgtaagttaatgcttaataagctcccctttgtgtgtgtgtgtgtgtgtgtgtgtgtgtgtgtatacacacacacatatatacgtacatatatatatatgtgtgtgtgtatatatatatatattagttctgtcactctaagagaaccctgactaatacaacaactgagcaggatatattaatatcagtgctgagccactggtttgtgggtatgtcatttccacaaagacatcaaaatgccatttagtttgttttggtccaccattcaataatacctccctttagcattgaatgaaagtattttattaacatttatttatgcttacaattatttcacatctttgtcaaggcaaattatgtagagtgctttgttttttaagtttaatatttgtaaagtatgtggaagtttaagtatacatgcatataaaaacttgaatgatgaattctcctacctttccttttgtaatatgcagtttttgcatgtaacaacatacaaaatgttcatttggaaacactttagtaagtatgaaattcagagtatatttagagtatgaaattcagaatatatttaaagtcagttaaatatattcttttgctgagtttctgaaattccatttatggatggttcaaaacaccatactcccattgggaggagaggagtgactgcctctcatttttccttgttcttttcattttaattggctcctatataccactcttatcttttcaaggttttccacatttaagaaaaaaagcaaattcattcagattctgtttttctgcctgcaatcacttatacaggaataagtgagtccttatggggagcatttaattcctaaagtttgcatttttctaaaggattttccttttacccaaagcatgtgttgatgtgtaagtcttaagtactacttcaagtttctaagaagatccttaattgagatctctttcagtagttacaggggcaaaataagcactgcagaggtccatgtgagagttctattatacatactgggctatatgactatttgttctatagtggaaggacaagaaagaggccataatgtacttagtgatggaacagttgatatttatgccaccccttacctcaagtgagtaactgtgtacttgaagtcactttggcagatattctgaagggaagaaagtttttgcccttaaaagttattaggggtgtgtgtatgtatgtgtttaaatgtgtgtatatgtataaatgtgagtgtgtatgtatgtgtatatgtgcatatacatgtatgtgtgtatacatataacatgcatatatgtatactctatgcatatatgtaatgtgaatatatgcacacacatacatatatatatgactttattttttagaattgtttttagttcacaacaaattgatctgaaggtctagagctttctgatttaccacctgttcttccaccatggcatttcccactatccatatcccccaccagaatggtgcccttcttataccccatgaacttacattgacacatcattatcaccccaagtccatagattatttcagggttcactcttggttcctttttttttttttagtgactatttttctcatgtcacctgtgctagtagtccctgttttatttttcataaagagaacattttatttatacttttttgtgaccgggaaatgttaggtcagaatatcagaaacaagtcacactaaaacaaatgtaaagattcacttttcttctgaaaatggcaagacagataagttttatttacatacatatgcttgaaacattgcagttagtccctttaaattctagaccgaagcacatattttcttttgttccataataaatattccctttaaagaatggctgatatcaagagcatcatgtctcctaatatggtctcactcaacagctgaatgttgaaatgtacagccacaaagcactaaatatatccttagaacaatgatgtactgaacaaaattcagaggtcatatgcaaagacagctcccaaggaagtttgcaagtggcaagtcctttccttcagcaactgaaacccaggagaaacagagtctcttgcctctgcttcttggagaggggttctcctgacaccggagggaaatggcgatctcatctccctgatgttagttaaaatttcatcttggattgataggttcatatctttgtgaagatatctaaattaaggtgatccagccaaatcactaaatactcggctcactccttaggaggagcttaactctgccatgatttctgtgtacacacctcatttattgcactcagagtacaaaagctctgagatgtaaaattgaaccaggcagcacattgcattcttatccaagtgaatcaaggctttctcagtgctactcatccaaagcacattgaaatcaattcttcttatttatttgtaaaacagacagtgatgatggtgtctgtgtcagagggttactgtgagtgtcagaggaaacgatgatggtgagaaggttagacacatggtacatgttgaattaatgttagctattagttaccaataccttcatgatttttattggtatgtaatagttgtaaatataaaagggtaaatgtgatattttgatttgtgaatatgtaaatatcagatcagggtagttggaatattcattatctcaaagttttatcattttttgtgtcgagaacattgcaaatctcatctaggtattttgagatacaggataactgtagttactcgagtgtgctattgaacactagaacttatttcttccctctaactgtatgtttatacccattgtccagcatttctttttccctgacatccctcctaccgtttccagcctctggtaaccaccattctactcactacctccctgagatcaattgtgtccaggaatgaaaagcaaataagtggtaaagatggactagttgatagttaataaccatgactggtctattctttgtctgctacactttctttcctctatgtgtggcaagtgcctacttactcttttaaggcttgtgtcaaagaccaccgaattcttcaccttttctggaatctgttagttctcaaacaaaattgtgcccgttttcttctcttttagtggttctgtacctctcaaaccccgtatcgtggctgtgacttaaacgttacccttgagagtaaaacttttatcatagttttgtttttggaaccttgcacatttctagacatacaggaggtgcacaatatacatgtactaagtaaatgaatgattggtcatttgaaagaataagtgttgaatacacagcaattctccaatctctgtgtttatgcaaacacaagaattaactttgcctaattcaaatattatattgaaatttattcaaacttcccattttccatgaattaagcagacatccgttgttactagattttcactaatcagttaaatctcttttgccttgtatcattttaaaagagcatgtggaacaaaatcaaacagcttaggtagtttacatctcttgagctcactattttaaggagcgaagttcaccctgccacttgcctatctgtctcagtactcacacaacacttgcatcgatgtcctgctaatgtacatcaaatcaaatattcatacctgcttttaagtgtgctcccgtcaacaaacagttcacttggttagtattatcttccatccaggatcaagataaaatatgtgccagagaaagatgccttatagagattctcacaatgtactagttacacataaattaattactggagcagacattcctaccttttagaaagtgaagacttgttcataggagttgagagtgaagaaaatcaattcttgttgaactgataaatgttccttctagatagtttacattgccattaaagcataaagttgccatttttctttatctgtcagctacttattgcacaagctattctggcttttcaaatcatatcttttggtcatttgccaagtgcttggcagttgggtacacatggattagccagtaaaagaatctcagaactttccagctatttttgatcaggtacacctgtaaatcttaaaaagcctataaagaaatacctaactagcacattggatacaagaaacaaaaatctcacgtaggaaaatagtagctgaagttctgaatgttgactcaacttaggaaattgcaggcattagggagaaaaatccttaaagcttaaaattccactaggtggtaaccactgttaacacacacatgcatttccctcttcatatttgggaaattgatggttgtgttttctttttagggtggaagaaggaattctcccttaagggaaggaaaatataggaaaaagaaccactctttgaaggcatctgttgtccaaatcatgaggaagagcttgtagttctgagttgcacaaatgtgctttagttgtttttctgtaggatacttggcgaggtcacctgtttcaccatagctgtgtcctcagacccagtgtaggaaaagggtaaaaaaatgttgattggataaatgtgtgacattgctagttcatacctctctgagcatctcttgaagctgctgcaggtaaaattcctccatcttttcttcattctgtcacttgcatattgggagcctttcctactgcccttgttatgttgctttggtttgtgcgtgaatcttttccattacatatgtttgtacttccaggatctcgcacataactgtgctcaataaatatcaaatgaatgcatgaatgactgaacacatgagtttcagatgtcctttacagccttttctcattgaagtatatgcttgttctttgcctcttaaaaaggggtacaactcaatgaaaatagggttgccaaatgttgcaaaactaagcgtagtcttaacaaaactaaacatagacatgccatacgatgtagaaattacactccctggtaattacccaaatgaaaacttatgtccacacaaaaacttgtatgcaaatgtttagcagctttatctatcattaccaaaatttggaagcaactaagatgtccttcaatgggcgagtgcctaaacaaattgtggcacattcatacaatgcaataccattcagcaattgtaagaaatgatctagcaagccatgaaatgatcagaaggaacctgaaatgcatattgccaaaagaaaaaagccaatctgaaaaggctgcatgctgtatgattcctgctatatagatgacattatggaaaaggcaaaagtatggagacagtaagatgtttaatgtttacaggggctggggacagggaaggatcaattggtggcgcacagagaattttttagggcagcccaaatactgcgcatcatactaaaatgatggatacttgtcatgatgcatttgtcaatataaagagtgaaccctaatggaaactatgaactttaggttataacgatgtatcattattggctcgtcagtgataacaaacctatcagtctgaggtgggatattgaaagtgtgcatgtaggtttgttggggaaggaggtacatgggaaccttacgtacttactgctcaattttgttgtgaatctaaacccatactaaaaaataaagtcaacccaaaaagtacgaggtactcaaataaatgcaaatttcagatacacaacgaatacttttttagtataagtgtgtcccaggcagtctttaggacatgattatacaaaaaatatttcattgtttacctgaaattcatgttaaacagtcctgtattttatctggcagccctacttgagagaagacatctgatcttatagcttcttggtgttcaccacaatgtcaggggagatgttggggacttgggctttgcttcttggagagctgcatgagatgacttcagcagtacttcttccagctcaagaaaccacactactgaaaaaacctggataaactgaacacactttgaggagaataatgagaaagatgactcaaaaccaagtttcaggatgtgtggttgatgacactgaggttatataatctggagaagggatgatccaggagtaatgggaaagttgttgctaaggcatctttttcataaagattaataaagtcattttctaaagctgcaaggggtaacagcagtgccagtgagtgaaggccacagcaaagcctatttcagctggctggtgggattcttttctaatagcaagagtcattcaacaatggaaggggcttctttgaaaggtggtgccttgctctatcctgggtgtatttgtacataagctgggtgatcccatggcaagggtgctgatgtgagcattaccatatgaatgtgtagactgactggtgacacgtgtgtgtgggctcatgcacacaaaagaactttaacatagtactgaccttttcattcatttttattgagatattgcacatagtacaaaatttaccactttaaagtataactattcactagtttttagtatattcacaagggtgtacaggtatcaccatctccactatctaattccagaacatttctgtcatctcaaaaagaaagccattagtaatcaccctccaatcttcccttatcccagcccctggcaaccactaatctttctgtctctatggatttgggactggttaatatttaaggtaaggtccccttgaacttggagattctcttgtctctgtaaggaggcccttgggatccaccacccaaacacaaggaggtcattcccaaggacaaaggaatctcagcacactggaatcagtgttaaactcagaccctcaagaagttagaatgcaccgtctttaaatcccacattcttttttttaaattttttttttaaatcttcatttggattggtttattttattattattatactttaagttttaggttacatgtgcacaatgtgcaggttagttacatatgtatacatgtgccatgctggtgtgctgcacccattaactcgtcatttagcattaggtatatctcctaatgctatccctcccccctcctcccaccccacaacagtccccagagtgtgatgttcaccttcctgtgtccatgtgttctcattgttcagttcccatctatgagtgagaatatgcggtgtttggttctttgttcttgcgatagtttactctccagtggcgcaatcggttagcgcgtggtacttataaatcccacattcttatggcggcactgtctgttcaaataatagttttttttttttttcgttccatataaacatgcactggtgagcctgagacttaaaggaaatgccatgaagtcaaaatagtgaaaactacattttactttgtcaacctaaataacagagagtctctccaaaagaaaagatgtttatttgtgaacagggcattgcaatagaaacacacatgccatagtaaactatacgcctattcagggaggtaaaggaagacaaaagtttttaaagggaaaaatgaggaggatgatgtaactgttttgaaatcattatctttgactacaaaaatcaataacaaaggtgacaccagtccgagtttggtcagggagttgtttggcagatgtccttatagaagtattttttctgtaaggttgcgatgacatttgtgcaaggttgtggtttttgcagccttttgtgatagtttttgttatcagacctacaagcatgtgaaccatctccatggttttccctggctctgtttgccaggattttcttaacactagtcacccccacttcattctcacaactttcacaaattgcagcctcgtttgtgtgtgcaataagccttcatttctattcttttttgaatattttacagatggggtacagttgctctctagggttttttcttttatttcttttcttcattagtaacttgtgattctgaaaagaggaagtaggaaattacaacattgtttgtgctaaaacttgacatagcatgattagaaaaactgtccttgggcacaattgtgatgaagacatgagtgggttctctcttgtttcatcaggacagctggtaaactcccacacttgtgcttctagcctttcttttggcggggcatgaaaagctcagctacaataaatcatcgtctagcctaagacatttatgaatagatatgttttatgagagtagcacattcaggatctgatgaagacatctgctttttattctcagtgtgtcacatctgggttaactactttgcaaaagtgtagaaatgttatcattaaaaatgaatttgggttcaattgtggcaagagccacagctgaaaacaatgacgggttgacagttgcctgagaaagctagggcttttatttatttattttaaagctatggctaggagagggcttagggaccaaaggaaaatactctacagtgagacttgaacactttacttaactgtgatcctgctcccgggtctgctcagggcactttataggtattttgagtcagggggaagttcacatgctgtcaatgtgtaaggaaggctctctttgatgaaatacagtgtggtgttgacttgatgagcccactgttttttcttaaggaaatacctttgtattgactgcatttgaggacaagtagtgactcataaacctggagcaatatgaggatctaataaaatcaacccctttacctcatacattcctagtggatgctccacaagagttctggggctactcagggcaggaagccatcctcacagggttcccaagaattccggacagaaatagagtcatcattcagcattcctcaggctgcacttgcacccacttccttgtaaccacgagccccatagcactagatcctgaccatttgcatctctgttgttcctatcgaaaggatctctgatgttagaatcagaggcttctgtttaagaattgcttcagcagatcctgaattccagtgaaacagctgaggccaaccagtttgaagaccccccacagaggaacccaatcagcgtgagaacacagcttcttcattgccctgtcccatgacttcaccctgcactcttctaccaatcagtgatctccacgcttcggcccactccaaaacccttaaagcccctagccccaaactccttggagagatggattgaaggtttcctctcatctcctcatttggcagccccatgattaaacctctttctctgctgcaacccggtgtctcggggcagtgacttgccacatgcacggggcaatggacttattaggttacaggagaaccttgacgtacagaaatgtggaaaaagtttacaaaccatttaggaacatcaaaagggacttgtggctacatcactgggaggacgtcctatacaatcatatcctcccaagttggcctgacaacagaacatccataccccaatatacaggcactggggtcggttaacagtggaggatgtggaagcaaaggtgaaaccaagccaagtggctgcaccacccctaagcagcactgtggcggcccctgatagcttggtttgccgttgtcccatggatttggctagtaaggagatgatgagccaagatagattctgacagtgtaggacttacacatacatgtgtcttccaaagctcatacgctggaacgtagtccccaaagggaatgtattaagagatggggccattagcaggcgattagtgcccttataaaagggctctggggactaactcgtcccttttggcttctgccatgttgaggacccagtcacaagttgtcattttggaagcagagagcagttcttactagatactgactctgccagtgcctcaatcttggactttccagcctccagaactgtgagaaataattgtctgttgtttataaattaccactctcagctattctgtgatagtatcacaaacagattaagacattcccccctacccacgctgccagttatttgccacagacaaaccatccctttctctcttttgagagggagtgattgcattgttgtcaacacctaggcacttggcagctctcagttacttggggaccaaggtgaaaaagacttaaacttgacaagtgagtgagaaagagggatgaagagataacatctccccaccatctggcttagccagctgaagaataagatagaaggtcttattgcagctgaacatctggttgagctcatggactcacctggagatggatgactctccagcaagacctgcatcaaaactgctctaattgtttttattagttttctctggctcagcttagtgggttgggtttttttttttttataattgggaagctcctgccttaacttctgtgtcagtcatagtgataaaatatgttgagtatgccctacaataatgatgtatacatgcttaagatgcaaattgcatctgtgtgcatgagatggaggtcaaacccaagggtgtcctctcttgaacttccaccgtaaaacatcagacccctagggcttcctcgtgcttgacccctgagggttcaccaaatcatcgcagaagagtctgcttggattttatccttacttagatacttgtagatgctttattattgctattagctatttattaatcattttcttttagcacattattttaataatttttatattgctccattctgttaccatgtcttcaagagataaagagagcatcaaaagatgatttgaatctccacagtgaaaaggcacagtgagtagctatgaacatcaaccttaatcccaaacaataaacactgagatatgctgtggcaatattataagattttaaagaaacaaacaaaaatcctcccctaaagcctccagaaaggaatgcagccccaccaacactttgatttcagtcccgtgaagattgtttttggacttttgaccttcagaactagaagataattaatctgattcgttttcagccactgagtttgtggtcatttggtatagcaggaatgggaaaccaacacagtgtccattttcttttcagttgctttgtgtagttttgtgaaaagatttatagagatttttttaaaacctcaccattgtcatcttgttttgtctaggatgttgttttctaaattacattttatttaagctttagtgcactggactaagttgactgagaattattaaatatattttcctcccccaaactgttattggaagcaatattttataggaacgaacacagggttcatgatactggctcttaaacaaaatgtgtgtttttatagaaaatattctgggcttgctcattgtttatagcaagggaaaaggaaacttgtgttccatttttcactcccttttactgacacattttttatggatattgaagctattgctggtgtcttccctgtaagtgacacatttgtacttttcaaaaaccattttagaggtatcaaagatatgagctagtgaaaaccacctgctcatgagcaagaagaaatgaagcacatttgcctccatttttcgggattgcaatgtatggaccattcattgaaaccatcttaagacgtggataaatttggggacttctggaaaatgtcttttgcaatgtagtgaatgtggatgctcaattgatgatgtaaaaaaatagactcatataatacagtgaaatgagctaattaaatctgtgacatttattgtggcacagatgtaatagataaaatcttttttttcatattcttcttaacttcttttcttatggttaagccagttttgcttaaggcttaaaaatcaacacctctaaaacctctggcctgtcttcttatttgctgtaataggacactgtcttcactacaccctgtcaaagttctggtgccttagagaattttggggcaaggatggcctgctctccctgaccttcccttgtgactctcatgaaaagcatgtggctgacagtgatgtgtgacccataggaatagtcatctggaactgggaagtcttctgcacaattcatgtcacttttctaattgtgatagaaatctcatatgtgcatcagaaaaataactttaggacatggtgctgagcctagattctaaaatcataactcaaatcacaccaaatgcagcttggggactagagtacagattaaactcatgccagtagagcaagctttgggcattgggttcaccactgaagattcaatcaccattgaaatgcttactcccgagtctggtgtccaaagtattctcagatctgagacattaacatgaaacatatttctctctccctctctctttcactgcatatgtttttgcagtgctttctaaactcatccaaagactctatcattaatcctttttccatcagtccaatggagtaggcatgcaaaggcatcttattacagtagagattggaggaagaaggtccagaaaggattcagagttatattgtagtcaatatattgtgatatatgcattctctctctctctctctctctctctctctctgtgtgtgtgtgtgtgtgtgtgcgtgtgtgtagtagtagtagaagtagtagtaaattagtgatagaatgattgaaggcacgctggactgattcacctcaatcctctgcagaatgatacagccttccttaccgtaaaaaacgtaactttttttttttgccatacatttagggctccatcggtaattattaagcagcaaatagacaattgcctggagagccctccctagagcccaccttcctgccattatttctccctcccttattccattagccgtatgggaaatgatctgagctctcccagctagccttcctggttccagctctgtcctctgtcccaaccactacttgttgctttccctgcacatgccagggtgtgcgggctctgactgcttctctcttcccttagcacaaatcaccctcatccaatgtcttttgagttgagatttcatttgcatggggcaagtccagaaggaagctcattgtaaaatatttgagagtcaggtgtgtgtgtctcatactttggtgcatcctcatggcatatctgttatgatactttgaatctagtagatgtttgaagattattaattggttccttgaattagcacaactaagcaatgaacacaagaggaaacctcatcatttcaaatatcggcattgtggagatctttttgggttttctcttgctactttggcatgcttacagctcacactgcatgcctttggacatgcacaacccctgaaactactcaccaagacataatcaaactggttgtgtgtttaagcacacagctgcctaaatatcatgtggatattattgagattttattatccagatgtaatggggaaatatcctaatggaaaacactttactcattttctgtgaaaggtgtaactgttttgaagattgattgggctgaccaataagcatagaagggattacagaaaggcaaccatttgtagaaacccatactgataagtaccaggtgaacaacatgtttattaatcccacttaaaaaaaaatgtatccagctttggccagaggttttccagtttgtcttcccatctgatgctcaaaaacactgtgtaagatatcattataaaaataattatagtcacactacaactggcaatggtacacagaattgccttgcagaaggtcatgcagttagtaaattgtagaacaagattatcaccaagccttctgactccaaattcggtgtctgttatatatcaccctggctaccaaattccaggacccatggaatctcccagaacctatggatagacattagggaggctgtaaacactcggaaactatatgtgcacatccataattacatctttctcagggaacacaccttgatatttcaaatttcttaaaaggttttatgacgtttacagaccatcagagataaaaagcataggaaatgaaaactataaaacttaaaagaggcagctttccatcttttctgttagaatacatgcttatcactcccacagaatgtaccctcagaaaaaatctctgttttacactagtggcatattgatttctttattgatggcaataggggtagtgataatgaaaggtgatagagtttctttagttatatgcaaatataatatataagttgtgttgcatttccagtagccaaatattagataatgatttgtcctgataaaaatcactaataagattcatttgtctctctccaaacaccagcttctcaatatgaaaaggcatctctgaactactgttattgacttagaaatattgttcactggggatggcgtcatcatactgcaaccagtaagaatggcgtcactcctagaggaactgttcatacagaggaatcctgcacaaagcacacccctggtattgggcagtgcacaattgcacaacttcacacagtgaccctgactctgtgagcaaaaatggaaaacaatatcagggcaggaatctgagagcaggcgagctcaggaataagaagctaaacactggctacgtatcagataaagactggacaatacacaagtgtcaaaggacaagataaatgaatgactgactagacagttgtcaggctgcctgtgaaggtaggatgctctccttcagtgtgtggtctatacattcaaagattgaatatggcaccacgtctccagtgagaagattacatgggtcatgaagcgaagagataaaagtagaaaggtccccactcaccattgttcccagtgacccactgagggaccttgtgcttcctgtccttgcaactcttagttctgcagaattagaggtactactagtcccccaaaggcagcatatatttgccaggggataggaaagaaccctgttaattttataagcaacagaggctgcttgggcacttcaggctcattgtttccaatacgcaagtagaagtgttgccatcttgaccttcattattagaagagatcatgatgctgttacacaatggagcagggaggaagaagggtgtcacctcaggatttactgtgaccaaaatgaacagggacaacgaccctggatttcaaagaacatagtgcctgagctcagtgacccccaggagtgaggacttctgttgcttcaagtcacgaccagcagaaatggtagccaagggtatgggatctagaagcattttgagaggagacaggagatgaatgtctgttgtgatcctgagatgagatgttgcactggggcttcaggtttttctcttaacctgtttgtactgagctttcccctagaaggagaagcctgctgggatcctgaagagaagtgttccccaaacagagatgggtgcctcggatggagtgtggcggactcatgacatgccacccagatcatccttcaaggatggtctaggccggacgctgtggcttacgcctgtaatcccagcactttgggaggcccaggcaggtggatcacgaggttaggagtttgagactagcctgaccaacatggtgaaaccccgtctcttctaaaaatacaaaaattaaccaggcgtggtggtgcatgcctgtaatcccagctacataggaggctgaggcaggagaatcgcttgaacctgggaggcagaggttgcagttagccgagatcgcaccactgcactccagcctgggtgacagagcaagactccgtcacaaaaaaagatggtcttgctggccagccgcaggtatatggttaggcggcagatcctttcgggttcctttggctgcagagagacacgtgtttccctgggtgacccacttccaaagaaggcatcatgtagggatgtaaagcccagtcatttgaatccagcataggacaacactaacagacatttgctccctagctcctgtggttcaaggctgcattgcagctcatcttttccctgtacctcatcctatttccatctcctccttttcacatgtgttgatccataataaataccttcctccaggatccatttcagtatctgcaagaataaataccttgagtgattttcaaagtttatattgtcaattttttaaaaggcatacactgtataattttatttatatgtggtatctcgagtgggcaaactcctagaaacagaaagtggcaccctagggggctactagggtgtggggcaggggaaatttggaattgtttaacgggtacacagtttcatttttgcaagatgaaaaagttgtagaaattggatttacaacaatatgaatatgctaaatactgaactgtatactttttttttttgagacagagtctcgctaattttttgtatttttggtagaggcggggtttcacagtgttggccaggatggtctcaatttcctgaccttgtgatctgcccgcctccacctcccaaaggctgggattacaggcgtgagccaccacatctggcctgaactgtatacttaaagatggttaagagggtaaaaatggtatgttcatttgtgataagattaaatcaatttaacaataaaatagaaacaaatgaatcaataaatcggtctacatattcattgtagagttcctgaaatagaaattatttattattcttatgagacccaaaaccaggtaaaatggattatatatacatataagtgttatatatacatatcattgtaagttttgtatatacatataattgtaagttttgcactaatgtcacagtttccttggaggaatttttaataatgtggtttagtattttcttaagaagaaactaaagatttatttttgcacattacgtgtcacctgaataagtgttgcaaatgtaatatgatttcaacatgaaatagcctaacagacttctcacctgcctattaccttaaaaaataaccaaactgaacacaagaaaattagattgctgaaaaccttcactctgaagtgaagaacctgagttgttcctgcaggtggcactgtccgacaataaaaaagaccaatctatgaactgccctgttaaaaattcaatactagccttcttgacctaatgtttaaacatacattttctatagtataaaaatgaacttttttgtttgtggtaatatctattaacaactgttcttgtcctttattcaaatatggatatttaacttttactattgaacattagattgttatttttagtattttttaaaggtattcagttagtgaaataatatcttagatttctggagtttatatatttatcattattattaattttcaccaaaccaaaaaatcctgaatcatcctgaatgcagctaaattcttcctttctaggtaaagacccttgagtgatacctgaccacacatacttggtcaccctgtgggtgtgtcagaagcaccccagtccttctctttggacaggcactggggcttttcttgagttagataagaggaaattccttggcaaatggttcactttgtagcacctcacaggatttaggagcttaactctatgcctgataccttggcccctgtcctcttggaagaaccaaggtggaaatattgttgccaaatagactattcacttcaaacagaaaaataatgcttgttactttctgtctcctctgttgacattcgtattcaaaaatgacttttcctgttcaattaaagtagggagaatgagttcttaagagttgagagattccataaactcagggaaagccttcattttattgactcttttcaattgtttctcaatgtcttaattcactggatccatgcaagggtgtgtaatgtgcactttcaacaaaaagcagcctgagaagcaggcatctaatggcctggtgctagtgctctgttgcctttttacaactgtgtcaacacaaggcttcctctatgccctccagccttcattctgagcacccaagcctttgtgctgggtggcttcttctttcctgactccagccttcattctgagcacccaagcctttgtgctgggtagcttgttctttcctcactcaacatacatcacaaaaatacttcatgtgtcgaggccacttttaaagtgtttaacttaccctcccaatcctcttctgcaatttatttcaagatacagactcgatgaatttaatgtatagcatgcctcctgaacctcatttaaaactcagtcttttaagggtacttgtgacttggtttgactcttctgagcattagaatcttgccccccattattgagaaggttcatcttttcaggtacctctctctataataatttaaagagcattctataaaatctagctttacaaatacaacaaaatgttgaggataatgaagcccacactctataataaaactcaatagcttgccaaatgaatattcagacacttgtatcaatattttctagatatgcaacagattctataaggtatacaacaacttgaaataagactccaggttccacttactgttgagatggagacaaatcctgccaagcaacaaaagtttgtgcttgcactgcttcctgtttggttgtgaattaatattggttgggagcaaacattggagcacctatttgcactgcatgaagacctcgtagggaaacacctttaaaattcctctagaaatactagctctactttaatcaatttatgctttttcaatttgcattcagtgccctctggcttataaaggcaaatactcaacagccacgcctgtcattttctaaatcatttccatgtagaggctttggaagggatcaacccaccctcatttataacatgcaagaaggaagtgtacctcatataccttcttgactatatctttatggacccacaaaaaggccttcattgacccagaaatggaaaaaaaaaatcaaactaatagccatatgtgagtgcttcatttcagactctaataatgtgaacttctagaaccatgtagcatgaagtgggaagtggggcatgggttaaggattagaaaggaaatagagtctcagaaataaagcactgttatagtctgaatgtttatgtcttctaaaatttctgtgttgaaatccttattcccagtatgatggtttcaagaggtgaggcctttgagggttgattaggtataagggtggggccctcatgaatgggattagtgccctcatataagagatcccagagagttcccttgccccttccaccatgtgaggacacagcaagaaggtgctgtcaatgaaccaggaagtaggtactcaccaaacactgaatctgccaagtctcgatcttggacttccagcctccagaactgtgagcaataaatgtcttttgtttacaagccacccaggctacagtattttcttatagcagacctactgactaaaataggaccttccataattttttttttccaggacagcagatggaaaaaaaaaagcctatcaaagaaatccaaaagattagagattatgtaatagtctgtgaagacacttctgaaagcatggtctgcatatggctgaggtgcagtgagctaagtttttaacatgactctgactgccctctctagattgcattgaccctgggccacctggaaccaggggacttcttccgctaccctctagcagggagctgcatgcaaactcagctgcccatgacaggagggcctgtaacaaccccttgggttccagagtctctaggtgcccagcagctataaatggctgctgaccagttccaggtgaccagacagccaagaagtttgtgtgtcatttcactgataaggttgcccacatgcttgtcctatacacaaaggagagcaatcaggtggccgggtgtccagcctagaccctcatggtgtgtccagccatgctgtcctctgcacacctctctgaaggatgaggatggacagaaacagtggtttctcttctctcattgaccttggcttttgaatgtaccccagtctccaatgaaagctatcccttcacccatgctgtgtcattgttggatttcttgtaaatgctgatgcagcagagagactgaccatgcagtcactcatcctgccccagttacctaagttagaagcaaccagagctcttctaaaagcacaaatttctaatgctcaggcacaacctattgaatcaggatgagcctgaatttttaaacaggttctcaggtgagttctaccacaaaatgactttgaaaactagtgatccaagacattgtttctcaaaccattagatgacctttgaaaggcttgtgaaacagattgctggggcccagactcagagtttctgattccgttgatctggggtggagttctgtaatttgcattttatccaagctttggggtgatgcttttactgctgatcctgggaactaaatttagataaccactagcctaagtcttagactctaagagaaaaacagtgctaatgtagtcacagtaacctttgaggaagctaagaattttttctggtgtctacattcctaacataagagaagaaaaaaatgaaaatacatattctgaagcaacatacttctggcttccttaccaatatatctggaaaatgggggaaaagagacaaagatagaatggcacagtaaacatttttttgggagaatgtgacaatatgataccatgatcactacaactgaaagttttgtacatgtggcataaaccaagaacaaagcagtatttagtagatttccaaatatttcatacatcgggaatgtgtaagtgctataaaactgcaatataaaggcacaagttatttaacagagtacactacatttcccctcttcaataaagatctaaatacaaatgtaaatgtcagagttatgtaatccatgtacataattccttttccatttattcactcatatttaatgaaccttgagatgcataacttttaaaaacatggataatgatacaaaaattagccaggcatggtggcagacacctgtaaacccagctactcaggaagctgaggcaggataatctcttgaacctgggaggcagaggttgcagtgagccgagattgtaccattgcactcccagcctgggtgacagagcaagactccatctccaaaaaaaaaaaaaaaaaccacaaacaagccacacctggataatgacataggaagagttatttaatagccacttaccatgtctgttcctacttgtatttaagttcagtgacattcagtggtaagatatttgctcagtaaatgaacaaatgattaacagtgtacattatgtagtttacaaaaattgaaggaataagggggaagaaaaggagtacccatctctcttttcttcaaatggttttattgtgatagagtgtgtatgccacttaattcactcatttaaattgcacaattctgtagtttttggtattgtgttagtctgttttcacactgctataaagaaatatccaagactgggtaatttataaaggaaagaggtttaattgactcacagttctgcatgactgggaagcccttaggaaacttacaattatggcagaagatgaaggggaactgagtaccttcttcacatggcagcaggagagaaaagagtgagtgaaggaggaacttgccaaacacttataaaaccatcagatcttgtgataactcactatcatgagaccagcatgggggaaaccatcaccgtgatccaatcacctcccactatgttcccccctcaacacctgggatttataattcaagatgagatttgggtggggacacaaagcctaaccatatcaggtatattcacagacattgtgaatattaccacggtcaactgtagaatatttttatcatgtcagaaagaaatctcatctcttttagccatcatcctcagtgatcctagccttctcccagcccctggcaaccactaatttactttgtttctattggtttctctattcaagatatttcatatgaatgtaataatatactatgtggcatttttatgccttgcttctattagtcaggaaaatggttttaggtccatccatgttatagcatctatcagtagttcattcttttgtggctgaaaagtgatgattatgtagttacatgacattttgttaatgggcatttgggttgttttcaatcattagctgttatgaagtacctcccttattcagtggtaagatatttttattgtaataattttaaatgaaaatattttctattactttctaaactctatagtgtgggtaaattgaacatcattttttcttgagtcatgcggttttattggggttgacttggtacccccttaaaaatatatatgcataactttgaaacaataatttataggtatacatatgtaattttgaaatgtcatactattcatacattattttgaagcagtcaccaacttacaaaaaatttgagtatagaatacaaagagctttcttttttcctaaaacatctgagggtaagtttccactctgatgcttcatatcctgaatattttagcatgcatttccctagaagaggattattatacacagacacagtcaagacctaaaaatcaggaaatgggcactgatgtatttctaccttctaatggtcagactgcctttaaatgctttgaggcaggaggagccagttagaattatgcattgccatgagttttcacgtctcttagtctccttcagtctgatttctcatctttctttgactttcctggtcgtagtgtgtccggaattggtgggttcttggtctcactgacttcaagaatgaagccgtggaccctcgcagtgagtctcacagttcttaagggcagcgtggccggagtttgttccttctgatgttcggatgtgttcggagtttcttccttctgatgggttcgtggtctcgctagctcagaagtgaagctgcagaccttcacagtgagtgttatagctcttaaggcggtgcatctggagttgttcattcctcctgtccgaagttgttcattcctcccggtgggttcgtggtcttgctggcctcaagagagaaactgcagaccttcatggtgagtgttatagctcataaaggcagtgtggacccaaaaagtgagcagcagcaagatttattgcaaagagcgaaagaacaaagcttccacagtgcggtaggggacctgagcgggttgccgctgctgggtcaggcagcctgcttttattctcttatctggccccacccacatcctgctggttggtccattttacagagcgccaattggtctgttttacagagagctgattggtccattttgacagggtgctgactgatgcatttacaatccctgagctagacaaaaaagttctccacgtccccactagattaactagctacagagtgccaattggtgcattcacaaaccctgagctagacacagggtgctgattggtgtgtttacaaaccttaagctagatacagagtgctgattggtgtatttacaatcccttagctagacataaaggttctccaagtccccaccagattaactagatacagagtgtcgattggtgtatttacaaaccctgagctagacacagggtgctgattggtgtgtttacaaaccttgagctagatacagggtgctgacataaagattctccaagtccccaccagactcaggagcccagctggcttcacctagtggatcccacactggggccgcacatggggctgcctgccagtcccatgccgtgcgcccacactccttagcccttgggcggttgatgggactgggcaccgtggagcagggggcagtgctcgtcggggagactcagtcatggcgggctgcaggtcctgagccctgacctgtggggaggcagctaaggcctggtgagaaatcgagcgccggtgggccagcactgctgggggaccctgcacatcctccgcagctgctgtcccaggtgctaagcccctcgctgcctggggctggcagggccggccgctccgagagcggggcccgccaagcccacgcccacccagaactctagctggcccgcaagcgccactcgcagccccagttcccacctgtgcctctccctccacacctcctcacaagccaagggaggcggctctggccttggccagaccagagaatgggcaccgaggccgaggaggcaccgagagtgagcgagggctgcgagggctgccagcacgctgtcacctctcagtagcacaattaaaatgtagcagccagttatttcacagaatgtccctccatttgagtttgtctgctatttcctcctgattgtatctggactgcacatattttccagaattagtgcaaaagtgaggccctgttcttttcttcacattctgccacattctaagcaaatgattttcaatttgtcctattattgatgaggatttgattaaaatgttccccaattttaacactcttaaaccatatgaaatctttacttgatgctagctcaattagcagctaagactagattctataataaaataattctgtcaaaattttagacatgagaaacatcagttcctcttttaacatatgacaagtactcctaatgtctagaatgtagaatgaccacttattcgtctgtcatgtagattccactattaattttgaaatccatacggcattttataggaaattgaataaaactcaaatgtttctgattaaattttgcttacctcttgaatcttttctttcctgaaaactcatcaaactgaaatgcctttgtaagaacttcttgattgtgtcttttggaaaatagaaagccacattctgtaaaaagatataaacaacattactttctcaaaaactctaattcaatatataaatagtataccttcacattcatgaatcctactgtgttcaaagtttactagttttctagttattcctttattcatatttatgtagaatatttcagaataagtaatatttaattttaaagaatatgtttcacaaggtattttctgatgttttaaacttgttttatcaacagaagatacatgctcagagtaaattgtgtgttttcaacctcagcgctactgaaatgtgtgttggattgtttttgttgcgagagggctgtcctctgcatcacaggatgtttagcagaatctctggcatctacccactaaatgccagtctcacccccaccctcaatcctgacaaacaaaaatatctccaaacattgtcaaatgtccccttctgggttatgtgggtggggtgtgtgtgtgtaaaattgccactggttgagaacaactgaagcaaattttagaatatttatgtaattttaaagacttccaatttagtaactatagaagtaattatagattataacagatttctagtggagtagaattgtcaacatttacattattagaagtttgagttgttataaatttcaaagaaaagaccagatagggttacattttaaatatttctgaaggtgtgtttttacagcataatatatattaaaatagatgatataggactaagtgttattgttaaattcaatcatagtttggacaaaatgtagtcctttttcatgtcagttaagcaagttgacttatctatgcatagattttgataggatttcttgtcaaatgaaagaatgaatcctggaacagcagtcatcaagattgcagttgttataactggtcaaaaaagcactcattcctgataaggatttttttgtgggaatatatatatttttttactctagccagtttacagtcaaatcaagacctgctacagctatattttaatgtgccaagttcatatatttttttcaatccttttctattagattgccactgtgcatattgaattgtaagtaactgcaaataatttgatatgggtttatattaactacaaatatcctccttctggcaaacaaaatatttttactaaattttctgtaggtggtagggagaattgggaaacaatttcacacaatatctactgggttcttggttaggtcaaaaattcagcataagcaacaccaggtgcttagaaaggattgcaaaaaaacatatttgatgtgtttttttgtccattttgcaggtatttgttttattactgctattgaaatgcttttagaaatattttctggcaaagcaaacatttattttggaaacatttacttggcttctaaggttgctattattcaattgtttgcttaatcaaggggaaaaatgtttgggaggtacctgatggttcttttatttcctctgagaacaaatctgtggtgttatgtgagtgttaaaatggttcaggaatcaaataaatatctgaaggagttagaataagccaatctgtttgacacaggaaggagacaggtcctggcagagggttaagaatttaaaaaaaaaaaaaaaagaataaaaagaaaacaaaaaacttgaaggtgaaaattgggtgacaaccacagacagagactaaaggaaattagcagcagaaggagcttcaagggaatatggaatttccctttgttctaggtttctgttttctgcatttttttttcctctggccgaccttactgtcagaagctatcatgaaaagtcagaagctaagagtgtgatgtaggtcatggttaggcatgaatctaagtttctgctaaaccggatttatgaataaaggagaatttgtcttacagacaagaaaaaaatcaacttaatagattctatggcatgtctagagaaaagaaaatttagcaattgctatctatcaatatatggcaagctgagcataaaagccaggaggtaaggggtagtgaattgaaacccatgagcaagatataagtgttggtagtccctgaaggacaaggaaaacagcgtgatgaattctgagtgacaaagactgggagggttttccatttggggttggatttcttgtttctgctgctacgtaaatcaacacatatggagtgacaaaactcagtacagcaaaggccaggagaaaaagacatattccatctagagacatattgtagagatgtggggaaaaatacaaagttttattttgttaataatctttattgctcatgcagttgacacacacacacaaaaaaatcaccttctacccacagcatctcggcatcaatttgtggagtctgacaaggaaacccaggttatatacaagtatgggtcttaatacctatatattttattagctttactcagaaaattaacaaaacttccactttgagaagcttccatcttatgacctggagagacataaatataattagtaaacttttgtttccaaagcaagattggttgtgctgcccttccctccatcctttgaaagaacaatctgtttccccccattttgctgttttccttttaatttccctgctcttctctggatgtctctaaacctgcgttcatctctgttctcttctgatccagctggatgtcttggtttcagggccttcttatacttttgaccttgtttacagccctcacttggctggatgtaattagcttctcacctgtgtccaggattattttttaacccttttcctggtcaattgccattttgttagttctttttcctttgaccaggatcacaaatgcatggctgtgtttaagggagagctgcaggagagagaagaggtgacctgaagtcacgttctgttcattgtaggaaaagtaatatgactgggatggttaggtcacatgatgtttgagaacctaatgttcctcattagcatcaattggatgttgaccttggttcaagctccttcttgtttccaatcacataaccactgccccgagctaaagacaacattggtaggatacagatgctgtgtgaaaagccacatgctggaacaaggttctgaatctttcagctgatgtgagtaattaatccagcttttcattggaccataaaacatgattttccaggaatacaggagaaagctcttctttgctccttttgttcctttattctgttgatcaacctgcctcttctgtggctcatagaattattttattttacagtcattgtcagtgccttgtgtttttcagaagtattatgacaagcctaggggaaggtaccaatcaaatgtggccatgatcatgaatacaaagaagtgatttcttctcttctttcttatgcaactcagcagaagtaccctcagcttacctttgaaagatctctcctttttttctgcctgatgagtgaaaatactttgatgactcctcatgaatagcaatgtgcatgatcatttcacatccatttttgtgtttccagagcctttgtgcagtatgcacagggatagatagtgctaaaatgataatgattgaaatgaaacgaagctgagattaaattgctctccatgaagctcatggtatagctaaaattcaggctctgagagaatgggtggcatctgtcatcatggagattagtatatctaataaagtttaaattcttgagggatttgtcttcattccaagccttctattaggacttattcataggttgggagaagttgagaagtcttgtcaacaccacatgaggagggacacagatgggtcctttctaccctgaaatgttatacatgggcccagcaataataaatggccgttgctttctaatagcatttgaaaccccaggttaagaaggagctatgcaatacaggactgatacaatcagaattttattacagaatttccatcctggcaatactatcacctcaagcaagtaatgcaatagtcacctgtttcttagatgaatgagaagttcattcatatgaatagctcagtgctttatgtccgtggaacacaaaaagctaatgctttaagtttaacttttctcatatgatgattgaatattctggcaatttctggtatctggaattattaaataatgtattatgacacaagattattttaaaatgtcattgttatctttaccatttcacattcaataaacaatatatctgagcctaacatttcacatttctttacactttcaccagctaaatttcctttaattctcaccaaatccatcaaactaaatgcgtgttaacttggctaataaaaatgtcatgatatttcttaagaaaatgtagctatgtgtgtgtagatgaaaatggagttcgtttgtaaatattgacccatacaaaggtaaacacaggtgtagatgaaggatttatatgggaggaaataaaagctgagagtgtgaacaggttgtgtttcagatggtacaaataaaggagaaagaaagatcaaaagaaatagcaacattctaaaatagtgttcaaggacctgggaaggagtcaaaggagaaccagtggttctcaaacggggcttcagggctccctaagtggtatttatattggggtgggggcatgcttggttgtcacaattagagggggattgcacaggcaatggatgggagggttctgttctacagagaagtatccatgtcacacataagttttgaatgacccccaggaaatagttgtgtgtcattctccaacactaaaaacaaacttcagtttacatagaaaccccaggcattctatatattgttttaaaatatactgcatattctagcagtgcaacgagcaagtagcctgaagaaatttgtttgattgcttgtgcactcctgctctgtgacccaggctggagtgcactggcacaatcatagattgctgcagcctcgaactcttaagctaaagtgatcctcccaccttagcctaccaagtagtagctgggactacaggcaggcatgtgccaccaggcctggctaatgtttctaaaaaaaaatttatacagatgggctctcagtatgttgctcaggctggtcttgaactcctggtctcaagtgatcccccccaccttggcctctcaaagtgctgggattgcaggtgtgagccatcatccccagcctattttgttggtttttgagatggggtcttgctctattgcctaggctgggtgcacaatcatagcttattgcatcctttgactcctaggctcaagtgatcccccaatctcagcctcccaagtagctaggactacaggcacacatcatcatgcctggctaatatttttttattttttatagagatggggtctcactgtgttgctcagtctagtattgaactcctggtgtcaagtgattctcccatcttgtcctcccgaagtgctaggattacagacatgaaccactgcacctggccttgaggaaatatatttcactttattttattcagtatgtcattaagagtgtttttctgcttgagaaaatcatatcacttttgacagtgcctcttgttgtttgaattgttggtctatattcatacgtcaggctgcaggtgaagtttatgtatttatggcacatttacaactatgcacaaatacacttttgttttcaaaatatccattttaaaaaaaaacatattattcatttgaagagattgttcttattaataggagcaagcatataacaaccttattctgcattcgagtgccattgtgccctaacatttacatattttaaaatgtaacataaatcatattgtctttatttctgctttatattgcaatgggccttatttcctgtaatgtttataataatacgtgtaggtcatctatgctccctctcgattccatttcaagagttaaaaaggaatgaggaaatatttttggtaaggagtaaaagagccactgataaaaaggcctacaggacttgggaggaactgcagggagtggaaaagtcagatcattagcggagctctagaaaaagcattggcgcttaggcttcttaaaagattcacatgctggtgtggagaggagggcctactaaccaaggcctgagagaaagaagcaggctccaggaaagcataggaatggggcttctctgagagggactgttagcaaaatgttaagataaatttgaaacaaacaaaagagataaggactttttctaaacctgaaccgcaattacttttgcaccaacctaataaaaatcacctatgacgtaccaagctgtttttttgcctcagatccaaagatgaccaagacagatccctccaagaagggtgtatatcctagtgtgagtgaactacacaaacatgacacaggaaaagacaactggttcccaaggttaagagtgcaattcacttttgtgaaaaacatgcctgagagtgttgctagaggttctcattctgtttttttaaatatttttaaaaaatccatgtttaaattgacaaataaaaattgtatgtatgttatcatgtacaacatgttgttttgaaatatgtatacaatgtggaatggctaactcaagctaattaagatatgtatgatctcacatacttatttttttgtggtaagaacacttaaaatctattctctcagtgattttcaagtatgcagtacattgttatatagtgagcatgatgtacagtaggtctcttattcctcctgcctaactgaaattttgaatcctttgaccaacatctccccaacccaaaccctatcttccccttaaccactaataatgaccactctactctctacttctatgagttcaactttttaaagattccatacataagtgaaaccattcagtatttgtccttttgtgcttggctaatttcacttagcaaaatgccctccagattcatccatattgttgcacattacagacatttcctctttttttaaggctgaatcagaatttcattacagaattaccccattgtgtatatatacacaatatatacacaacatattgtagatatatacacaatatatacacaacatattgtatatatatacacaatatatgcacaacatattgtatatatacacaatactccattgagaaaaatcacatcacatccattgtgtatgtataccacattttccttatatgttcatttactgatagacacataagttgattctatatcttggctattgtgaaaaacgtggaaatgaacatgggagggcagatatttctttgacatactgattttacctcctttcaatatacatccactagtgggattgatggttaagtttctaattctcaaaagattaagataacctttataaatgtctggaaaagtttacatatatttataattacatataaatatatgggataattatatataagtatataattatgacagaaaatgaatctttttctcctatttaaatgcttaaaaatcattcacctcaagaagatcagatacttatctatttttttctcctatgggtcatagttttaattaaattctctaaacaattttgggcttaaaatttgtgtttgatatgatataaaactctaaatctgtttattttacccaaaattttaaccaagtttcctggtaacgtctattgcaaaattctttctctctcgactagggtagtttaattaatccccacctcctacactgagttatatttaatgtatacttccagtttcacagagcctaaactttattcttaatgagaatcagtgattaacctagtatgatcctaccaagtaagttagaatattatgttgcctgcctgaaatacattttttatattgaacacagaataatagatttatgctatttgcctaaaaagtattttctctgcttccatttaataaatagtggacagatatttagataacatatttcgaaggtacaccaaattattagattaccatgatagccacatgatttcacttggctttaggttgattgcactgttttttgttttttctttttaaaacctccatcatccttattgcgagttgaaattcttcttgcctgccctgagaattggagtggtcaaatcaaaaagcttttatgaaagaggttttagtggtggtgtgagattttgtctttcttatttttcagagacattttggtaggagataagaaattgctggaatcatttccaagcctggctacattctttagtagctctgtaattttgggcacattgctttctcaaacttgtttccacatatgtaaataggaaatagtgatatctacattacatggttattagcacagtttctagcatttgtaaccactcagtgaatagtaggagctattggtatttacaaagtaggggaaagttgaatacaaagttagtatccaaaagtatattggatactaaaagccagatgttctcttctgcaagaattctctcacagatgacttcaataagttactattaaatgaatgataaatggataaatgagtggataccttcataaacaaacacagataacacatggcaaggcatggatggatcagaactgtctacttccttctggccaatccaacttttttatgtgccttgcaacttcttgcctatacaggtgaatttcaaatgtgctgtcttgttgtcatcagttaccctagatgattcctcctctccaccaattctcttcctttaaccccttctcaggggttaaactttctgatccaaagttccctgccttgaacctgcattgggtcttcaggtttggaatttttacgttagagtctgtattctaacctttattttccatgaaggtcctggccttagcttaatcctggttgttctccatgatctgaaatacaataaatcattcagcagaaatatttgagatccaatttgtctcgagggaacagtatttctgagttagatactgtaaattttggcagataagctatgatatttagtgcagaattatagtcttgtaagcaatatgtgtttttttttcctcttccgagatggagttttgctcttttgcccatgctagagtgcagtggcacaatctcgattcactgcagtctccacctccaagcttcaagtgattctcctgcctcagcctcctgagtagctgagattacaggtgcacaccaccgggcctggctaatttttgtatttttagtagagaagggattttgccatgttggccaggctggtctcgaacttctgacctcagctgatctgcctgtgtcggcctcccaagtgctgggagtacaggtgtgagccaccatgcccggccaaatatgtgaatttttaaagtggctgtgcatccaaaagctattattttgtacatgtttaagatagaaattaaataatggcaatacaatttattagttcatatcaagtaaaaacagttggggttgcctgaagatgggaaaattaacacattataataaaatccttactatttattgagaaataaacaatgaactaattgtatttataaattgtccctaaattagaatttacaacccaagtgcctttcccaaacctatcaaaacagaaccaccttgcaataataatatccaagaaattatcatttacccagaaatctcagctgatttgcagatggaagtagcaaagtctctcgtcctcaggattggttgtcacaggtttacactaccaaagtgtcttggaaaattccatcattgttttatgccttattttactgccttcttttcaaatgttctctccctgcctcgaaatgacttctggttcatgaaatgtatggcgttttctcagcctgagagacctggagatcagcatcactctgttcatagattgtagattgtgcagttgtggtggctctggcagccaaaatcccaaagatcatgttgtcagtcactgtgcgcagtccagaaaattaactttccgtcattataattctgtggtttttgaaagtatatcaaaaataatatccttttagaatacttctgtagtattctgattttttaacggaattctttattctcctttgagtcacttggaatctacttctaatccagtcacttggaccataggatccagcacagtgggacctgcccatgctaaccctaccccaaagtgggtggtttgcacaaggaccaaggtcagttgccctcagctgcagcactactgacatttggagctggatccatcctctgtggtggggttgccctgtgccttgtggatgtttcgcagcatcctggcctccacccacttgatgccaggaacatcaccctcagtggtgacaactaaaaatgcctccagacattgcctaatgtaccctgggggacagtgtcacccctgggtgggaaccactgagctggattaataccctcctcatatcaaagcttgcactaactcttcagtgtgggagacttggcaaattatatcacaacagtgtgttgaacctgtgcatagaacaatcactctaacataacttttattgcccagttaaaaattcctccaggggttgctacagatacgtatctaggctgtttgaactctacctgattaggcactcaaaattaatgtgcctcaagatgttatgatcaaaccaactcgtgtactgatcattgatgtaaagctatttggacttgaataatatgtgttccatacacatgcatgtcaatattttaaaatctccttaatcagattaaacaatctcactccgaaaaaatattttaaagaagataattgtccgtgcaatatagctatttatccttgcctttttaaaaataatgtaaagaaaacaagagtagtttttcctgtaagaaaatatttcttcattcacactccttaacaaattcaatttctttaaatagcgagtatttttttttctgcagacataaaggtttacttatttcctaagttattcctagtgactgtgaatgtgtattttcaccaatttattaacaaaatatttctaattattcaaaactgattaatccctgtataatacattttttaaaattttgaaatattcttaatcttaagaataatttcaaaaaaatccaagaacttttatttttcctaagctatttgaagacagttgttgaaatacttgtgtgtgtattttctacaaagaagtacattctcttatataatcagagtacagccaccaaaatcaggaactgcagcttggcatgtagctgccacatatccccttcaaagtttgccagttgtcctcataatgtccctcacagtggaaagattcaatacagaatcatgcattgtgtttagtttcatgtgtgtggttttttttttttttttgtcggggagggggcggtctctttcaatctgaaatcatccctcagcctttcttggactattgtttttggaccttgatgtttttgaaggtttcatgccagttagtttgcctattggttttgtcttatgtttgctcatgattacatttggattatgcatttgtagtaggaacactacaaatgtgactctgtgtttttctccctgcatcccatccggtggtcgatttttctcctggcttgttaaccttgatcacttggttaaggcagagtattccaagtttctctgttgtaatcaataagacttttgtacagaggtactttggtactatgtaaatatcccattcctcatcaaatttgtacccactgttttaagcattcattgatatttctttttctttcttttcttttctttttttttaaagacaggaacttgctctcttgcccaggctgaagtatagtggtgcagtcatagcttattgcagcctccaactcctaggatcaagtgatcctcctacctcagcatcccaagtagctggggctacaggcacagccatcatgcccagctaattttaaactgtttttgcagagaccaggtcttgctgtgtttctcaggctcatcttgaactcctcgcttcaagcaattctcccgcctcagcctccaaaagtgctgggcattaatatttcttggatgaattattacagttatcattatgaaatagtaatattctaattccaccatttcttctacattctatcaattgacagtatacagtaaagaagagctttatcgtatctccatttatcttaacctggactcagattcattttttattaaacagattataatctatttctgtcattatttttatttgatgcttatttcctgctgaatccatccaacaatgtattcatccatcatttcaggcattcactctttttttaggcagtgcctctcttagatttttcctgtcactttttggccttcacttgtcttttctagattttaaacttgtgtaccttgcaagattaatgcagtgcatctcttctaattctgtgagccttcctttattcagtgggtgaataaatgacccatgctccccctgggttcttctgagcaatgtggtgctgccttcagagctgtttcatgacctggccaccccagcttcagcgtgtcacaaaagttccaagacatgaaggaatcatatcacacgaaagttctcaccttgccatattctgattttttctgccacttaagcaacacaatggtcactgccaagaggcatccagtgttctgagaaatcaccccagccaggccaaccttggactgcgttaattgtcatgctgttaacgcaaagataaacgggtgatagctgcccttcttttaacctagaggtgtgcttaaattctctgtgtttttctttaaatggttggaggattatctaaagcaaatacattcccatgcagctgctatatctatgattaaactttttttttgatgacaagcttttgaataaaagtgctgctaagtttcatgaaaacagttacggtaacagagttggacatttattcacattatttccaaatgtgcaaaagagaagagtaactaatttatttatctatccccctgcctctctttgtagcagaggaattcacacttgtgtaccagtaatagctcatcatcctccctgctacactgttgtattcacttaacttgcattgtattcgtagactggttttaaaaatatgactttttagttttctgccgagaatcaaatcttctctgtaaacagcacacaatagctaggaaacctgatttccaatttaaaatatttcagtctcttgctaagcaagtgcctttcagtttaggtatctggtgtagtaaagtggaattgcttattacacccgttttaaacaatcacttatgggcacctcagaccctttgggtagatgctcagctgatgagagccttactcaccttcttcttccccaagatggtggataagttcatgagggcattactttgtacaatgggatggcgaccctgggctcttgctggtccctgcatgtgcatggctcacttccactgggtggagtttgtctagatccagccacaaaatctccaccatttgatatgcagttttgcccctggaatatttcctggtctggtctcttccagcttgttggaggcctgctggtctttcctatggactttgccccacctcagctcttgctgctactagatgtctggtggggactcctcttccattcctagccccagcattctgctctgcctcctgttgctagcgggcacctcagcctgcagcaaccccgtgggaagtccgccagcctgtactgccttccatctgtactcctccccagggatccagggagtggaatcttctgctaactcagacatacatgctgcctccacaggtggccaccctggttgctgtgggacacctgtctcctcctgccgtccaaaagagcaagaagcactaaactctgtcttcggtcagcatgactctcagcccatgtaagctcaccttggctgtaccccgaggagggagatcaaagtatatgttcctactgtcagctttactcacatccacatcttctccctgcatgtccttgggttggaaggaacagcttattttttgtcctacatcagtggttcttaaactttactgtaccaagaaagcttttaaaaaatgctgatgattggggcctgcagattctcagtcactgatctggatatgtcctgcatgtaagagtgttttgcaaatcgtttctaatgtgcaaccaggattacaaaacgttatcttgtatcctgagttctctctactcttggcataaaattaaaatctgttatatcttgtgtatgtgtgtgtctgtgtatgtgcatgtagagaaagagatagaaactgcaagggtagcctcgtaatatgttaaatggtaactatttcattttgggaaattttgacttaaagaatccttttgtccccctcaacgaagtatgctctgtacagctattgccttgaaagaaagaaaaatcccctgtgcttgtcagtagctcaacatggcctctttatatccctttgcactttgctcggtagctcaacattttgcattttgcagcaatagttcaaaagcccccctctctgccttaggcccctggatccctcagaatgcttcaggatgcctagcgagaaggatatgttcacagaaaggcaaaaatggaaagcacattagtagagtttgcaaaatataacctttgcatcactgctattatccaccccacagcgaatgaggcacgtctaggtgaagggtacatttatttgagccacataaaccaagagttataaagttatgaaatatggaaccaatagggaaataaatttatttttagaaagacaaagggacttgcccaaggtagcatgattatgtaaggttttaaccaaaggcaccatttccgtggaagccaggaagagtagggcgggagtagggcaggagtagggccaggagggtgaaatccaagtggcttaaaggtgacgtatgagctttcaacagaatatagaaagaatgaagagcggggcctgttttctctccttcttgatacttccatgaagcctattatttcaccagccttctgcagcttaatgatgcagggggcataagaacaagggatggagtttctgccagtaggttcacctgtgttgtcattatttagttattattcaccaaagcgctgttgataactatcttttgcagcaatggctcaacaaacaactaaagcagcctgggcgaggtcgctcatgcctataatcccagtgccttgagaggctgaggttggaggatcacttgagatcaggagttcaagatcagtgtgggcaacatagtgagacctcatctcttaaaaaaaagaaggccaggtatggtggcacgtctcagctacttctcaagaggccaaggtgggaggattgcttgaacccacaaattcaaggctgcagtgggtcatgattgcaccactgcactccagcctgggtgacagagcacgatctgtctctaaacaaaaaacaaaaaacaaaaaaaaaaaagaagaaaaagaatgcaaatatagacatttataagtataaatgctaatgataaactgactttttaatattttgtttcacatgagcggtattttcacagccactggattgcttatctattagtggttctaaaccagaggtgattttgcccttccagggggcatttagcagtacctggagcctttctacattttatagtacttttcatgtttcctaaaacttttgaaaaactgaccttcttaattgattacttatgatgctttcaagattcaaattgttccatggtaattcagccttctctatttcattgtttattttctcttctttgacattcacgattttgacaaagttaaaaacttacgttgggtcacagactactatgatagaggcctgagcctaattattatcagcttaagttgtagaaacagctcttgtattgacactagctggatttattttatttaattgttttggaatgtgtaaatattatgcagttgatgtgcctcagaggccattttctttcactttttaaagtacaactagaagttgatatttttagcattcagtattctacactttgtggacagatgaacttcataatgaagtatgaagagcaactgtaccttaaagaaaaaaatagctacatcaaaactaggtaagaatgccctatgatggaatattttatgctgctcattatattttacaagtcatagcagggcattatgtggagagatgtatcttgctggaaatgcactttatgacttattttgttattccaagaggatattcgtacttgattatcttctactcaattgtgaaaacatttatgctttcgggtatggtttcacccatcatgtgggctgggctggtttcaaaaatattcatatggcggttgctaattataggatctcaggaactattaaaaataaacacaggcacctaaattcgagaaataaagaagctgattaggaatagaagcacattgagaccttagcacagttgtaaaatccatgagtttgagctgattaatagagcgtattattacagaatggtgatttcctgttttttggcttcccactgtgcaccaattaataatgtgtatcttatccacaggcagcagaggtccccccctgaactattagcttcagcaacctgctcttctgttctttttttttttttgagacagagtctcactcttgtcacccaggctggaatgcaatggcgtgatctcggctcactgcaaccactgcctccagggttccagtgattttcctacctcagcctcctgagcagctgggattataggcacctgtcaccatgcctggctaatttttttttgaatttttagtagagatggggtttcaccatgttggccaggctggtctcgaattcctgacctcaagtgattcacctgccttggcctcccaaaatgctgggattacaggcgtgagccaccgtaccccaccaacaacttactctcctgttcttgtttaaacacttgccataacttgatcttgaattccttcctgcagacatttagaacaaaaatcagtgtgaaatatttgtcaattacatctgaccttgtcaatcttgagcagctcaacaaatctcatgccagggtcctggctgatatttgaagatgtttgaggttccagtcatagactatgaaagaacatggtgcccgttaatgcttagttttccaaatacgtaaacagttctttgtatttgcatacattgctttacattttataaaatatgctgtaccacctcattggcttcttcaaataaccacagtgcattacagttataattttaaacatggataaaatagggtgcagccatattaaatccagtagttggaagtggccttttccagaatgttgcctaacatgtagggcatacttaataactattttttgaatggatacatattagtgcttggaagtaagaaacattgtattgttgttgttttaataatggttgtttttgcttatgacatagacaggtaggcaagatatattaactaggtttcaaaagagatttaaatcccaattctgttgttaacaacattgtgaccctgaaattctcttaactttttggcacacactttacttatttttggaaaaacaatctcggggaggaagtttgagtagatactgtgtaggatcattttcttttctaagtgtcctggatcttacatttcactgagtagaacgaagctttaattcaaacagttttgataaagatatagaaagacaatgcagtttgttttttgtttgtttgtttgttttgagactggatctctctctgttgcccaggctggagtgcagtggcaccatcacagctcactgcgacttccacctcttggacaggttcatgtcatcctcccgcctcagcctcctgggttgcttggactacaggtgcacaccaccacaaccggctaatttttttgtagagatggggtttcgccacgttgcccaggctggtcttgagttcctgagctcaagtgatccacctgcctcagcctcccaaagtgctgggattacaggtgtgagccacacaatgcaattttttattgggtttataaattaggctttcttgttcttcactaaactgtttacctaacaatatcacctggctgtggagcagttattcttagtgaaattaaaaatatttattgttcatctaaagctcccaggattacaatgctctgtcctggtatatgaaatatgtcagataatacagataatacagctttattgggaactcccatttatgttatttttgggagttctgctcatgggctttgtatttaaagtgcaacatattcacttaggtcttactgaaggagttaattatggaagagcaaatgagaatcttatcatttgattcacagttactcaaaattttatttatattatctattagacctcccttgagtgcctactatagacctgacactacatgaggccctcggaccttagagacaagctagacatggcccttgacctcaaggagttgcagtgaagaagtcacttctacatggtgcttgagatgatgtttaggaaaaccttcacagcagaaatgatatttgaactgtgtcttaacagatagataagggtattctaggcagcaaggaaaaaagtaattttggtacaagttgcagtgtgaacacagacatggatgcatgaaataattgtgaattttggcaaatggaaattgtccgtatgtcacatgcactagtgaataatgatgcatcgcaaagggaggaggtggtgaaagctggtggggaaaaacagtagaaggctgtgaaaaccgtgttttgttctttgtcaagtagacacttgggagccattgaagaatttgacttcaggagacacatggacagtgctaaattttggaaaacctctattggcaatgtagtgtggttgagagataatatttaggggatggtagacaaggagattttgagaagctgaacaaacatggtaaccctaggattggattaaagagatgatggaggcacatgttaaggaaagtcagtggaacccatttgttaattggaggtgaggtttaaggaaaagaaagtgtgatggtttattgtatgtgtcaacttgattagattaaggaatgtccatattgctgggaaaacattgtttctggatgtgtctatgagggtttctatgtaagagactaacgtttgaatcagtggactgagtaaaaaactgccctccccatgtgagtgggcatcctccaatccattgactgcctgcaaaaagggagaggaaggaaaagttctctctctctcttcttgagctgggacatccctctcttgtccttggacattggagcccctgctcctcaggcctttggacttacaccagggttccacaccctactgccccgcccctcctacccagttctcaggctttcagcctcatactgagaattacaccatggactcccttggttctgtttctcaggcatttggactcaagactgaattacacctcaggctttcctggtcctccagcttgcagatggcatattgtggcacttctcaacttctgtaatcacatgagtcaattcctataatcagtctcatctatctatctatctatctatctatctatctatctatctatctatctatctatcatctatctacctatctccatctatctatcgtctatctatctatctatctatctgtctgtctgtctgtctgtctgtctatccatccatcctattggttctggttctgtggagaaccctgaccagtataggaagagaaatggccaagattgtgatttgagtcactgggaaaagaggaggagaaggatgtcacatggaggaagttaatagttttagtgtcatacctcagttttgggttttccaggacatttcttcgggtagatctcatgggtagttgaacacaaaatttgcacagcacatagaaacttccagctcttcatattgatggaaccatactgagattctaaaaccttattatggaggaattaagaaggcaccaaggatagagtgttggactggacaggattgcaggagtacacaaagggaattgagtttactatttagagcccagactctcacgctatcagggaacatcttgggataaagtagtacctggaactaaaattcctgctttccagctaagtaaattcaatacagtttagaaaaggaaacggctgaaagatagaaaagaatatggtggaaagaccgaccttgattccagaactgctttggttttcttccttctgatctagaagtgggctgtggcttcccgctagccacaaagttactactttctgcattcatgtctctgtcctagtgatatcttacttcctgagggagtaagggcttgccttatctcaatcttgcttctggctccataagtgtacccagttattccataaagtctattccacactgtcctaaagccaggttcctctcagcttgcaagtggtcatggtttagaccactggctgacctgcctgatgttgcatgacttcccatgggttcacttctgctagtgtgaatttactggattatttcttacacctctcttttcggtctgggcctccttgggttggtttgtccatttctaactttatacccatggctctgcattctttagtcctataacactcataatctgcatagcttcttagtatttatcatatacgttattatgctattcttttttaaaaagcttttgccttttttcaaacacctattgtattagtccattttcacactgctgataaatacatacctgagactgggcaatttacaaaagaaagaattttaatagactcacagttccacatggctggagagtcctcacaatcatgacagaaggtgaaaggcatgtcttacatggcagcagatgagaagagagcttgtgcagggacccccctcccttataaaaccatcagatctcatgagacttattcactatcacaagaatagcacaggaaagacccgctgccatgattcaagtatctcccacagggtccctcccacaacatgtgggaattatgggagctacaattcaagttgaggatttgggttggggacatagccaaaccatatcagctgtgaagtcagagatgaggtattgcaattctgttatcactctcttccccagtcccctgcatatatagtatttgccaagtactagtgaaggtggagctgatctaagtgcagatctagggggataatttatttgtggtcccatctgaaacaggagtagtagcaagattcacttctgtattgattcatcaggtgcttttgagctcctaacatatgaacaggagagtgctgggcactgtggaagattcaaaactcgatcacataggaacacctgccttaaagaaagctgtggccaaacccatggattattagggctagaagtcatctgagaacatgataaaatttcacattattctcttatttttttaatttagtttcaaattaaaaccaaatttgtgttcatccttagtttagatgtgtaattaaagcaataactataggcttcaaacaacagttgcaagaaaaccccaaaaataaaaggacacatgtgtacacttgtgcttggagatggtaagcactcagccagtgacttacattttatcatgttgacatggcagaggtcagtagttacacaatgttataacacattaaagataagcctatctttactctgaatttcatcatcacaaagttgtaagtctgactaaaagagccaaggtaacattgaaagatatttttcagcatttccaaagatcattaagtcataaccttgattctagaatatgcttgttattggcaatgacatcttttagaatatttgctttagaaagctatttttgtttactaagattttgaaacacatttgctataggaggtgcagttgcctactaacctgagagataattaatttttgataaccttactgatctagttacactcacagtaaacatttttttggtaaaaaaaaaaaatacttttttttttttttaaataagtgactctgaaaaagtaacttggaaataaaatgcattttatttatttcttcttctttctttctttcttttttcttttttttgagacagagtttccctcttgttgcccaggctggagtgcaatggcagggtctcagcccactgcaacctccgtctcccaggttcaaaggattctcctgcatcagcctcccaaatagctgggattacaggcacccaccaccacgcccagctaatttttgtatttttaatagagacggggtttcaccatgttggccaggctggtctcgaactcctgacctcaggtgatctgcccgccttggcctcccaaagtgctgggattacaggcatgagtcactgtgcctggcccaggttcttcattttttttaagtcaagtcccaaaacaaatatgaaaaattacataaaagggagtttcctggccagagataaagtcaaagttgcatacaattaggtgtccattcattgattggtttatccatccatacattcattcatttatccgtctatccagttgtccttccatccatgtaccaacccactcattcctccatccatccatccatccatccatccatccacccacctactcatctttccatctacccactcactcatccttccattcatccacccacccacccactcatccttccacccatccatccacccagccacttatccttctatccctccatccacccactcatccatccatccatctgttcacccacccactcatccttccttccaccatccatgcatctacccacccatctatccatccatccatctatctatccacccacccactcatctttccatctacccactcactcatccttccaaccatccacctactcatccttccacccatccatccaccaacccacttatccttctatccacccacccacccactcatccatccatccatccatctattcactcattcatcctttcatctatcaactcatccatgcatccatccatctactcatccattcgtctctccatttatccatccattcgcccacccattcttccatctatccattcatccacccactcatccatccatccatctgtccacccacccactcatccttccatccatgcatccatgcctccacccacccacccactcatccatccatccgtccatccatttatccaccagcccactcatccttccttccttccacccatctacccacccactcgtccatccatccatccatccgtccatccgtccgtccgtccatccatccatccattctttcattagtgaatgaaaattctcggccaagagcagatattataacagagtgtcaggaattgtgttagtttctggaaataggaaagatgcttttttggatcaattgttctacaggtgggctttcagaggagtttctgtatatagcataaagagttcctcagtagaatttttgagacttgccatgtaattccacagaggcatttactaaatcttcctaaagtatctggattgcaagggttaatccactcactcgtttaagagtgtaactgaagatggtaactgcaaaaggcataaaatgagcctttttatgtcctactctaacaattttcacccctggtcagaggcatctgacccagtgaagccagaggctcctaagtaactgttggaatgatgtgttaacagtccatagctgccaaataggagacccatataaaaggccaagcttgaggtttggggctccctaagccaaacatgtgacacgagtaatgaggtgtttagcatttgaaagggactggcagccctcttctgggtaagtggaaggagaggcactggatcccattctttaggagctgtgcttctgtaaaacagaagttggaatccaaagccagtgaaatatgaattaaagaagatgagagctgcagaaattttatggagaacaaagataatttaatatttgaagtgagtggtggcttttgggaaaatgatgaaaattcattaaattgatagttcattaaattaacagatttgaatgtgtactggtatttgcccttttatttatttatttttagagatggagtcttgctctgttgcccagattggagtgcagtggtgcaatcacagcttgctgcagcttcaaactgctaggttcaagtaattgacccacctcagccttccaagtagctgggactataggtacacaccaccatgcccagctattttgttttaatttttatattttatagtgatagggtcctgctatgttacccaggctcatttatccttttaagatgagacatctatgtctatatttctgttccttttacaactttcaagaaagatacaagacgccctgtatcttccaaatgtgacagcaaatatgtcctaatataaggactaaataagatgataacttttagaaaattcagttttcagagtaaactttttacggatttgtaaaatcttcttgctcagcagtgtcggttctcacatgggtggttgggaaatactgttgactgatttccataggtatttttagggctgctggggtgagtttataaacttattcaactcgtcttattggaaactctcttttgattgctctcaaatgttttaaggaaacatttcatgatttttaaaaaatagatttaaggggtagaagtatagctttgttccatggatatattgattagtggtgaagtctgagctgttagtgtaaccatcacctgaatagagtacattgtacccaaaaggtaatttctcatccctcacccccctcccatcctcctacccttctgagtctccagtgtttattattctgttctctgtctatgtatactcattgttcagctcccacttataagtgagaacatgcagtattgtactttctgtttctgagtttttcgtttaaggtaatgacctccagttccatccatgttgctgcaaaagatatgacctcattcttttttatggccaagtacttttccgggtgtgtgtgtgtgtgtgtgtgtgtgtatcattttctttatccatcaatggatattttctttatccattgatggacacttaagttgattctatgactttgctattgtgaatagtgctgcgataaacttaagagtacagatgtctttttgatataatgatttgtttccctttgggtagatatccagtagtgggatttctggatagaatagcagttttaattttagattttttttatattgaaaattaaattaggccaggtgcggtggctcatgcctgtaatcccagcactttgggaggcctaggtgggcagatcacgtgaggtcaggagttctagaccagcctggccaacatggtgaaaccctatctctactaaaaaataaaaaaataaaaaatagccgggcatggtgacgggtgcctgcaatcccagatactctggaggctgaggcaggagaatcacttgaaccccggaggcagaggttgcagtgagctgacatctcaccattgcactccagcctgggcgacagagcgagactccgtctcaaaaaaaaaaaaaaaaaaaaaaaaaagaaaattaaattaactggttagttcaccatatctactagactttctttgtccagaatgatatttagttgcatcagaaagttaaatccaccgtaaaagattaaagggacaccattgatcatagtttttaaaatgtccttcagatgtaaggacactgaaggaggagagaatgcaaaaatgatggaagtaggggcagcgttattaaataagtaaaacgttaaagatgactacttggatggctgtgacggtactcaatgtgtaagattcagcgtgtttgccaaaaaaaatgatctgcctctttccttagagacacatattgtaaatgatttaatgtcttgggttgttttgatgtcatgctagggacataaacaacagcttttaagaggcaacaccctcactgcccatttgccaagattctaatctcagcctttcccattcctaaggtgctcaccaaactaccttgaacagcaccatgcactttcatgccattatcaattggggaacatcttccccagtcctacgccattatcagctgggagaaaacctacaatcagtgcttaaagaaaaaaatgcaaacatttgccagactggagaaatgtccatttaaatgttaccgaactaaactaattatggaatgttctaaccatcggatgctgacattccctacctcagcattatacaaataaagattatggttgtttaatatggtgccttgcagccaggtgtttagtattgcatttggtttcttggtatttggaatttttatggtcgtcattacagtaggaagtttcaagggaatcattttatggtatatattttacttcttactcattccttggcttccaactctacaagactcacttacctttacctttgtgaattacgtgcaaatattttcaaacccttctttgtgttctaattgtttttggcttccatatgctacagcagagccaagcagaatagaaaagtaagttttaaataaaaatcagaaactattggatttgccaaacgctttctccttcatttatttgggaaatagtcttgtattttgccaacatttgaaacaaaattctaatgacctttaatacatctccttttcatcacttggctaagtgttcaacatttttcatgtgcattcaaagagagggaaatgttttcattataaaagtggagttacttacatactctggtttctacactttcaaagagctgtaataacagattatggaattctgtaagtagaaaagccatggattctcctggtccattcagccagggtattcactgtgcacagactaaagtggggctaagatattcactgtgcacagactaaagtgggagagaggtggtgaaaagacggaaagagaacaacacaaaaatttaatttttaatctttggaaatttggatctcatagaagcaaagattgcagactatcatacttagaaacgatgtaatttttccaattcagccatctgccccattcacagacactctcaccaacagagtccttcattcaagaatacaggaactcactaccttctgagatggccacttccattttttaacagttttaacgttcctgtttgttctgaaataagatgcctctctggaattcttcttctctgtttcttgtgctgacctttccagcaatactgaatatttttaaaaggtttctgaatgaaacagcttctgatgttttgggtttatcattgtgcctccactctaggtttttcctccatttttccaaattcctctctgagtagagtgcttcccattctctcacaattaggtttatcttttggaacacctaccccgcttgccaatactcatgccaagaggcccagaactggatccagcaccctaggagaagtctaaagatgtagagtggattgggcgtacttttttcccttgatgttcatagttccataaggaagtcagaattgcagtagcttttgagacaatcattctactgttgaattatattgaacttacagtgatgtgtcttttcaggtaattttatataccactaccccatatctaggatttatggatttttttaaaccataaatttaagactttatatattttgctattatgttaaaaatatctatggaaaataccatgtttataaaaatctggtaaaaaaaaaaatagccagacttggtggctcacacctgtaatctgagcactttgggatgctgagtgggaggatcacttgaggccaggagttctagaccagccagggcaacatagatcccatctctaaaataaattttttaaaacatagccaggtgtggtggtgcatgcctatagtgccagctatgctggaggctgaggcaggaggattgattgcttgatcctgggagttcaaggctgtagtgagctgtgattctgccacacttcagcctgggtgacagagcaagaccctgactctcaaaaaaaaaaaaaaaggagaaacaaatagcataaaaaatagtatggtgttggccgggcacggctcatgcctgtaatcctagcactttgggaagctgaggcgggtggatcacgaggtcaggagttcaagatcagcctggccaagatggtgaaaccccgtctctactaaaaatacaaaaaaattagctgggcgtggtggtgggcgcctgtaatcccagctactcgggaggctgaggcagataattgcttaaaccctggaggcggaggatgcagtgagcggagattgcgccactgcactccagcctgggtgacagagtgaaactctgtctcaaaaaaataaacaaataaataaataaaatagtatggtgttggaggatggggataggcttctttatccttttgttgttatttttgggtctcttaatgttgatataatagttatgccctcacagtaagccttgaagccttgaagtcctcggcttattgcaatgcctattctagctgccaatattccagggagctcctgatttcatattcttgttagtcttcacctgatttcccctgtttcaggctctccctgcgttgtcttttcccttctgtttttcctcagtcggcacctgcaggtttttgcttctctgaggttcccattctcacaccaggtgttctctgcaaatataacccatctactgccaggagtgacttcagctacctcccacctgtggccagtgggactcatgtgtctagcagagcttcttctgggataaaacttaatgatggtctacttcacctgacttctgtgtgttctctccgtgtgaattagtaacctgagacaagaattccagtacaagtagtttatttgggatgggttcctggggaagagtggtgggggagtgggaactgagacactaaagagggtgcccaggagagtgtttggtattcagcaagttatccttctgggtaactagaggggaatcttccctgggaattctggaaggcagagtggaagataccccagaattagtctacctgagggcacaggggatggagcatttctgcagactcagcttgcatcagtcaccagctgagagctcttctgggtacactcattcctcagcaggtccactcaggtgttacgggcgctgacacggaactagcaacaagcagagaaattcagtgctggctgttcggtgaagctgagaaggaatgaatgggttctcacagcttgacctcctttcccatgtttatttatatctctttccaaatgtaatgaccttttgaaatatgtttatatgtgaggtctaagtttcctttcccctgtggatcctctagaaatttctggaaaattctgaagcttggggttagggcatgaattaaattccaaagacgtttctggaaagttctgcatcttggggatttgaattggattccaagaaaacttctgaaaatgtctgtgagtccagggtctgaatcttgtgcatgcacacattttgttttgtttcttaatctggtaattttgatgtgctagggaacttgacatgagtttctctgcccctggatggtgagcatttcgcgtcttctttgcttttaaattttgaattcattctctttcccatcacacacacacacacccacacccacacacagacacagacacacacacacacacacacacagcacagcacacccaacacttctcatgtgttggaaaaccttccctcctcctctctgattctgctgctctccctgcctcctttccatttcagtttccctacttcacagtatgtccttggacacatcctggggttagtggaaatgagaatgaagggaatgttgagcctggggagtttgagacactgtaagacagcaaggggtcaggaccagaagagcaggcagcgtgggctggacgcagcttctctgaatgaaaaccagcgagaactgcatcaacaacctggtggtggggacattgcagctgtttgctctggactccaccgcagcatcagagctcgaataatcatgaagctcaggtctgtacccagcccagcacaagctctgacgccagttgttcttttcagctttaacaaatccctatggacccctcctgtgaagacccatcctacagaacctcccatcacaaccctctttgcttgccattcatagtgtcccgcattctccaaacttgggcttcaatccttacgattccatttgaatggttttgtatggggagttaactagaacttctccataacaacatttaaatctttcctttctaatatatatagatatatatatcagaaaagatttaagatatatatatatatattctaagtgaacattgtcactttggggacttagattttatatatatattaacgtattaatataataaatatataattgtattactataataaatatataattatatttatatatgtatatattaatataagttaatacagtgtattaatatataaattaatacatgattaatataaatatataattatatatgtgtatgtatatatattatctaagtgaacattgtcacattgggggatactgcatggactcagtataaacaaccagagttgaatggtttgttgaaaaggaatgagctatgctttctccttcacactgtagcactacattcccacatctatcttaatctattcattatcaccacacatgcaaagtttaatgggaaacatttggagacatttggaggcaataagtataacagatatatatgagctaatagcatatgcaaaatgtccttcactacccaaactcttgttaattgaatacttgctatttcagctcatgaaacagaatatttgagataggattatttggagatataggattatatatatctatatgcctatctctctatacatatcagaaagaaaagatttaaatatatatcaggaaggaaagatttcaattttgttatgcagaagttctagtatacataagtttacatataaacttacgtatatgtaaacatgtatattttacatgtgttcatatacgtaagtttacatgtaaatgcttacttatagttagttaatttttatttattttattttatttcatttttagagacagggtctttctctgtcgcccaggctggagtgcattggtgcgattgtaggtcactgaagcttcgacctcctggtctcaagtgatcctcccacctcagcctctcatgcagctaggactacgggtatgtgccaccacacctgcctagtttttaaaattttttgtaggaatggagcctctctatgttgcccaggctggtgtcggacccaggccttaagcaatcctcccaccttggcctcccgaagtactgggattacaggtgtgagccatcacacctggcctatatttgtatattgatataaattatacatacataaaatatacatgtatatgtaagatacaaagatacaaatatcaaatataaatacatatattttatataaaaatatctgtttaaactactgaataaaagaatgctgcagggactcagtataaacaactagaattgaatggtttgttgaaaaggaatgagctgttgtttctccttcacactgtagcactgcattcgcacacctatcttaatctattcattatcaccacacatgcaaagtttaatggaaaacatttggagacattgcagtaagtataacagatatatataaacagcacatataaaatgtccctcactacccaagctcttattaactgaatacttgctatctaaactcatgaaacagaagttttgagataggattatttggagagtattttcaaatatattttcccttgcttaaataaaaactgagtatctgaccccaggaaccaagcagatttggaaaaaacaattctttcagcgtactttagagatggactttgggcataaacagtcatttcagaatataactttgtaaaactgtaagactttatcaaaggtaccagaacacaggtaatttgctacatagtgctgaagtgaaccagtttggtggaaagttataaagaatgcaacttcttcccatggacaagtacatataattgggttccatgaatagaacttcagtaccaaaggccccaagcatctgtaacataagccagcttctatctaataatgcagcatagtcacactcaataaaaggtgtttctgagatttaagaatcttgagaactgttactatacatttttatgaatactcacaagagagattctgccagaaaatgtttctaggagagaatttagcacatgatcgatgttggtttggcacaagcttttgtaggttatcgcaagtgtcttttacagatgttcctcctttctttgtctttaaatttgtatttggttttcaatgatttaggaagaattacattaattaggttataacaatcacagtcaagaggccactcactttaaaagcatccatttgatgccagtggcacttcaggggggaaatgttatttatattcttaaccgaccgtctttttgtttctgacaattgagcattgcctatcattgcactttcaggtgttttggttttacctccaacaaccagaacaacagacgcctacattataaggctttactcattttccttaattgaaaaaataggacactgttttaatccagtgaaaccatgaggattttatcccctacaatgagaagcacacctcagaatcgctatgctagtggctatggaagtgtgaacaaaatgctgttgcttctgactttggagtcgaataacgaagtgtctacaaatgaaaaccattgctgtttaaatacttggataacataagcctactgctggctctaaaaacgttaagtggattctattcttggggcaagcaaacagataggagagtggttaaccatctgtggactgatgattagtacagtgtgatttagaactagcatgggcattcctcttgtttgtgagccacagtttaaatccagttttgtttcatttcactgacctaaatggctacatctttttcagataaaatttcatcaagttttaaaagtgtcagctcagaaaacattcctacaatgtacaaatggagacatataaatgttaaatacagtatttttctttttcttgtattaaattaggcacctgaggaggcacattaatatttttggtcattagaagactatttacactgcaataaaaaaggggggagggaagcaagcatctttgttcatcccagtttattcagcatcataggaaaagtaactgaggcttcccacatgtgtgaattttaaaatgtgtagttattaaagtgtattcatccattttggcagaaaaaatatgtatacaatatataacccatctccttgcccctgcagtagaacctgtaaactttatttgcatgttggtcaattctatttaagcctataatacagaggtcatcctcaaggtagactgggctgcatacgactatttgcctttgtattaatggtcctcaaataccttgtttgttgattactggttttattttatggttttcctgtttcctgtttcactttcagtcttgagactgctatgttcttgcagctgatggaagctgcaagcccctgtgagttgccaacattgtttgtttcactatgtaactgatattgaatttaatcgggaatcttgcagcgtatctgggaacgtcaccacacccatttttaggaaatctttggtttaaaaggtagaaaccttgcttcctcaataaatcccaaagtaacagtcagaattgggacgtgagagggtctcaccaaggttcctgtgctggcacggagaaggcagagggttcctgtgttctccaagctgtgaacaccaggaggagtgattcctccaagtttgaagggtcatgaggacatgacttgcttttctaaatacccctgggtggacccaagtctgaatcccaaggctactgagtcaattagcattatgcaacaggaagacacagatagcagcagcttgaacaagtaaaagttcatctgaactcataaagtctggaggaggcagtatagggaagatacggtggcctcattaactcatcaaggagccgggcttcttccgggtctccactccactgtatcccatgtgctaagaggggctgttgtagcactaaccttcacatacacactcagcaaagcagaatagaaagagaaaaagcaggaggaggccatccctcctaaccctctcacgctactatccagaagtaacacttgctttcacccattgaccagaacttaatcagacagccactctgtttgcaagggaggctatgaaatattatgtgcatatagggattccgttactaaaatttagggcaaaattactagaagcctttgccatgtgggtctctgtaatggctttcgtgaagggcggaggcaccaagaattgatatgggtttcagtctgtccttgcaggctccagcccctgatctctcccatgtcatgttcctcttcccttcctgaatttctgccctctggatgtctagcttcagcatcaaacacaaaaacaacatcaaagccttacagagactgctcaaccagctccacaagtgtgcaaatcagagctctgtcataaagacctctaactgtatgtataagtatctaataactgtgaatagatataaataggtagatgtatatctgatattgattaatcaatttgtctacctctaggcatatatgcatatatttatgtgtactatattggataagaaaatatatatgcttgtgtctgtgtgtgttcatatgtgtgtgtgtatgtgatgtagatatagactatatagaagacatatagatagattgatatgtcttatatatatgagatatataaaatactgatatctatatatcatatatttctgtgaatctatatatctatatacctgtagatatgtagatatatttacatgatatatatactcaatcagtatactattgatataaatagcatatatataatcatatctatctatccatctatctatatctcctgtagatctagatttaaatatagatataggtatcaatactgtatattcagtattgatattgtagtggtatgtttctatggtggaaccctgactgataaactctccctctaacagctatctgacacccactttttttgttactatgtaagtcccagaatgtaagctctagaaacttaagagaaccttgggaaaataggatgaatgtacccccactaccctcctgcacacaaaaaattgaagctaacccattctatcacctccatgaaatataggaataaatatgaaattaaattatgtaaaataatggtgattcaattacctacacccttgtgtttgtgaattaagatatatctttgcaataatatttccatcttctctccaatgtcagatctttccttttttttttttttgtggggggggacagggtctcactctgtcacccaggctggagtgcagtggcgagatatcagctcactacaagctccgcctcccgggttcaagcgattctcctgcctccacctcctgagtagctgggattacaggcatgtgtgccaccatgcctgactaatttttgtatttttagtagagatggagttttgctatgtttgccaggctggtctctaatgcctgacctcaggtgatccgcccgccttggcctctcaaagtgctaggattacaggcctgagccaccatgcccagcctcgtgtcaaatcttagtagctcagtagaatagtaaggtaagatcaattcttcacatcaatacttaaatacttctcagattaaggactgtgtcttagaatttgagacctcaaaaataccttgtaataactatttctaaaagtccctaaattgtccaggttaagtgttgttttataaaaatatgtgtttgaaagaaaaaaaaagggatttctaatcttttaaaattttcatacagaagaaaaggtgaattcaaggtacatatgttatcaggttttttaaaaaattaaaaaataaaaataatttgtgtttgaggcaaaataatggattgagaaacagtaaaatgtcttaaagaatcatttacaaaattaagactaaattgagggagctttaatgattatggggaatcacataaaagttttcaaaatgtacatgaagctttggaaatgatgtttattgaattaaattgactataggaaaaggaaacctagagataacattctggaaatatgttctgcaatttctgtatttcataaatgaattaactctaaggcaattatgaggaagatgagataaatagtatttttcctctctttatctctttcatccttttttccttctctaagttatagcacctcaagcagagcctcttaaagacaaaggcttcccaaatgctgaaatacttataaagtctgatgggtttgtcttctgacgtttgggatttctttttattttgctttctatagaaaactcaacagtccaaaggccagaataggacgtcttctatcaaactctcaggttttcctgtcttccctcagtatcaaggcatagctttcactaacatttgcaaaagacatccatttaactaaggctgttgattacccaagtgtggcagttgtcagaaaatacttactacataacactagaatcactggaaaccgaattggagttaaataaggtggattaacatagctaatgtgttcaaagaaacatagaattttactctactgcttagacaccaaatttatctgtgaattttgtaaatagacttaattttttataaaatgacctaaactctatacatagtatgtgaataatgggagtttgttatttaatatttaaatgtctactatgaagacagcttttggatgttagccccttaaacaccctaaatagtcccttgttaaaagtaaaaatctgagtctcagacaagtttagacactttcaaagaccaagttggatgctttatgaagacaggaagggatgtcagctaatcagagtgcgagtaaacaagtgaaactatggctaagctattcccgagtgagaactccccatgagaggaaattaaggaattcccctgcttctatgtgaaatgctgctatgtagtgcacggcacaccagtatgccataagatttgttaaagcccattgttgtgctggggaattgtggggccacttacatatgtggcagggtaattagtaatagctaatttattactgatgccagtcagttaatctgggattaattcagaaccatacattttaattattctttgttaaaagtgtatagttatgagtaataacttgggttttaattttctaccccctttctgcaaataaaacctgatgatttgaacacagatatctttcttcagttttcacattattatcctgtcttaatcaagcttaacttgattaaatcaagtattatttgaaatacacacacacacacacacacatatgtacacaatgcaatggaagatacttaaattgtataggctgtggtttgtgataattctaatgatttcatttatgactaagttgatggtatttcagtgcagaggtcagcacgcatcccattgttgttgagtgtgtttggtctatgtgtgtgtgtgtttgtgtgtatgtttctgagtttctcttgagtttgcagtccaatatatggatccatgctgcaaatgcatgagcccattctctcctttgtctgctttctcctgtcaaacctaagaagtctccagggtggttgtgaagccattcactgagcgccagtcatgggccactgcacccattgagccggttgcctgctcagcaggcaccactctggctcagaatacggggtgacaggtgtgtggttgagcaggcttcctcattaggtcctgcaaggacagtgcccctttatcgacagcccttatcagagagggatcagtaaacaggcagatcccgtggctgagctgggcagcattaaaggctccattgggagaggaccgatgacacctgccctcttctacaaagagctcttcttgcgaaggtgacaaaaggattgcatttcaggggaatgaaggcctatagggatgtctttcatccctcccaagcattctctcctgacacattcagcagttcttgactattgagaggaaaccattgaaaatcatgaaagagcaaagggccccaaggcctccttctgtcctgtcctgcctttactgatgagaccttctaagtttccactgctgactcacttgcagtacccatgttctccttaggaggctgcattgaggagaggaaaagtggaaaagggttagttcacagcccattgaaggaacaataaacccatccacagacaactagattgagccctgcacataatatgatacctgctctaatttggtacacagtgagtacagtcccttatcccaaactagaaagagcagaatcagaaagggcgcagggccaagtcataaggtgaaaagaatgtaatacacaggttaaaatgaataagtctaactagattgccaaaaacaatctggaccacttaagcttctgcgtttgataatgatatatggttaatctggcagttttgtccacatattgtggcaaaatgtgcaattcctatagtgaagctaagtgagatggttaacttaatgactgtcactattcagaggtgtcatttattagcttctgaactcttagatgttggagaacacaatttgcaaaacaagatattgagttgatggatgaaagtgaacctgaagaaaatagtctagaaaggctatattcatttagtttctttttacttttgattttcataagttctcatagttgaggatggaaaattaaaaacacatgacattggtaacaatacacagttgttgtacagcaccaaaatattgtagcataccagctgtaacagcagtatgaagccagagctgcttcaaggagtagggctttgatagattatttttcttagattatttttcttctcacataacaagaactcgggatgtaggtagcctgaggctgctttgctgatcatgacttagggccttagaactttcctactctgccactgggaattcttgcatgatgactcctgtacctccgagcttaggtataagatgtaggcaggtagaaactgggtctcaagaaaaaagacacacatctgcaggtctgccttcatcttcctatggctacccccagctgcaaggaaatctgggaagctgcatattttaattggatacattgtcatcctcaacgtcatggttgtgaaataaggaggaaggggagggtggctgttgggtggcatactaaattcaagtgcattcaagtactatagagggtagtgccataggatttcaataggaggacaggagagtgttcacctaatcagaaatgacaccctcatggaggtggaacttaaagggctttgaaatatgtttagagcttctggaaacaaaacgatttttcagagcagatgtaatggggactaacgtgagagacaggaaattgccttataccaaaggcatgaggcaacctgtcttcccagtataaaaaggaaggattggcattataatgaggagaaagctgtcactggaatggaaggtacattaagggaatcacagggaaattataagagcccttgaaagacaagcagaggttcagggctggagagaagaggaaatgaaataagttctcattcaagcttccggcatgagtaggtggggtaaggcggcagcatctctagacacaggaaaaatgaatagtctgttcagaaaaattggaaagaatcaatcaaagggatattagaatatcttgcaccttactagataatagagcaagtttgtgctcacggaagaaaaaggaaatagaactatcaaagatagtcacacattctacgtttcctagcagcccagcagaattgtagtgtggccaagaatgttggaaagaagcagcacatttttaggaaagaggatggttccatttgcgatgcactcaagtagacagagtcaagcagcctaggaactgaggatctaggagcagcacacaggggaggcctgaggtctgcaggtatttggatgggatttattactattattatcattgtaggttgttttctgattacctagacatttttatttgtttatttgtgatacataatgtacatatttatggggtgtatgtgttattttgatacatgcatagaatgtgtaataatcaaatcagggtatttaggatattcgtcaccttggaaatttgtcattttttaatgctgcaaacatttcagatctgctcttctagctattttgacacacacagtagattattgttacctatacttaccctgctatggaggttgctgtcgcagaagggactggatttatttgtaaagggatgaagatggagaaccatagagaaaaccagaaacagagcctcatagacactcagcattaaggaataaggtagtgaggagagagagccatgatgccaggtcagcaacacacagcaagaatgtgctaccagaggtgctgtcttcgtctgttttcacattgctgataaagacatacccaagactgggtaatttataaagaaaacgaggtttaatggactcacagttccatgtggctgggggctggggaggcttcacaatcatggcagaaggtgaaaggcatgtcttacatggtggcaggcaagagagagcatgtgccggggaactcccctttataaaaccatcagctcttgtgagacttattcactatcatgagaacagaatgcgaaaaacccgcctccatgattcaattacattccactgggtccctcccattacatgtgggaactgtgggagttacaattcaagataagatttggatggggacacagccaaaccgtatcagatgccaagaaagcgaaagcacagggtgggcggccaacagagctgaaagagaatgaagaggaaatggcaggaacaggctgctagatctgagcatggagcttatcctcagccctggggaactggtgccagtgggtaagagatggagccatgctgcaggcgtctgaagagggaggtgtgggagggaaggagaggtaacaggctcaggacaagaaaacagaaaacgtgcagcccagctgggagaagtggtaaggcggcagttctttttgttttgcttttcccttaaggcaaaggtgatctgaacacacctgaagacagacaaaaagacctgcacagagaaactgaatagacatttagagaaatgtacaatttctccacatttcctaccagccaggcagatgggtgatgttttgcatgtatgaattatagtgccagccctatggagcagacagttcttactgcacttttttaaaaagtaaagatgattttccccctaaagacaggacactatatatttttcagaaatatgtttttgatattaaaaaaattcttactgaagattttcatggtttttcctgtgtgcataaattaggagtaataccttgtaaactagaaatatggcatcatttaaaaatgtgagcaattcatgaatacgtatttaagcgaggcaaaactcactgtgagcatgcccattcctttttacccccagttgcatgcatgagtatcatagtgcaattagttttcccactgagaaatgcaattcttcatagatactgtctaatgccatggaggcaggtcaggaatgggcagtatttgagggtgtttagcagcacaagcatgtccagcagggtgtatttgtgtgaagtgtttctacatacagagaacgaagcaagtactttatcattttcagaagctttatttttgcttattagttttattgagacagggtcttgctctgttggccagggtagagtgtagtggtgtgatcacagttcattgtagcctcaacttcctaggctcaggtgactctcccacctcagcctcctgagtagctgggactgcaggtgcatgccaccatgcccagctaactttttgtattttttgtagaaatggggctttaccatgttgctcaggctcattttcagaagcattgtgaagggaaagggaacatgtgaaatgggagaagttaccttatcccctttgcagggcgtgggacagaggtgtagcttgcttcttcagtgccccgactctcaaaccccttgggagagcatgcagacaggcaggtccagaggtcatggggagcatttttgggctccgaccccatggcagcatctaggggtgagtgtttacaacttctgaagcccaagtgggtgtgtgttacagtgtgctctttcaacattgccatctgcaggcggcttgtgttaatcaactcaattagaccccctgccttattgcaagggcagagggctttctctgtcctggatttttgccctagtgtaccgaaaaaaattggatcactggtgggcttggaggatgagtgcaaggtgttattgagtggtggatgtggctctcagcaagatggatggggagccagaaaggggatggagtgggaaggtggtcttcccctggagtcgagctgcccattagctggactctcccctgactgcccccagctgatttccccttggcatccatgtccttccaccatccctggcctaccagtgtctgctagtgtgtttttctgctcctctcgatgtccagctgcttgtgtatgtgcctgctaaggtctcttgggtttatatgggtataggatgggggacatggcgggccagagcggtcttggaaaatgccacatttgggcgtgaaaactggagtacctgttcccacttaggcctgagggcacagacctgaggatggagccatcaccagggacactgccttctctacccagcacttccctgccccctcccatattagatgtacccaaatattcatgtttttaaatatttttagctcttaagcatgtatactgtggttcaccattaccaattaaatggaaaagaataactgaatcacttaattgttctgtttaattggggccaaatcatacttctggattttttttgttgttgaagcatccttcatgttgactttgcaagcagcatttttatttcacagaactgtaacacataaacttgactgtgaagtggcatcaaacctagatgagaatataagatgtatagaggtctagactagaacaaacaaacaaacaaacaaacaagcaacaacaacaaatcccaagctccaagactgtaattcaaatgaaaacaaataaaagctgaagaggatctaaacttcatcagaaaaaagaatcaggacctgaaacatacatttgagtttctgcttcatcactaaaggaatttagattttaggatttcatgtatcttctggggacccttagtgctttttatctgtaaaataatgagctggaggagatgatctataaaatcacttcgaagcagccctagaattatgtgatgctatgaaaataaagccatcacttgttgaatgctgcctttggcaagctgtgtagacataagagaaagatgtcagtctgatggatgagaatattaactggtagatctgcagccttgatctctgtgaaacaagttcatatatgtaagcaactagaacattatttctggtttcaacttagaaccatcacacagctgactggacacagaacatttgggaatcaaaatctctgcccattttccagctatcttaatgagcagttacatttgatcccattgagcctataaattgcttcgatttggtcatagtcctaaaaactcaaactagatatatctaaatgtttaattcactcacaattcaaatatattgacattgccttctgtaatgaaaggccatgttgtttgatagtataaacttatgaaagaaacttacctaatagcaaggcatgtttgtgtaaattcagaaaaaggaaagttaaggggtgaccgtgctgtcattttacatgaagatgtatcttgttcccgggtcaggagagaccaataccacgtttgctccttcaaatagaaatgaggcctgtttggcaacttgatgtgagtgctcttcttaacctggttgttgtgttcttgctgtttgtatctcagcagcagtgggcagctggagcctcctgggagaggatttctccttagcaatctctgaagttatacttgggacactttaaaataggcatgaggttaacaaaggaaaatagctataatgttctggtaactagctgaagcatatgtgtttatgtccacatgcagcttatgttgagcaaaagtctcttgcacatttttaaggaatttacaaatggctcagccaggtttgatttgcagaatattctgcttgttgtacaccacactctgaattctatggtgactatttttttcactgtgatatttcagttcttaaccatgtgtctagcacattagacctgtggtaagtatcaataaaagggaaaggggaagagagaaagaataccactttcatgtgtctagtcctctatatagccaaccccttttctgggacctatacatgtccacgtcccaccatgaccattccatttctccctttgttatttcaggcagatgtaataatttctgagaagtatccatctccattgctgttcaggccctacagtccagactcttccctcattgcatatccatggctctgttgtattctgattagcacctgcacaaaaatatgcaatgcagaacgtaaacaggggtgaccatccatgtgtgcagaatcagaaactccagctacctgctgcagcaagggagtagcttcttctctctgtgctctgttagaaggtggaagcagaggctgagattagggagatgaaggatttatagagcacccttcctgttcaatgggaagaagcaacatagaggttgaatgcctcctgaaaaagcatttcctcatcatatttaaaaaatatatatgttacagcgttgtttgtgatgtcatcccattgcaaattgtcctctcttttcaaccccagtgggttttatgagcagcaaccagggacacctttgttgttatttttgaagaaaaaatgtagggagtggattttcagtgctcagatgatgcatggtttgcattcttaatagatattagagcttttaacattcaaatgcactgaagaatggaggcaaagaccttatcagaataatatatgtcttatgtgcttttaaacatgacaagttttttttttatcatggggagaagaaaaaaaagatgtatttcttaaacaagataataggtgccatgtggttcatttcctccttagcttcgcaagtctccagtaatgatggacaggtagcttgtcaaaaaaagcctaatcagtttaatgtaaccaaggcagtctaccctacaggatgacctctgctgcgtccatgaagaatataaatttctttggggttgggagaaaataaaaatacaaataaccatagcaaggcttagaatatcttatgagagtcaccctttcgtgaagcaattgctttctcttgtactggaaattgacatgaaatttagggctaagtgcaaatgcctgtggtgtgcagatctctgcaaatataagcctgaccggaaggacaaattagatattttttaaggtagcagctgaagctggtggatcagagcaatgcacacagacaggtagggacgggtaaaacttaagaacctacagctaagacaggggtacgctgtgtttattttgactgcagctgttgaccaccatacacacattcagaagtactgccaactccttaaaaagtctgggaatgtggccaaagactattcctgtcttggcacagataggtgattgcttgggaaaatatcagaaaaagtcacctccaacatgtaccctgttgggggccttgtgatatacaggagagctggagggggggccatgctcctgatgggtgctaaccgatggatactgtgctggtgccaggaagctcctcccaatctgggactcacctaatttatatccatcaggaacagagtaggacaaatgccctataacgcagaactccaaaccacacactttattttcctttcctgtatagcgtttacccatgagggcttcttttgagcctgtcttgaaaaaaaataaaaattcaagataaatgtatatttatttttaaaaatatctaaaatgccattctaaggcctactcttaatattttggaagaaggctttctctgtgctagtccatgtaatagactcttttaaatcctgattattcttgaattttgagaacatcagacaccaactttatgtggcagtgaagtctttccaaaatatatctctatatatctacacacacacgtgtgtgtgcatgtgtgtatgtgtgtgtataatggtagcaatgttaatatagaaggaaaagaaggagaaaaaccacatggttatcttggtgtatatttaaaaagcataagataaaattcaacatacatcatgatagcaactttttgttaattataaatgtcagaggcttgttttattaattgaaaattgtttgttgatgtctcttatcaatttattgagacatcataaaaaatagaaggaacccacagttctaaactatttctactaaatatattctaaaagaacatgatagcttgtaaacccagtgttgtaggaaacaagaaagaatatgcatatgtgagtctaacagacctgggaaaaatagaatatatacaaaagcgttgagacttaacaatgttcaataaacactcatttaccttatctatctctattcctatctatctatctacctacctacctacctacctatctagctacttatactgtaatgagccacataaccagattttggtcaatgatggaccacatatttgatagtggtcccataaggttataatgaagctgaaaaattccattttcaatgtccattgcttggtgacattgtggctgtcttagtgctgtagcacagtgtattcttcatgtgtttgtagtgatgcaaacaaacctattgcatgtaaacaaactgaatggtataaacaaacctactgcattgccagtcatgtaaaagtatagaacatattattatgtacaggccataatatttgataatactatgttattggttttgtattcattatactctgcttttaatctttatttgatagaatattccatacacttttctgaaagttaactgtaaaacagcctctggcgggtccttcaggaagtatccagaagaaggcattattatcataggggatggcagttccatgcgtgattattgccccagaagaccttccagtggaataagatgtgaagttggaagacagtgatattggtgatcccagccccatgtagagctagcctaaagtgtgtgtttgtgtcttcatttttaattaaaaagtttaaaagtagtatatattacactgtaccatctgggtttgtgtaagtacactctgtaattttcacacaaggacaaaattgcctagggacatatttctcagaatgtatccccgtcattaagtgatgcatgactctttgtggcatttctgaagatacaatatgttgttaaaaccaaccctcaaaacagaggcagtgtcatattttatttaatttttaattttttaatttttaatttttgagggtgcatactcagtatatatatttatggggtacgtgagatgttttgatataggcatgcaatgtgtaatactcacatcatggagaatgtagtatcatcccctcaagcatttgtcctttgtgtgatgaacaatccagttatattcttttacttattttaaatgtacagttcagttattattgactacagtcaacctgttgtgctatcaaatagtaggtcttattcatttttctattcttttgtacccattatccatccccgcttccccctgaccccgcacagtcatattttaatgtcagctggaagttatccttgaattccacaactatttaaggagtatctatttgaacaaagctcatagcagaggttaccaaatattacccccaattatcaaagaattacagtgcacacatttcctaaagttatgcatccagaaagcaacccagattttgtcattgtttttccttgttttgtttttttttttttacataaatgtagtttcttttttaatgaacaattgaacaaactagactgaattaaggcaagtataagtgttacataaaagatggtatcattgttttggaggaaaatccatgccctaatcagtctcaaacgtgagtcaaatcactatggttttcaataaagacagagtcaggatttttttctcactgaatatgtttgtttgttttgtgttagtgttctatttcacctgtgttgagcagcatgctgtatttttccccacgtggcatgatactcctgctgtgtgtaaagacatccaagagaacaacataactctaagtgtttctgtctccagaggggcaaaggtttcagctaaattaatctcttaaaggttgctttgggaaagtgagcatgcctttttaatctgcatgccctgaactctgagttaaggacttccaaacagcttctttgtgacagtcaagagggagtgtagctttgattcctcactggagtagagagcgaagggagagacccgaggaggcttgttacaagctgctgtgaggtgagggtcagctgggtctccctaacaaggtgactgccacgtttccaacaggggtccatcaatgccaaagtccaatcagagctgctcagccttttaggaatgccttttagattttttattttaaaaagaacttttgtattaaagggacttgacattccccaggtagcttataattcaagacagtttgatccgtgagatcattgtgcgttctttaatggagttcagtgaagcataacctgggagaaaagatgataaaaatcacagctggctttactcaaattcagggctggcatgactactttcaggagagtgcaaaaaaaatttttttaatttaattttgaaaattggcctggtgagatgtttatttcattgaataagttgtgttccagaaagtaccatgaagggatcaaatattaacttactgcaatacagtaattatctcctattaacagaaagcattctgaggaaatgtgcaacagtttgttctctgtatatgcccctccttctgcacctgggctcgggaaacgatggcctgtgggccacatctagcatgccgcctgtttatgtgaataaagctttattggaacccagccatggccattcatagacaagctgtctagaacctcttttggatcacaaccgcagagttaagtaatagtgagagagactctggtccacaaagcctgaagcatttattaccgagttctttatagaaaagtttgctgacatctgaaggaccttcatactagccaggatcccgattgagttgtctcttctgttgagttccttcttggcagaatcccgcctggtatctctttcccaaaataccttttattagcctcatgtggctatggagtccttgaaatgtggctaacattactaaagaatggagttttaaaattctatttagttttaaataatttaaatgtaaataggtacatgtggttagtggcaaccatattgagttaatgaaattgtgctttggttgcaccacaaaccaaggaacaaagaagtctggcagtctctgatcacatcgtgattatttgttttctaaatgttttattgtgaaataaaatacacacacactacacaatgtacagaaacacaattataccatttttattcaatgtgtatcagattatttaagatttctattttttgaatttgtcttaatgtttttaaagaaatgtgtataatttaaattttgaaatttttgacgtaatgtagtcacgttccccagtttatttctagtgtcaattatgtgagctctgttttttctttattgctgaatccccttttctgatgcttatcaattttatctctctttgaaaataatcagtgtttagttctcttctgctctattttatttctttgttctctctttgagtcatttccttgagtttattctatttctttaactggttggtttgaattcatagcacaaaaatctttaatgatttttccctaatatatgcattttagactgaaatttctgcttctttttctttgatattatcagcttaactagcatgtaatgtggctttcttttaattatccagcttgaaataggttgatctctctgattctatcaatttatcagtttcataaacctggaaaattctcaaccattttatctttgaatattgtgtgttgtgcattctctttttaaaaatctccttatatttcattcaaatatattttgcactttctcattcaatagattaaatatcaaacgtttctctaatttttctacatttttgttgctctatagttattcagtgttatttctacatatctatattataaaccactaatatcctctaaggctatcttaatctacctttaaacattccattgatttttacatatcaattatctttttttttccattttaaaagttcatgctggtactctttcgaaaatttgcctggtcatttttttggtatattgcttcttactcatgtctcaaattccctctatcgttgtttagacatttaataatacttattttatattctgtatctgatgattctagtgcatgatagctttgttcatttctaatgactatcacacatggcaggtagaagtcgtgcgttttgtaactttttcatggtattttgttttccatttggatctatctctctggaattactaggaggcttggattgggccaatttcccccagggacagttatgtttgctgcagataccttggaacatttcagagttgacacccctttcaacacaatttcttcttgatgcttctgtggccattcggagagttttctggccactcccccttggggcctgcttgtcagttgctttccaggcaaagcatgatgtttatttgttcaaaatcctgtgtgattgctgtgtcccagactcaggcactgtgggcacacagactccagggaaagcagcttggggccagagctggagtttcttctgctcattgtcactcctgtcacttagtggcagagtaacttggggtaacccttggagtctcatttccctcttctgtaaaaataaagaaatgattcctacgttatcataatgtggcgatatcaaaatagaataatttgcaaaaatgctttcgtggtgttataataagtacgcaagacatgataatgtctcccagtgtttatgtgaatattggcatgatttttatgtcagtgattatgactgttatcattaaaagacatggcagttgtctgtggagatgacagaatggggaagaatatattaaaaagaaaataaaattcaatagcatattagatgaagcttttgtactatgtactggggtagacagcaaagggattaatttatgacattggaacccattaaacatcttctttcctcccagcagaaacattttgttatcacccaactttgacatgtgttaatccataacttgctcatcctcagtaactaaataatttagtaaactaggttgatcaagctatttaaccttgtgtttcaaagagatattaaaaagttaatgacatagaagaggaaagacaaaacggtttattaacagaataattaagcatgctaaaattcttatgtaaaaatgcatgagaaaatacccaaatttgtcttttgcgtgtaccaaataatatagcatcaaaaactgattaaaaaatcaagagtaaacaaatgacataaatagtttgaacacacatgtgtaaaaacaatcagatcaccccacctctctcgcatgctctctctgtctctctctcacacacacacacatacacacacacagtcttacactgtctttgatataacatgaactcaaagagacatatgcaccaaagttcaatgtttatttttttcactttttttgtgaaggggaaaaaaataaacagaaaaaaacctcaaattcctattaatggataagtggtaaacttgacgtgtgttcattgttacaatatagcagtcgaaagcatatgaaaaaaagctcaacattactaatcattagagaaatacaaatcaaaaccacaatgagataccatctcacactagtcagaatggctattgttaaaaagtaaaaaaatagcagatgctggcaagattgtggagaaaaaggaacacgtatacacttctgatgggagtgtaaattatttaattcaaccattgtgaaaagcagtgtggtaattcctcaaaacccaaaaacagaataccatttgacccagcaatctcattaactgggtatatacccaaaggaatataaattgttctcttataaacacacatgcacacatatgttcattgcagcactatgcacaacagcaaagacatggaatcaacttaaatgcccatcagtggaagattgaattaaaaaaatgtggcatacatacaccatgggatactatgcagccataaaaaagaatgagatcatgttctttgcagggacgtgaatggagctagaggccattatccttagcaaactaacagaggagcagaaagccaagtaccacatgttctcacttataagtgggagctgaatgatgagaacacatggacacataaaggggaacaacacacacactaggacctttcagagggtggagggtgggaggagggagagtatcaggaaaaataactaatagacaccaggcttaatacctgggtgatgaaataatctatacaacaaatcctcatgacacacgtttacctatgtaacagacctgcacatgtacccctgaacttaaaattaaactaaaaaacaaacaaaaaaccagtataacagttgaaatgaggaaagacctgaagagcatcacgtagagggataaaatgcaagttgcaagacagtatctgctgtctaccggttatgaggtatattcaaaactgcagagagcattatagtgttcctggcaattattatttaagaaaacattacttcaaagaagtgattggttatatattacacgtttgatagtagtcacaactggagaaagagaagtagtaatgagacatgagatgttatcacaaatgacttcatctttacatgtttaatggtgttttaaaatatccaaaacaaacgtgactgtgctgttgttattttggggtaacatgtacatgaacttttgtcttaatgtgttttatacttttatgttttcttttatttaaaaatcataaagcagatgaacaataaatttagaatagactcctagagctaggtgcagtggctaccagtgcatctgtagtaccagctacttgggaggctgaggtgggagaacttggtgagcccaggaggtcaaggctgcagtcagctataatcacacgactgtactccagcttgggtgacagaacgagatcctgtctcaaaaataaattaaataaaataaaaggtagaattaacttagatttcaattaatgcatttctgtttatttttttgccttattttgtaaatgtctataaatacaaaaatgagagctgggtgttgtggctaatacctgtaatcccagcaactcaggaggctgaggcgggaggattgcttgaggccatgagttcaagaccaggctgggcaatatagcaggacccccatctctaaaaaaaaggaaattagaaaaaaataaataacctccagaagataatgttatttagaggaacagccccattgttctatgagagaaaatcgtttcaatttgtttagacaatttggctttctttctctttctttctttctctctgtctgtctttctttctctctgtctgtctgtctctctctctctctctctccctccttttcttttctttcttttcttttcttcacagggccttgctctgttgcccaggctgaagtgcagtgttgccaatcacagctcactgcaacctccacctccccagctgaagcaatcctcctacctcagcctctcaaatagctgagactgtaggcatgcaccaccatgcttggctaatttttgtattttttggagagatgggtttcaccatgttgcccaggctggccttgaactcatggactcaagtgagctgcctgctgtggcctcccaaagtgctgggattacaggcgcaagttactgcgcccagcctagactgactgattgactttctttccttccttccttccttccttccttccttccttccttccttccttccttccttccttccttccttccttttctttctttcattcttttctttctttctttcttctttctttcgagatggagtctcgctctgtcgcccaggctggagcgcagtggtgtgatctcggctcactgcaagctctgcctcctaggttcatgccattctcctgcctcagcctcccgagtagctgggactacaggcgcccaccaccacgcccggctaattttttgtatttttagtagagacagggtttcaccgtgttagccaggatggcctcaatctcctgacctcgtgatccgcctgcctcggcctcccaaagtgctgggattacaggcatgagccaccacgcccagcctagactttatttttaataatctagagagaatatatatcttctcattcccataccatgtaaatataatcaaagcacaactaattgaattgtacaggtgactttttttgctgtaaaggaattgaaccatcagaaattttccggcatatagattagcagcatgggaccctgagtgtggttccagactagcaggctctagcagcattcgcagagtcgcaggcatctgctcaatgcgctttgttcctatggcctgccgtgatgtgcatgcagtcagaaaggaatgggcacctgggaatacaattctccatccctctttacaacgaataatcactcagaattttcaccaaaaagtaggcagtgttattctaatataaaatatctcttcagagcaataggacttgaatattaagaaaggagtagaactttaacaacattagtatcatgaaaaacttaaactgggccaggcactatggctcacgcctataatcccaggactttggtaggccaaggtgggtggatcactttagctcatcagtttgaggccagcctgggcaacatgatgaaaccttgtctctgcaaaaaatacaaaaattagccagacatggtggtgcatgcctgtaattgcagctagttgagaggctgaagtgggaagattgcttgaccccaggaggaggaggttccagtaagctgagattgcaccattgcactccggcctgggcaacagagccagaccttgtctccaaaaaaaaaaaaaaaaagaaagaaagaaagaaagaaaaagaaaaatttcaactgaaaaaaaagtttaaattagctttgttttgagatattgcaaattgtcatatgatgatgatattgtgtccaggataatcccttgattttcttagttctctttttattaggaagaatgatcaccagcaacatataatgtacaaaataaagtacactcctttagtcatttacacatttatttcattgcagttgacatttaatgcataaggctatttcattccttggggtcttgctcctgaacctccatctgcctagagcgatttaaccacatgttgtctatttactcaagagtcatctcctctctgctgagttcaggtgccctactccacccccagttacaatggaccactgagtcctaccattgactatgagaaaggaaacttcatacttagtcacacgcatctgctggaatatgcgcttgtgtgcaggcctgtgtgtacctgtgcagccattatctgcttggggacaggagtcatgttgtattgcttattctatccacagcacttaggacagtgacaaacccatgacagataatcagtgtgaaattctaacatgctggaacaacacaattagtgtcatatacaaaacttgacagtggaaatgggcaacatcaaccaggaaaagttcaacttgttgactcaagacataaaagcatgactgaatttaggtacaggagatacaaaaggttagtaaaaaggatgtgcttgatatttgaaaaggttattattatggtgaaaatatttaaagacatacaaaagtaagaaaatagtgtaataaactttctatcgccaggcttcaaaacagaaagttactaatggccaattttatttcatctatacctttcctcctgctacagtttaaatgattgtgttccttccaaaattcattctgtaacctaatctcaatgggatggtattagggggcggagctttggggaggtgatgagctcatgagggtagaaccctcctggataggattagtgcccttacaaaagggacaccagagagctcccttgcctcttccaccacatgaggacacagagagaaggttctgcctatgaagcagtaagcagatcctcaccagccactgaatctgccatgccttgattttggacttccagcctccggaattatgagcaataattgtctgttgttcataagccacccaggtgatggtatttttgttacaacacaccaagcagactgactccttttccccctttggattattttgataccagctgtggagctcaccttatgttttctgtaaatatttcagtatttatctctagaatgtaggaatgctttgttaagagtcatgtgaatgtgtgactttggagagcacactagggcttttgagcctttatttgagaagggcacagcataacatggtcaacagacagcaaagatggctcttgaaaagtataccttgagtggaaaggttgatcagaggaaagcagtatatttgcattaattagcagaacacgaagtgcattgcttactctgtattcccttgaaaggcttcttcccttctggagataactttcttaatgacaccagacttagcttgcaggcgtggtggctcatgcctataatcccagcattttgggaggctgaggcaggtggatcacctcaggtcaggagtttgagaccggcctggccaacatggtgaaaccctgtctctattaaaaatacaaaaattatctgggcgtggtggcacacacctgtaatcccagatacttgggaggctgagtcaggagaatcgcttgagcccaggaggtagaggttgcagtgagccaaggccgtcccactgcattccagcctgggcaacagagcaagactccatctcaaaaaaaagaaagaaagaacttttatttttctattatttcatcatttctgcctcacttcaagaaacagatatttagtagatgcttagtaaaaatacttctagatgacacactcacttaacttttgggaacatataactgcgaagtattttgagtttctttcaattcccatcatggtgcattgagtttatcacatcaatgtatgatttagctcgaaaggttttatatttatatattcagatctctctatatgtctgtagacatttatatatatatctatatatttcatatatgtatttcaggaatttatagaccacacattcatatatagatacagatatatatatgtgtgtgtgtgtatatacacatatatatttatacgtatatacgtatatacatatacacacatatatacgtatatatgtaaacgtatatatacacgtaaataaatatatttatatatacgtatatacgtatacacatatatacgtatatatgtatatatacgtatatatgtatgtatatatgtatgtatatatacgtatacacacacacacacacacacacacacacacacacacacacacacagagatacacaaagagatacaaagagtctagggacatttattccaggaacactcatggaaaaggaaaaataccagccttgtcagatattagtattaaaaaaaggaaaacatgttaatatggaattttgttatgggaatttttaaaacacagtcaaatattttctgtcactatctctgtacaaatacccaccaaaaaagaaagcaatgaaagcaaagtccagcttatatgcaaaatatggtaaaaatcctctataccagaggtccccaacccagaggtccccaaccctcaatccatctgtggcctgttaggaaccagcccacacaccaggaggtgagcagcgggcaagcgaatgaagcttcatctgtatttacaaccactccccatccctctaattacagcctgagctccgcctcctgtcagatgagcagccacattagattctcataggagcacaaaccctattgtgaactgcgcatgtgagggatctaggttgcatgctccttatgagaatctaatgcctgatctgtcactttctcccatcacccccagatgagactgtccagttgcaggaaaacaagctcagggctcccactgattctacatgatggtgagttgtataattattttattatatattacaatggaataataatacaaataaagtacacaataaatgtaatgtgcttgaatcatcccaaaaccacccccacacccccttgtccacggaaaaattgtctttcacaaaactagtccctggtgccaagaaggttggggaccactgctctataccccaataggcaacattttcattcttctgtgctatgtacattctaagagcttgctctgtaatcacagtggcctgtgcctagattttttttttctttttgagtaagaactagtaagacaatggctaatacagtggaagactgtgatgaattttgtgtttaataaagcaacagatggttggaattcattttaattccttagcaagaatgagtaaaacccaggaaattgttagtattcacctctttaatggaaagtcataaaattagtcttcttccttctggatttggcctcaattacagagtgtgttggattggtgatgtaaaagttactaaacaccatgggatcgtgtagggtgcttaatcagttatattgcggtcctataaaacagcactctcgtgatagaaattaaggcgataaaatagctcaattagctgtctacgtatgggtgtagtagaatgaaaagtagagagaggattcaggccagacacaaccagtggaccttcttcagtcagaaatggaagtttgggatgctggggggtcttggagtcaagccaattgtttatggttcatgagaggagatggggtgacatgaaaaaatcctcagagcttttggaaaattcttcaaaacagtaaaaattagtgaacgtatctgtaatattttactaagtcaaagatgcattcttagactatgattttaaagtgaaagtgatcaaagatgttgataagtcacatatccttattagaaatagaggagaacaatgctttagggagaaaataatgtgtgtccaaggttatgttgttagttaatgaaacaaggactagaaataatttttttccagattctactgaacattctgtaccacactgcctcttctttttctttttttaaaaataactttataatgttactttaaaaggactaaagaaacagtcacctagtctctgtataatttattgcttttcaaacatccacgtgtgaataaaatatatgttttataagaatagtgtattactttgagtataccagcacacactgtggatctcctcaccatgttggcatggcaaatggtataattcattcaactcaacataatttaatgatgtctttaaacgtctggccctgttccttagagtaagtgtgttgagcagagttaaaaacatacatctcaaatgtttggcagtccctcttttctcacaatcattgaataaatgaagtatttacagatgcacagttttttctactcattttcccccttatccatttcatccaacaattcttgttcattccatgatttaattgtattgcctgaaagtagtgacaactttgaataatcattcacactcatgttgagatgaaaatactatctaggagtgagtttcattaatcacaaatctcttttttagtatacaccactttttctttcctatttctgtgttaggcccataattcacactctcactcaaaagagagtagagcaccttggaaatttctgttgggaggcatggcaggtcgacttctattaatagatggttcctgtgactttctctccccagtattactttcagaactatgttacatttatgtacaaggcaaaagggatttttgcagatgcagttcaggttactactgagtcaaccttaaaatagggagattatcaggctggaactaatccaaccatgtgagccatataaaagcagtgttttctccagctggcgccagaagcagaagtcagaaagatctgaagcatgagaagctttggatgggagggaggctttctgacactaaaggatgtggacggacccaagagcagccactgggagctgagagtgaccccagccaatagccagaaaggatttgagggcctctgccgggcacggtggctctcacctataatcccagcacttaagggggttgaagtgggcggatcatttgaggtcaggagttcgagaccagcctggccaacatggtgaaaccccgtctctactaaaaatacaaaaagtagccaggcatgtaatgcatgcctgtaatcccaggtactcaggaggctgaggcatgagaatggcttgaacccgggaggcggaggttgcagtgagccgagatcgcaccatcgcactccagatagggtgacagagcaagatgccatccccccgcccccaaaaaattggtgggacttcaatcctataaccacaaaaaactggattctgccagcaatcccagtgaatttgagcaagatttttccccaaacctgccagcaccttcattttggccttgtgagattctgaggagagaaatttgctcaagttgtagtaattggttatgcaccaaaagaaaattaatagttttctaggggcagacaagatttttaccatcatttaaaattaaaaaaaaaaaaagatgtggaggagaaagaaagagggagagcgactaaatgaaaatgttctactctgttaagttgtgctattggaaaacactctaatggagatgggggctccaaaaagaaaaacgtgtttgtgagcaggggataaaaaggaagagaaacctttgggaagaaataggagagaacaaagaggcccctgccccctgcccaggccttgctgtaggtcagctctggaagacaagggaggcctacagaggaagccgcgtcatcagggaaaagctaggtttgtgtctgggggagaaagtgaagagaatgttcagagaaggtttcagggggcagaggagtttgctgaggacacaaaggaagccggagcaaaaaatccctgaagggttttagaagggagaacaggggaggggaatggaggcaggttaatggtatgtacgagtggtataaaggtataaatgatgtaagtaaagacgtgacctggcaggcgcactcctgctggtgcctgagagcacttgtcctgatggccctttatgatacagtgaaggaagagggattctgagaacaccttagtccctgcagcttctgacagttgggctataaagtgcagttctcttagacaatcacgagttcaacaccgcccccctcccactccagtgtcaactccatgcaggcagatcacagaacaatgtctgggatatcacgggtgcccaggaggtattagttgagtgaacttcaggaagactttcttttctatgtcctaatattaacagtgcctgcagagagaggagtttagaaactgcttctaggcatgttgagtatgaactaaatcaaattaccaagaaagcctcaaaagccctgaatcctgatgcttagataaaacagacatttgggtatatatttttatttttctttctttatagagagcaactgttcatctatgagaatattttatttccattccttccccatccctagcccccaaaaagaatctcgaccctcccacatccttctgcatttgatcaaatgccattttttttccagttgttcaaaccagatagcttggatctttttttagctctctgtgtcccttacactgtataactcctgaacatattttctaggctctgtctttcaactatatccacaggaagccactatttaacacctctacgtttaccccccccatatcaagttagcaaacacacatcataatgcattgtgtgggctatgaagtctaactggtctacctgttcctaccctagtctccccatatagcagccacagtggttctattaaagtgtaagtcacgacagggccctgcattgctttccttctcaatccgaatgaaatccagtccatgtcagcatctactacatgatcttgctcccgctctcttccaggtgtcttttcccatctctttacctgttgttaagagagagagccagccatgctgtcctccaagtatgactgtgctggagggggtttccacttcctgtttctcctgcatggaatattctaccaccagatattttcagggctcacttttttactcccacaaccagagagatttttgttttcttctgattgctctattcaaaatcccaaccacctcatcactctttattcttaaacatggcatgcttttcttcctagctctcattatcacctgccatattatatatatttatctctttggtagttttttgtctctccactttagcgtgtaagttccatgagggcagaggctttttccattgtgttcgttggtatttttccagcttctgaaactccgcctgttatttagtaggtatttaacaaatagtaaatgaatgaatggctttatttcttccaataaataatggccattagaaacctggtttaaagatacagtcacacagtaaagagtggagattttattcatgaacaggaccaataaaatggagaagaaacaaagtgaccatgaaataaccaaatgataggatgggtaaaaagtcactgactatggagctgatgtagaccttcaagatgcaactccttagtctgaagatgatgacagtgagaccaaaggatgtctcatttatgccctttcaagctcaaacaactacattaccacctggccatgacaagaacagtctttgaattgtccaacacagaagattatctctaaaaattagaaggagaagagacatggaggaaaatgaagagtagaactctttattgattggctatttgccagtcacacagttatgcattaggtctttaagtgtgcttatgcaagagaaggtagacacaaatatagagaatagagcagattatcagtcctttcttatggttttcataactgttaaaatatctttctttgtttttaacaaggaatccagggtttgttaatagctaaatttgaagaggaaaaatacattaatgttttcatagcatagttttaaaggaataaacataaatattaaaaataacttaaaatagtagcataacattagggagaaaggtttatttattacaaaaaaaaagagctgaaacactggatatacagtggctaattactgcaccagcacggataatacttcatgaagaaagttttaagtaaagctgaagcaaacaaaaatactttaagacttacatcataaagcagtatagaaagagattagtcaagccaccatttcagctaagccagccgcacttatgctcacatcggatgacatatttacatttgctggtctgaagcaaggtgatttataggggtgagtcatacttggcatctcctgacaatatattgcctcagattaaaatataaacacttttcactgtaattttgaggtgtcttgagcttcatctaaaaacatatttggtgctgagcgaatgaaatccctacacgttctatttaaacaatgttttaaaaatatatcatgttcaatgcattcccctggatctaattgtcagattggataagctaaactaacttttggggcttggccagatcaaagctaagtcttctatacattagaaagatgtgtagctcccattaccactgacattttggacagctactcgctgttccaaacctgccttatctctatttctgtctccacactgcacgagctttaaatggccactggctggtcagtgtctccccatgttgtctactttttctttttcgagtttgaagtagttactttgctacttgcccctctcagaacctcagaattctctcagttctcctctctcttactcccaatgccttccagtggcaaaatcctgctaattatatctcttagatacatgtaaggtatctaaagagataaccttgcttccacttttccaagtcgctgcccgtgatggttaatattaggtgtcaacttaattggattgaaggatgcctagatggctggtaaagtattgtttctgggtgtgtctgtgagagtgttgccagaggagattgacatttgagttggtggactgggaaaggaagacccaccctcaatgtggatgagcacaatctaatttgctgcctgcatggctagaagaaagcaggctggagaaggtgggataaccttgcttgctgagtcttctggctctctttcttcctcccacactggacccttgcttccactcctcctgcccttggacaccagactccaggttcttctgcctttcgactctgggacttgtaccagtggtttccagggggttctggggccttcagccacagactgaaggctgcactcttggcttccctacttttgaggctgttggacttggactgagacactgttggcttctttcttccccatcttgcagatggcctatcgtgggactttgccttgtgatcatgggagccaactatccctaatgaactcccttttatatatacagagatactattggtcctgtccctctggagaaccctagtatactgtgcacactttataacttctctctagagtagtcacgtcagttttctggctgttgtctccactgcagtctttccccactctaatccaccttgaatagaacccaaagagtgaccttcagagagctcagccctttcattgtttctcattgcctggagagcaagactcaaaagttcaagttggcattgattctgcagaccagccttagtctgtactttagcctcattctgcatcctcctgtcccatccccagcataccagccctacagaaatctgtccactctccaattatacctaacaggttcctacttaggagacttccttccagtagggcaacatcttttcagggcctgctcaagccccatttctatgtacagtcatcagtcaatcacagctcttcctcactttttgctttttttttttttttctcagatggagtctcactctgtcgcccaggctggagtgctgtggcactatcccagttcactgcaatctccgcctcgtgggttcaagtgatcctcctgcctcagcctctcaagtagctgggtttacaggcacccaccaccacgcctggctaatttttgtatttttagtagagatagggtttcaccatgttgaccaggctggtctcgaactcctgacctcaagtgatctgcccgcttcggcctcccaaagtgctggcattacaggtgtgagctaccacacctggccaccttttgcctttaactgaattacagcatcatcaaaatcttccctgtaccctgtccgattatgtgttcacccacatctgcagagggctactctgtaaagtgtgcgtgctgtattattcatcattgcagtctacctggtatctaacaaaatgccttgcacaaatgagctgctcaataaaaatatgctgtttctttttgatccagtggctgaggtttatcccagaaaacaaaatgccatatgtctctgttctgtctgatggtattgtggctttaactaatgactggtttaatttgggactagccactcagagaaaccattcattctaaactcaacatctgataatgaatttgtatattctctctcaaatgggttagttccattctagttggtatttttactaaattaattcaataagttgccagtgaaaatatcaggcactgagactgggtgatgatgagaaatttgcggtctgggatactttttgaaaccaccaagccacatcacgtaggtggtttccataggtcgggatagccatgagtgactgacagttttccacttttcattctctttgcttcatgctctgaaaaaatgtatatattggtcacttctctgacccaggtatacccaaggagaggcatatctaaaactcgcacagatcttaagcacagttttgaatacacagtgggttcttcttgattaatcaatttttgactgacataatcccagttaatctttgggatcaaagaccagtcttagtctttgacgaggctggtctttgacaagttaatttacgaatcttcataatcagtaatgccctgttttcatgaacccagggaccacagattttcccttggttttaaaagtcttcccagtaaggtacaatgtgacgttttgacatatgtaagcaatgtgaaatggttaaatcaagctacttaacatatctatcacctcttttaatgctttttgaggtgagacatttaaaatttactcccttagttatttggaatatataatacattagtactgactatagtcaccctgtgatgccttagatctcaagatgtattcctcatgtctttctgaaacattgtaccctttgactaacaactccccattccctctctgcttatccccccacaccatcatctggtacccacaattctactctccctttctatgagttcaacttttatagcttccacatatgagatcatgcagtaattgtcttcctgtgcctgccttaatattaataaaaataaaaatttaaaaagtcttccaaatgcactaaaacctatcacctactttgagctttcttatagcaccttttgtagaaagcccatgtattagttcattttcacactactataaagataccacctgagaccaggtaatttataaaggaaaggggtttaattgactcacaattccacatggctggagaggcctcgggaaacttataatcatgttggaagggaaagcaggcccatcttacatggcagcaggtgagagagggagtgtgtgtaggaggaaatgtcaaacacttataaaaccatcagatttcatgagaactcattcactgtcatgagaacagcttggaggaaactgccttcgtgatccaatcacctcctaccaggtccctcccttgacgtggggattatgaggattacaattctagatgagattcgggcggggacacagagccaaactatatcagcccatatcctctgaagccaaaatttcaacattttactaaatggcagcaaactgaagactatttacaagtcagtatcctagagatgggttaacactttttcctccttgtcatgagcacatggatgtgcaatttccaggaagcctcttttagaagagatcctgagcgcttcccaagcctgcagacgtgtgattcactttctttccctgaacttgaccccacaagaacccaccgtaaattggaactgttctttgaaattgcgtttaacactaaaaggacacgttggaattagacatcatgattcatctttcctgtttgtttcaatgtcaaaataatgataaaatgtttttaacattgaataaagaaaaatacacctcttatagctgtggctcctgtgaatactgtggctccttgggcttctttcttcactgtctctcacaccaaggggtatttttattagagtttgagaagtggtgtcccattgctttgataggaaagttgcagggaagatgtatagtggccctgaggacactttccaccaagtcctttctctcattctaggttatatgtctatggcctccttgctgtgatatgtagccaccgagaactttgttctctctaatggaatgtgtgatggagtgtatatgtgtatatagatacacactacctttagccccagctcatagacctacattttctctttctctttttttttttttttgagacggaatctcactctgtcacccaggctggaagtagcacgatctcggctcgctgcaacctctgcctcctgggttcaagtgattcttttgcctcagcctcccaagtagctgggattacaggcgtgcaccactatgcccggctaattttttgtatttttagtagagacagggtttcaccatgttggttaggctggtctcaaactcctgacctcaggtgatctgccaatgttggcctcccaaagtgttggggttacaggcgtgagccaccgcgcccggcccatttcctctttcttgttcatttattttctgttcataaaagagagaaccgtgagatcccagagaatgagtaatctacacaggaggacagtcattagtgtgggaccctaactgaacacagttttccactgtgtctgaataaggtcccccaaccagtgaatacattaccttatacagcataaagggatttggcagatgtcataaactaaggattttgagattgggacattatcctggattatttaggtgagtccaatgtaatcacaagggtatttataatgaaaagaaggaggctgggggttcagagggcagagaaggccatcagacaatggaagcagagattgaaaggatgtgctttgaaggtggaggaaggggccagaaacggaggaatgttggaagccatgagaatctgaaaaacccaaggaaacggattctccctgcagaggctccagagaaactagattttctagcaccttaactttatttgggtgaactttatttagaccttctggtcttgtgtcttgtttttagccactgtgtttgttgtgattcgtcatactatcaataggaaagaaatacgcctgccaacttgatttcctgcctggggcttttccatgaggaggaaataaacaactgtatttgagccatgcaattttagggggtcacatgttattgttgctcgctctatactactaatagagaacttgcgttcctcttcaactgatactctggagacagtaagctacttacccatctgggagttggagagagagagagattttgatagggtctatcttataagtgtcaactatgtagaatcggagaaaaaaaaagaataataaaaaatgaattcaacctctgagtgagaagacaatcatcaatgaattacaacctcatgagagataaagtataactacttagtggcatgagtaccttgacaaagtaacttagtggcacgagtaccttggtaaagtaacttagtggcatgtgtacctttgataaagtaacttagtgtcaggagtacctttctcttcttatctcctgcctcctgactcttcctggcaactgtatttgtttaagatggtaaatacataattgaataaaaatgtttaaaatattgatgttggtagaaaatattccccatatatatgaaataaaataaaatatttaaattacatctgccttgataaatacctttatcatgattcagtaatccaataccctataattagtggttgctttatgtttaagaaactcaactgcagaaattcaagataagggattggtcactacattgagattctaggtccaaagatttaattatcaagagtagatttggggacagcatttaaactctgcacaatttcccatctccaaacttagacaaaaaatgtattagaaaaaaagtattagtttatcaaatttttattcatataattcagagagaaaaaaagtggttaattttagataactgttttaccaaacatatttttttctttgtaacaaaaatgtaagggaaatttattctaaaattatcttgtattagttttctataccacataacagattgtcacaaacttactggttgaaaacagcacatgtgtgtcatctcatagctcttgtgatctgagaatatgggcgtggcttagggtccactgcacacttttacttgctgtaatcaaggtgtcacctgggctctattctcaccttcgaggcttgactggaggaatcaagtttaggttgttggcagaactcatcttcttggggctgagtgaacgagggccctggctttccactggcttttggctggaggccaccttcagaacctagtggctgcctgcagccctctgggacatgcctctctccatctgcagttcacaccatgtaagtttgctgcctccgagactctaagcagtctcagtcactcagctaagtcttacatagtgtaatcaacagagtggtattccatcatctttgacttattctttgggttaaaagcaagtcagagatcctgcccacactcaaggggagaggaatgcacaagtccttacaccatgggggccatcttagaattctgcctaggccaagtatattattaagaaaggtctctctctctctctctctgtgtctttttccatatatatacaactgaccatttaacacatgggtttgaactgcatgagggtccacttatacacagagtttcttccacctctaagaacccctaagaaagcaagaccaaacctttctcttcctcctcctcctcagcctcctcaatgaggatgaggacctttatgatgaagatctttatgatacatcatctttttgatgatccactcccacttaatgaatagcaaatatactttctcttccacatgattttcttaataacattttcttttctctagcttactttattggaggaataataatatgtataatacatataacatacaaatatgtgttaatttatcattcatgttatcagtaaggcttcctgtcaacagtaggctgttagtagttaagtttttgggggaatcaaaagttatatgcacactttcaactgtacaaggggtcagtgtccccaaacacccatgttgttcaagggtcaactgtgtgtatgtgtgtgtgtgtataagattatatatatatataatctgtactttatatatatatataatctgaacttcttatacttatatataatctgtatcatcctcttttaaaatctaataaaaacctagattcttccttgagttttttaacatatttcctttacctgtttcctatatctattacctatacctctgtgtaatgtgtattaccctatcttaaaaaagtgataaaaaatacatctaataaaaaccttgcctcttccttgagtttttcagcacagtaaatgtttccctggccaaatctgttgaaatcaaatttattctcatagtcagtttcatctttggcttttcattccatgagcgagccccacatcaaccctgcatttttgtgtatggactgcatattacaagagcattgtcaaattacctagatgtttaatgacttaacaagacaaaagaaaacttacagaataaaacaaaaatgataacccccctcccaaaaaagagttagtaattcaaactactactgataatttccttatatgacaaaaacatttgtgagagttgagcagaattgattattcatcttgaaatccagacatttcacaggaatgagctgcattaatctaaatgaaaacacaaaggaggtttttggttttaagttgactgcatctagccataacaaacccatggaaagttcttatgtggaatagttcttctcagtcagacactccatttatgggcacaaggttttagatgtgatttggacctgatgagaaatgtgaagtgatgtatatatgtttgccatgggaagataacatgttttttacaatatacacataaaaaagagataggaatgttgtatgtgtcttagctataactcaaaattaagagacattacctccagggctctttgaacactattttcaacatattgggaatttttcaggaacagatttttccccaacttaaaaccaggactcacatctttgatgttacaccacatcttacttctgctacttgcttctggctcctttttctccaccaatcactctttctcactttcttcatagactcctcttcctcctgcacccaaaacattcatccaaaaacactgtctgtattcccctcattcttctgggcagtcttggtttctgcatcatttttgttatgcataatatgctgtggagtttcaaatttgatgtccgagccctcatagctaccccatgtttcagatactgtggtaggcagaataatgacgtcctccccagagatgtccacctgctaattcctggaatctgtgaagatgttactttagatagcaaaggggaaggaaggttaccagtggcattgagactgtaaatcagccaactgcaaaataaggagcttattctggatcattaaaatggacacaatgtaattataaagatctttaaatgtggacgagagggtcagaaagggtctcagagtgatgcagtataagacgaaattgacaagccattgccgctgttgaagagagaagaagggatcgtgagccagggaaggtagacagccttaagaagctggaaaggcaaggaaatgaattctcccttagagcatccctaaaggaacacagccctgctggcaccaccatcctggccccatgaggcccatttggacttttcatttctagacctttgtgttgtgctaagacactaactttgtgatgatttgctgcagctgccatcagaacctagtacagatgtcagctctctgatggacacaggtatctgttgcatttcaggcatccagtgaattcttccattacctaaattaaaggcactctgttgcctttgtgtctgatctagaaaacacagttgttctttcttccctggacctccacatccaatcagccatccattgtggtgctttttacctcttaactgtttcccagatctgatctgactcatagcgcctctcgccctgctttagtataagtcattatcatctttcatctggagggacttaatagactagcgggcttcattgaatatacttttaactgccttaaaaccatgctatatatagtgattagtaacctgtcccaatcagaaatatgaaactcttgtgttggttctcatcaactagagaataaagagcaggcccctagcttgcatctgaggtgtttagtgatgcacagagctccacctgtcttcccttttatccttcttgacgttctccatggctgtctccatgtttcgaagaaaaccagtttttaattctcctcatagaataggctatttgaagtctccattcagtttcccaaatggttccattttctttgaaattcccttctcatccttcctcaactggataatccccatgatccttcaagtagcccaggcactattatcctcagggaaatgctcttaactctaccactctgagctagtatcccttatttgaattctggtggcaccctttgtgtgtcctctcatcacatttgccatttcaaattaaaactattctgagaaagtgaaaaaggtgctgcctttgtggatcagaatttggaatcattaaactaaattcatttgctaataaaactttctgacattttgagaggttagggggcactttaagagcattaatgtattggaataatagcagagcaatatatatgcttttggccagatagcagttgacttcatctaagaagcgtctcttcttgaagttcacagcttccaacaatggttctcaacccttggggaacattagaatcacctgggtagaccaattaaagcaaaataactggagatgagagacccaggtagcagaattatttcaaagtacctagatgaatctcatatgcagccagaattgagaagcactgcaggagggaaatgctcattaagtggtaagagatgaaaggaattccatctaactggatttaacactcaaaatgtagaaggaggttatactgtagccataacgtcttccttccagcttttgtgtgtggtttgcctgtctgagccagtgttctctttgttcctgctatctttttgtaagctagctcattcattctcctcacattaagtgacaattatgacttaatcatgtctgtgtttattgttagaataggtatctcctttgagctcatatctatcttttttgacattttcgcttagatgtgtcccaaatttgtgtcacaaactgatcatttaattttacctaaaacaaaaacaactcttttcacagttttccagatcttaacaaatggtaccgctttccacccaggttctcaagccaagcatttcagagtcatcctgtcatcttcttccttcaacccccaagtgctgtttgctcccatctctcaagtgtatcccagtagacacagttttgttgttgttgttgttatttgtttgtttgtttgagacggagtctctctctgtagcctaggttggagtacagtggcgctatctcagctcactgcaacttcctcctccctggtcccggttcaagcaattctcctgcctcagcctcccaagtagctaggattacaggaacgtgtcaccacgcccagctaatttttgtatttttagtagagacaggatttcaccatgttggccaggatggtctcgaactcctgacctcgtgatttgcccgcctcagcctcccaaagtgctgggattacaggtgtgagccactgcgcctggccaacacagtttttataatctttaccatatctaattcacacctccatcatttattgcctagacccagtgacaacttcctaacctgccccccaatttcctcctgcttccctacaattcattttccaaccagcaggcaaagcagtccctaaaataaataaataactacattggataaaaagctcacctattttaaagcctttgaggactttctttggcccttggaataaattaaggcagtttaacctggcttgcaggactgcaaattccagtgcctgctgagacattcaaacccatcttgagctgcactactcaagtaacttatttttgtatttattgtagatttctctcattggcaggtatactatgagcacaaggaccttgtcttttctaatgttgtacctctttctgggaaatagcgttcaacatgacttgtttttgtgaaaaaggagaagatggctcctagatgcaccatgtgagatctgatgtatttttttagactatgacactggcaaagtagttaatgagctttagaaaagcatggaatctttctaaacatttccatgagggaaaaataacacggtatgaaactctgagaaatacattttgataatttaggaaatatattagaaatgtaaagatgaaggttatctgtcttttgcctaaggatttacataagggataagattcttcaaaaaagaaaagcacaatagctgaaaatacttaagtgttcttaatcaagtcaaaatcaaggcaggcttcagtcacagcaaaaaccgaggctcaggtggaagctgcaggtggcccctccctgagcaaccacctaactggttttgccaaataagatacactggctgaaagttagaactgacatgtgggtaaatgataaggtttattgagaagctgtctataaggaggagctcttcaagaaggagatctggaaatatgtcaatctaggtgatatggtttggctctgtgttcttacccaaatgtcatctcagatagtaatccccatgtatcaggggagagagcaggtaggaggtgattggatcctcggggaagtttcccccatgctgttcccgttatagtgagtgagttctcacgagatctgatagttttatgaggcagtttttcctgcttttgctcactctccctctcccctcccaccatgtaagacgtgcctgctttgccttccaccatgattgcaagtttcttgaggcctacccagtcatgtggaactgtgagtcaattaaacctctttcctttataaattacccagtgccaggaagttattcatagcagcgtgaaaacagactaatatactaggataaaagaagaaatttctgtgtagtgtaactttcctcatctccctatgaaactcagtaaactccatattgttgattttatttgagagaatcctatgaaatgatgaatttgccttaatggaattccttaagggagctctagtattttgaaaaattccatttgggaatagtttctctttctttaaaatacggatttttttttttttttttttttgtaatgtggacttttgaatgagcgcaatggaatggattttgggaatgttatccaacaaactcccagtgggaggcaagtatcaaaccagtaatccagaaatttgaagaggggaaattaaacaaacagaattactaactactgacaaagactactactaagaagagatcaaagaggtctctaaagaataccgtagaactggggaaaaatactgaaggaggaaataaacttggaatggtggccctgccccagggatgggatttagaccttattggagaggctgaggttgcagtctgccaaggaaatgggtggaatgaggggaaggggttaggtttactgggatgtccgagaggagagctggtccacagttagtgggttgaggctggtacacagagatccaaaaaacaaaagctgctggagggggactactgggtgtcccacgcacaccccccttgaagtcatgtcacaggaacaaaggaagaaccagaaccaggagaggaagcccctttcttcctgggaaagccctctcatactgtctgctgacaaaacttgacatgtgcctgatgccaaaggagaaatgtttaaaggtttcagctctgagcatggggaagcagagcacagaagggtgcatttggaattgaaagacaaaaccttgagaactgacacagggagcaacctaccttctgcttccaggtgcagccccttttaatatcaggaagatctcttatgttgtagggagctgcctgaaatacatcctcctgtgttgaggtacttggggtcattgttaaaatgtaaatatttggggagagatagcattagcactttgtacttcatagtcaaaagggaataataattagtgatgcgacacccccatatgatgatttttaaagattcttttcatataacctatctctggttttctgatgatctcaaagatgagcatggggcaaatggtgtaagcataatttaaggattccacactgctatgcaagttataaggtaaaggcaaaagttccctacgctacaattgctttccttttgggattacttgcagcttttctctagtatttttgctgcaataaaccttctgattgaacctactggcatagttttaccccagaaggagggattttggattctaaaacagtatccatatatttatatacttaaaccccataaaattatttgtccaaattatttttaggacacaagtttataaatctgagaagaaccaaatgctcaaaatgaaataaacataagccaaatattggcccatctcaatcatttttgtaatgaagtatttagtcttggaaaggatgcatgagacagtttgctgttgatattgttgtacttacagcttaaccgtagctagctagctagagacatagatacgttttatatgtatatgtatcagcatatgtcaatatttatacatatgtaaccataatatgtaaccattatatatgtgtagctataactgatagaacatattttaatatattttgtatagatgtcaatctctcatttttacatataaaatttagtttggaactagtatggtcaggccaaaacagacttaagtttcttttagtattaaagattaccagctgggcacagtggctcatgcctgtaatcccagcactttgggaggccgaggcgggcagatcacctgaggtcgggagtttgagaccagcctgacctacatggagaaaccctgtctctactagaagtacaaaattagccagatgtggtggcacctgcctataatcccagctactcaggaggctgagtcaggagaattgctcgaacccaggaggtggaggttgtgttgagccaagatcgcgccattgcactccagcctgggcaacaagagcaaaactgtgtctcaaaaaaaaaaaaaaaaaaagattgccgtaacttgtacatattttatttcagatcatatgaaggatcagatttgctggtgaatatttattgaatgcaatcaaattaatattaatgcaaaataatgattatgtcttttaatatagactccaaattcttggacttcagagtcaggaaaaaaagaccttttaaattccaagtttataggaaaaaataacattgcagacacatcaaagattggtaatttgttaacctgagtaaattctttctgcttctcaaggatcaaaaacccatacacttctccaaaaacatgagcttcagcttcaccagtcttgtcagctctttaagcaaagaaatgctgcttccttcctctccagtttcataagggatttaatagctgttcttatgacctgcaccccattctcatatataacattttctaattcaaagattctggtagacgtttctctctacctgcatgttctagaagctcatctatgtgctttgaaaatctacacactctgcccctgtgcttcacattttgcaaacataattatgtagaaagaaaagaggactctttatttttcaggccataagtctccaatataactcacacttaagaggggcttctcagattagaattctctcaaatgggctcttgtcaccaattttacaggacagctaatgaaaacatcctagtaattttcagaacaaataaagaaagcaaatgaataccctgtcaatgttctaattgaatagttccaactgcgcctgtatctctgggccattcagactttcccagttggacttttgtttctgttccccccccccctcccccactcttgtagagattcaatgcccaccacacacagggtttctttgctgtctgcccgtagggtgggtcttcacagtacggactttgatctggcaaggactggaaaataaaagcttctatcaaaggtgactttacctagagtgagcttccttttacagtagaagaataactgccctttgttatgaacaaaactcagaatgaaaaatagctgtcacctccaactctgcacacttggaggctttttctgagaaatgatgttcttcttagtctactcctaaagacagtgacaagcagctgggaaagtgtacattattcatcgttccgccttcctcactggaaggaacgtgggtgtaggataaataacattattcccagtgtctaggccaatttgggatgctttgcatattttattaatcccctgctattgagaaagataattcatttggactcatgagcactgaactatgaaaagccaagattttccttttgttggaaattttctggtatgtcaaagaaacaaagtaatagaactaaagacatcatatatccaggagggttggattcaggtctcaatttatttgaagaaagattagacaagtatcaactacagtattgttgtttttttcagcaaacgtttaaaaataagtgtgcccctttaggctgttggggttctttgggaatgctataatggttcaattcaggaaggagcaactaatgagaccctgtagttctccgcaccccaacccccgccccagttcccgaatatttgcaattagttaatcttccctacaggaaaccaaaagtttaatgattccttacaggtaattcggcatggggcatgagtgaaaaggtgagttgaaatgaagcacaaaatagaaaacagtggattcccagaaaatcccaccacaggcaaggcacacagcagcatcccacatccccaggatgggaggagttaccaggttaatgtgtttctcgggtctatttttgtaacagcagcccgccatactcagcatgcattccacctctgaaatataattaccaggatgtgaaaaatgatagaattcactgaaatgataatatagcatctgttaagataacttttggcagggttcccagcttttcgttacttaagaaaaataatgatgtgttagtcactgtgagaaaaagaaaactctgagaaaatgttaataatgcctacagtggaaaccatcatatgcatctgagaatatccagtgacgaatttttttggcctttatcagttattgcttgttcctctaaggaacaattttacagtggacaaaaaaaaaaaaaaaaaaaaaaaagctttcttgagtacctagtgcctagttcactgttagccagtaaatacctttatggttgattccttatcatgtagggatacaactcagggaaatcaataaaaagaatttaaaaactggcaaaattatatattttaaagtaatgtgtacataaagggcacagtggaattaaactaggggctaagaataggtaggtaaattttcaaaatgttgctgatgtgtggggatctgtctacaccaactcaagatgttaagtttctattatcatgcactgaatgacatggctctttcatcttttcttcgaaaatgtttaggattaccacatacaatgcaggatgcccagtgaaatttgaactccagataaactggacacacatttaccaaagagagatctgtcatttacctgaattttaaattactgtgacattctctgtttttacttgtgaaatctggtaactctggaagtgttgcatatttatacgtatatgaagctttttggtcaataaaaacaaaggaagttgaatgatagcacagcctatcaactgcccaacatgccagaaaacagtacgatgtaatgtttgggagaaaaaaaaaaacatcatataaggttgggaaaccgtgtatactttattctgtccttgatgattccaaattcaacttagtatattaaaatctcttaagaatccctacactgggaaaactttaataagctgtctttagcccagaattgtataacactattttgctagaaactagagaaccaagttcatttgggagagggtgaacagtacttcttctgtgtgtctgtgtgtgtgtacataatatacctctaggaaatattaggaaatatgaatttgaagattataatttctgcacagttaatttcagcatagcattgaaaaatactgcattttatttctatttaaccaagtgtcttctgaaatatcttagcatttattattggtgaaagggaaggaattatttcatctaccttttgagttattctcaggactcatgcaaaataacaatattattttaaaatattttactggtaaatattggacctttactgaagatcatgcacaatatctacagtgagaaatattactattgataaattaggcaaccttgaaggtgattcaaaatagcaagaaagtgtcaacttgaagactcagctcaaccttgcaatttcactagtgccttagactttttggtattatcatctacacctgtatatgtgctgtataattccaagatgttgtaaataagtttgctcaaatagctttctctacttcttcagtggggtttgaagttcaacaattctgagcgtatcctgtctggtttcatttttgatgctatagtagttaaggatttgaattctgattctgacctacattcacaatttggttttgacatgtgtttgctatgtgaccttgagcaacatataagattgctctaacccttcagctcatctgtgaatgagctgtatataataatgatacctcttctcagaggcttctgtgagggttcagtgaaaaaaatacatgtaaagcatttagccttaataaaaagacagtatcattattattgtgttgctaattactactttatttttgcttgtgatgttgctgctgcagttggagctgtagcaattcaaacactctgtgggaacagcactttgggaactgaggcattttttccaagggttgctccaagaattaaatgaggtgatgtaaaaatatgctgtgctttgacatcaaaggtagaattcttccaaagaatgcctttgtcctgtattctctcaagtacaagttgtggaaggcatggagtttagaagagggaggacggatgataatatcatccaaggataaggaaaggaaatgtgaagacccctgaggacagacattttctatgtgattgtgccaagaaacaatcttgcctccatgtaagctttcattttcagaaacccttatgagaaggtgtattagtccattttcatactgctataaaggtactacctgagactgggtaatttataaaggaaagaggtttaattgactcacagttccacatggctgaggaggcctcgggaaacttataatcatggcggaaggtgaaggagaagcaaacttggacctgctcacatggcagcaggagagagagaagtgccaagagaagggggaagagcctcttgtaaaactatcagatctcatgagaactcactatcaggaaaacagcatgggggaaccaccctcgtgattcaattacctctacctagtctctcccttgacacatgggaattatgggtagtatggggattacaattcaagatgagatttgggtggggacacaaagcctaatcatatcagaaggggttgtcaacagtctcagtttagtccacccaacatttcatttacagcatctacccctcagcacctgcctgtctgatacacttcagtatagcaacccatcttgccttaccttgttttatatttttcttcttcagagcatttgtcgctgtgtggttgtagatttccctcacaagactaagtccaattcatgaggttctttgttttgtccctttgctatgccccctttacaatcatagtgacttgtacacagtgggcactcaagaaataattgttgaataaaagagcaaatgaatgaataatgactgttgaacattggactcaatttacacaagtattagtggaataatttaaccaagaatattctgtcatttctgaacgtgcactttcaagtttctagggaaaaagaaattcatctatttgcccatgtatctatcaattatctatctacgtacctacctatgtatctacctatctacctacctgtctatgaatcatctatcatgtatctacctatttatctttcatatctatatccatatttgtatctatacctacttctacctatatatcttatttatatccacatatgatatgtaaaacagaatgaatgcagagcaatttatgggcaatgtccttcaaagagtaccattttaaattacttaggtacttcatatttacctgtaaaatacttaattctgtatggccttgcctgttgtttgggttatgaaataggttgaaacacagccttgagagatacatagagtccaatccaaggtcatttatttggttctaagagtggtagtttctctaacagaaactatctgcaaagatttgagaataaaattaaacagtaaatccatgagtcagattatcctagtgaatcaaccagaaaggggagccgtaaattcaagtcagagttgggagatttgctaatttgtaactcggataaagtaatttgcagactgtgtgatcccaagatgtggagaatatgtacttggtctttaattccaggaaggattaaaaagagaataattgctttgtatatctgtacaccaggtctcagataaaacacctgcttgccgagaagctacactgacttgcttaggaagatcagtccattgtttgagtaagcatgattccttttacagtgggtgtcccttacccagcaaagctgaatatcaagaatatagatgatgaattataagaacccatggtactcagattgattgtgttaattttgctaatcaagcaatgtttaagagaatgatgcatgattaaaagcttagcacattggctctgtcattccaatgtaaaatatattaggttgctgcaaaagtaattgcagtttttgccattacttaatgttgcattaggttgtattagttgtattaggttgatgcaaaagtaattgcagtttttgcgattacttctaatgttgtattaggttgtattaattgtattaggttggtgcaaaagtcattgtggtttttgtcattaatggcaaaatgacttttgcaccaacctaatacaactgggtaatggatttaacatgaaagatataaaagtattttaccaagttcattaaaaaaattgtaatgagggcaaacctgacacttcataggtttataaattctatttaatttattaagacgtttaacttttaagagttttttgttcgtaaggatatcagtaatttgaatgattcaaatattaattttgtaaatgttgaaaatattttggaggtttttgttttttttttttggttcagagaaagctggcccctgagtcctcagattcacatcaacaatccccatccagaccctttttcttttgaaggttatccgaggtcaccatctgcatcttgccaaagccaggacaggaagatgcattcttgcctggttctttcttccccttcagcctttcccaacacacacccattaattatccttcattgtcccacagtaatttctcagggatctagtcccatctctttattcctttactcgttccctgggatataattacagcctgataaccaggctatgactacggacttatcctcttcccattcattcagaagcagagacaggcaaggctttctgaaatacaggttagacagatcataagatccccagtttaagagccctcagcagcttcccatgagaaccccaaagacatccaaatctccaaatgccagcctggcccttctgcagtggaagcctgggtgtgcaacatttgctgtctttcctattccagtaaactgtatgccttttatgggcaggggagggaaaatgtcttgttcacttttataccatctgttctttgcacagtgcctggcccatgaaatgggctcaggaaaagttgaataaattaatgaactactaactaattatttgcctagctgatagatttccaactttgatcttccagttgtttgtttattcaaataggccagtagttttcagctggaggcgattttgcaccccccctagagatatttggcaatatctggaaacgttttgggctgtcatgtctgggaggaggcacgctactgtcatcttctgtgtagaggccaaggatgctgctaaacattttgcaatgcacaggacactcccaacaaagaattatttggtgcaaaataccagtactaccaatggggggaaccctgatacagactaaattgtaaattaaaaacgtatttagtatttagcagattatgttcaatgtttatttccaacaaaatattttattgtgagttgcccaagcctgctccatattttataaaatgattgtttagtaggactttctttgtgtaatgcatttttatgtctggtggtgaatgtagataatataagctttatatcaatgttccaattagctcgcctttaaacactgaaatacaacttgtattctccatttattctctagatttataagcaaaatagatttcatttctttttcatttgtgttgtacattaaaattaaacctgtgcagaaatattgtcatcctcatagtttttctctttgatgaacatatgtatttgaggattgtgagttagcttacaaaggttgaggggagttcagcaataacaccactaaaataagcaaaaaacaacaacaaccaaaaaaacatggtcgctatcaccttggaatgtagtgttcagtataaatccctaaaccaacaggttaatttgaagtaattgttttgctttcagaaatggagttcagcagcttcgatctatttatctggtgcaagtgattgagaatgaatgggcttggagaatgaacaggttcacacgtaccaggggatggatggagaatcagttattattcaaacagcatgtaggtgacttatcccagttgatccaagatgtatgtgtgtgtgtgtatatatatatatatatatatatatatgtgaaccaggaacatctaaccagtagttctcctggaaacagaggcatgccttacaagggtcacccattcaaataaatgggctagagtgtttgatttgggatttcttttctatgagagctaaacaaaacgcaactactttgtgatttgtaaattccaagtacagatttaggcagaacccagttcttgcttagagcagtcactgtcaggagtattaaagtactacttgtgagtagaggacttagtccatgatttaattatttaggcctccattggtataaattgatgcttctggacttttcatggtttcttctctttgactactaaacctctgttaaatccgtagaataatttcagccattagccagtcttatagctaatatcgttacccaagacatgagtaattaacaagttgaaacatttccatggcattgactcataagtgatgagaataccactggttagctcagtgcattgctttatatgcggcaaagtggaattctgtagatagaggcatatataggtgataaggtttggctgtgtccccacccaaatctcatcctgaattgtagctcccataattcccacatgttgtaggaggcacccagtggaggtaattgaatcatgggggtgggtctttcctgtgctgttctcatgatagtgaataagtctcatgagatctaatggttatataaaggggagttcccttacacaagctctctttcctgtggccatgtaggatgtgactttgttcctcctttgccttctagcatgcttatgaggcctccccagcctgtggaactgtgagtcaattaaacgtctttcttttataaattacccagtattgggtatgtctttattagcagcgtgagaacagactaatacaataggtatgcagatacatatttatcgaggaggtggctttacatttcctttctgttgctgatttttgtgaactagcctaaacttgactaatgttttccctgtgttatatacccatatatataaatacacacaaacacacacacacacacacatacacacacacaacagtgttaacctgacctaccaacaaagtaaggcagtctactgttcaggttgtggttttgctgtcactgttcttctagatatattatacttaaaaaaaaataaaagtttcggctgagcgccatcactcctgtgttcattagttttagagaaacgatagatgatcttcattggatcatgtaggttaatgtgcggtgactgtgggtggtagggtaattacaactcatgaacgctgcaccgtttgggaattcgttagacaaaactatgtggatgagatcttttcatgcctaattcctacagctattttggaatttatctaaggaaattgtcttccaactttaggaaaaggtcagaaagaattaagcctctggaagtctcagggtgtggtttatccctgccttttagaagtgagataaatcccactacttctcagatggagtgagagccaaagtaaagcaaaccagaaaacgtggaaccagattatctgaaaggagccgggtgcataccaacttttttttttttttttttttgacatcaccgtatatttttagttgcttgtgagtatcaaagagagttttgggagaaaatcaactgctgagggttaaggactgaatccagattgaagactttatctaatcatcagcaccttggattaccaaatttgtgtgcatcctttggagttgaaagtaccatgaataaaggcaagaaaaaagagggcagtcaaataaatagaaattggagatcatgtagccaaagctcctcaaacctatgtacatttggactttgaattgtcaatgggcacaccaagatttttgaagctttgactgtctataaggcttggtggcctcaccagcatgcctagttgcactgcatgttattgatatacagcagctggggccattctcctaagcatgatacagaagcatacatttgtgtgaagtggttttttaagcaaagcccacacgtgggacatctctccttgtggctttaagcactgatttccctgccacagtcttagtcacagggcacgtcagtgctcatgttgctcatctccatctttatgtgtattaagatcatgtagacatcttcaaatgtagactctgattccagcagtctgctacatttcttggcaactctcaaatgtgctgatggtagtaattttgtaaccaaaatggggtagccaggctctacccagcctgcatagggcttttgatttaacctaggtttagctgttcatctgctatatttcctctttgcctacattctaaaagatctcagatgagaatttctcctacgctcgtcaagactgtcgtttaggttttgccatcagtatttaggtttcccacaccacccacagtcaccccacattggcctacatcgtccaacgaagatcatgtgtacaccctacacatttgctaataattcatttacaaaatgttttgttatataaaaactgggagaaactaaatttacttatagagaccatctggtaatgcagtagttttgtaattctatttctcatagcatgctcaaattaaggattcattttagagcgtttcttgctatcacactgccacatctcactgctaaaggtagagctaccgatttctggaattttactgctatgtttttatttatgttggacagcggaagcagatttccaaagaggttatgataacagataaattggccaccaggatgctcccatgaatgcctggcacctcacgatgcaaagaagcagtgcatttctttcttttgttgtctgtttccctctccttttttacatcacataattaacaatcaattactatgcatctagtgcctgccagtgactatgattgatataaagacaaaaagacatagtaatatcttccatgccctcaaaaaactcactgtttatgagaaattaagacacatataaacaaaagcacaaaagtgatacatcttggtgaggattaggatagatataatattagctgacagatacaaaagagaaaaagggaggaaaaaaaagggagagaaagagaaagacagggcactgattctgttccaggcactgtgtgtcattctttacgtgctgaatgtttttatccttaaaacagccctacacaataggtctgattgctttcagtttttatcacgtttcataaaagagagaacttgcttttatactcacacagcaaaacaacagaaatgccggaattcaaatccaggcctgtctgatttacaagtcatgtttttaattgctcaggaaccttacctcctatcataaaaatcagaactcaaggcaggatgcctgaatctgcttggagatgtcacaaaggttgggtgagggtacagagatcacactaggaggaaaactggttaagctaacaggactccacttggacaggaagggattgttgaaaagcatttcaccttcagagaggagcctgcagtttgctgtggtgcggcgttcattgattctacagtatgatgtgatgtagggtggacagatccaggtatgcttacaggtctacaccagaacattccttaaatcctttgctgaggagcatgaacttagtccctcaggaggacaccttaggaggtttcacaatgagagatgccattgaaagttgagtgtgggagtacagtgaaaggttgaagctgcacagacacgatgcagttaagcagtgaccgccacagccaggcaagtgccggggaggacttgtacaaggagggctctgggtcagatacagcaatgcatggagagacatgaaagcctatatatttgtgacagtgatatcagattacagtagacttaggagttaatgagggtcaatggattgttgtggtcaatacatgaatgagcaaagtgaattagtaaatccttaatttttttcctgttctaaaattgtaaatatatatttagaaaccctaaactaacttgtaaaatgtgggaaaagaagagttgatgaagttgtttacttttatctgcatttagctaaaaagcattaggaataaacaacatgtatttttggagaaaatatctacagaaattaaaatgcagaattttatgaaattgttggaaacattaagattgcattttttttttttttttgagacggagtttcgctcttgttgcccaggctggagtgcaatggcgcgatttcagctcacagcaacctccgcctcctgggtttaagccattctcctgcctcagcctccggagtagctgggattacaggcatgcgccaccacacccggctaattttgtatttttagtagagatggggtttctccatgttggtcaggtgcattttttgttttacatttaatctagacattattatcaggtagatatctcattgatacacagtgttgaacatttttagtagtaaaataaataattttaaaagttgatatatatagtattactgtattttattggtttagagatatttgaatgctgctgtcagtatatctgaataattggtggatggtagtcaacatttgataagacagactatggtcggttgtcatttctaacataaatctgagcccaaagtctgtcatatgtaagttttatagtgctacaaaggagcaacaacaaatgcttgaaagcattttttataatttttgggggaaatatattgacaagaaatgtaaaattaaaataaaaatttatttcgtgatctcagttttgctaagaaaaatggtattagcttcaagtttaggcttaaaagagtttccaaagtgctggaggggttaagaggaggcaggccagttctccagacagccaaattattttttccaaattaaaaaagtcacagttgggggtatttttactcactataacataaagtctagaagtatttctcgtgtatttgtactttaaattacagatgctccttgacttaagatgaggttatgtcccaataaactcattataagttgataatgtcttaagctgaaagaatatataatacacttcacctacagaacatcatagctttgtctagccttccttaaacatgctcagaacacttacagtagcctacggttacggttgggcgaagtcatctgacacagtgcctattttattaaagtgttgaatattgaaaatctcatgtaatttactgaatactgaaagtgaaaaacagaatggtcatatgagtatgcaaagggtttctactgattttgtgtcacattgtaaagtcaaaaattcgtaagttcaatcatcataagtcgggaccatttataattatttagtgctaaaatatttatgagagagccactctgataaataacacacagagtgtctctgtgtgctttctcagcatctcaattcttagaaacagggttgctagaaatgtgtgtgtgtgtgtgtgtgtgtgtgtgtgtgtgtgtgtgctcacatttatattcatagatagcccaaattcattcccaggagttctaccagtttgaggtccaaccaggacagtgtgagagtgtaccagttaagtatacgtgttgctaaacttctaaagatttttgccaatatgatagataagaaatggtgtctaaatgcagttcatgtattttgctcatttcaaaaattcatttatttgcaacttgttttctctgttttcagtgttctttcccctatagagtttttttttaacatgtgaagaatattaaccctttatctttcatgttgcaaataatttcactcagtctgttttttcttgactttacttacggatattcttttaccctgaaaaatatttcttatcaaaaaatgtactgtcaagtttattgacttttcattgcatttgtatattgagtcatacttagaaaccatttccccacaccaagtttagagaagaattaatttcctttttagtatgattgtatgcatatagatatgtgtttatgtatatgtgaatatatgtttatatatctgattcatttggggtttattctcatgtatggtttgaagtatggatctaaattcatcatttttccagatagctacccatttacaccattcattaaaacatccaacgatttcagttgtcacttttatcatatactaaattttcttatgtgtttgaatctatttctagatgttcaattctatttcactagttttactgtgttttcatgcacccataatgcattaggttcttcatcaatgctttactgtgtatttaaaatctaaaacagcttgacccctacctgagttacccaaactctgaggttaagggcacagaccttgagaatgccaagtcttcccaatatttctgacaccagctgcgagtgtgagggtttcctgaaatcatcctcaggtttgatgtttgctagaaaaagtcacagaattctctgagaccttttataatcatggttacatgtagcatgttaaggatacaaattagagccagccaaaggaagagacatgtggggcaaagtctgaggtatgcaaacagagatcctggtaatcctttccctgtggaatcatccaccttgttatctcctcttggccacaatgtgtgacaacacatatagaatactgccatccagggaagcccacaggaacttcgcagtccaggtgtgtgtgtgtgtgtgtgtgtgtgtgtgtgtgtgtgtgtgtgtgtgtgtatatatatttttttttgagacagggtcttatctgtcacccaaacttcagggcagtggtgcaatcacagctcaccgccatctcgacctcccaggctccatcagtccttcaacctcagcctcctgagtagctgggattacaggtgcttgccaccactcagctaatttttgcttttttgttgagattgggttttgccatgatgtacaggctagtatcaagttcctggatgtccaaagtttgtactggagcttattgattaattggccaactggttgaactcagtttccccttctcctcaccttagagatcaggccgattacacatgatatgaagggtccactattaaaaacaaagacactcttatcacttgagaaattccaagtgtttagagtttatgtcccaggagccagaactgtctgaggatgaggttgatttcttccttcacagccccttctagctgtccacacactttctgccaggggtttttattgctcttcttgaacattgattactccatatgaacttcagtcagctaaactaactccctaaaatattctgttagccggctgcagcggctcacacctgcaatcctggcactttgggaggccaaggtgggcagagtcaggagttcgagaccagcctggccaatatggtaaaaccccgtctctactaaaaatacaaaaattagccaggcatggtggcatgtgcctatagttccagctactcaggaggctgaagccaaagaattgcttgaacccaggaggcagaggttgcagtgagccgagagatcatgccactgcactccagtctgggcgacagagcaagactccgtctcaaaaaaaaaaaaaaaaaaaaaggttttgttgagccatcctactcaagaaaggggatactttttcatttcttaaatctgtgtttgtgtctttcaggaggatttttaagtagacccattctaggttttgcacatttcttgttacatttattcttaagtatgttatcttctttggtgttattgtatgtggcactttttctaacattatatacactaaattatttctttaaggatatattaaggctcttgatttctgtatgttctgtatgttattttattttattttattttattttattttatttttgtatttttaatagagacggggtttcgtcatgttggccaggctggtctcgaactcctgacctcaagtgatctgcctgcctcggcctcccaaagtgctgggattacaggcgtgagccactgtgcctggccaattgtatgttaatttcttccagctcctttattgaattattttattgttttaagtaattgtgttatttgctaaggattattgtttctctaaggtttttcagatttcttctacaaaataatggaaatgttatttctctttttaatttttatacctatagttggcttatttgttctgctttcaatagcaaacacttctagtttaagattaaatagcagtggagatattttgcatccatgcttgcatttatggaatgaatcctacttggccatggcatattattttcttaatgtggcgttggattacgtttgatagtattttatttagtatttaatcaccaatatttatagctgatattggtctgaaaaattattttattattcactggcatactttttagttggcatctaaattatttcatacgcctatagatgtattcaattataccttcatatgatagtaacttgaaactgttatccatgtagatgaccaaagtctcctttagcatttggccatttgacattattattctttccttcttgaattaatatttccttttacttttgtcgaagaatgttcattttaatataataaatattttgaaaatgtttttatgatatcaatatccctctgaaatcatatatggatataaaccgaaaattaaattttttctaattcctaaaacaacatgttcttatatgttaacgttttcctgtgacttatttagaattatatatttttaaattatacttagtaaaaacataactatatacataataaatatgtcctgagacatacatttttatggtggaaaattggggacaggaaaataacaggaaactgcataggcctctaaatacccaatattctcatggtccaatcatctattgttttactaatcaattggggaccaatctattgtgtgcctcctggaatcaatgctactatgtcagccagtcacttgatccagaaattccagcactgttaattaatctgcagtagataagtaccatctggtaattgcaactcacaggagttgaagtcatagatgcttttaccgaagtctagttcactcatgcttgcctgggacaaatgagcttacctcatttaagctctgaataacatgctcctaccacacccaattcgtatacttgatttttaaaattctgactgcattatagtgcaattttactcattcccaggaataaatacatatataatgaaatatgttctttatatagaaaaatatagattgttggaatggattttgaagtttcacatatgtgttttatttttctgtgtttgcttatatatgcgtgtaatatacacctaaaaggttacaatatacacctaatataatttaatatacaactgaaattatggatctattaatataaaaagaaagaacattagaggagaaataattgaaggtaaaattaactttgaaattactcttaattgattcaatagataactgttcaaaataataatatcaacagtatattagattatcatagcttatgggtaagtgaaacaaatgatagcaatattataaaggaagggaggaaggaattgcaaatcctcttctgaactacccatgaaatgggataatatgattttcaggtatatttagattagtgtaactctggtataaattcatggtcaaccactgcagttgtttaaaaagaagaataattgggctgggtgcagtggctcacgcctgtaatcccagcactttggaaggccaaggcaggtggatcacctgaggtcgggagatcaagaccagcctgaccaacatggggaaaccctgtctctactgaaaatacaaaattagccgggcgtgggggcacatgcctgtaatcccagctactcaggaggctgagtcaatagaatcccttgaacccggcaggcagaggttgtggtgagccgagatcacaccattgctctccagcctggacaacaagagcaaaactccctctcaaaaaaaaaaaaaagaaaaaagaaaaagaaaaattgatatgttcagagaggagagaaaaatggacatatataaaatgctcagtttaaaccagagaagagagaaaatgagggaggattagaaacaacaacaaaaaacaagtactacagatgcaaaacagttacgaacttggtagattttaatctcactatatccttagttgttttaaatgcaaatggtctagatacagcaattaaattcagacactgtcagaatgggttttaaaaaaagaagatccaaccatatggtgtctacaaaacccattttaaatatagagacagattgaaaataaagggacagagaatgatatgctaatactaatcaaaagaaagcaggagtagctagctatacattaattacagacagaacagatttcagagaaagaaaaattatcagtgatgaagaagaatgttacattaagataaagtggccaattcgtcaaggaggcataacatgtttaatgtatgtggacctgactcacaatacatgagacaaaatctgaaagctgaaaaatatcaaaatatttgcagattaaacaccacactggtaaataacacatggctcaaaaaagaagtctgaagagaaatttaaaaatacttttaagtatacgaaagtgaaagtaaaacatcaaaatttttgatatatagcaaaagcactatttatagggaaaaatcatagcattgaaatacatatattagaccaggcgtggtgactcatgcctgtaatcccagcgctttgggaggctgaagcagacagatcacaaggccaggagtttgagaccagcctggtcaatatggtgaaacctcgtctctactaaaaatacaaaaattagctgggcacagtggtgcgtgcctataatcccagctactcgggaggctgaggcaggagaatcacttgaaccctggaggtggaggttgcggtgagccgcgatcgcgccactgcactccagcctgggcgacagagcaagactctgtctcaaaaaaaaaaaaaaaacaaaaaaaaaacatatattagaaaagaagaaagactcgagtagctgaagctctattttacgaaacttaaaaaaaaagcagaagaaaaaagatcataaaaaatgagagcagaacacaatgaaattaaaatttaagaaaaatagagaaaaccaaatgaaggcaaaagctggttctttgaatggatcaatacaattgataagcttctagctagtctaaccaacgaaaacacaaagaagacacaaattatcaatgtcagaaatgaaaggaaagaattactactaactccacagacattaaaaggataatgaaggaatattatgaacaactctatgcccacaaatttggtaatttggataaaataggccaactccttgaaaggcaaaatctaccaaaacctgtacaaagagaaatagataatttgaataggcttatatatatataaaagtagttgaatcaataataacttccccaaaattactggtttccaagtgttcacagttgaattctactcaacatttaaagaagaaatatttcaattttctacagtctgtttaaaaaaaggcaaacagaagaaatcttcttaactcattctctgaggccaccattatcctgacaccaaaaccaagtaaagacattacaagaaaagaaaaacagatgcctatatttttcaaagacatagatacagaaatttctaaacaaaatattagaaaattgaatccagtattaggaaattgaatccaataatgtattaacagaattatacatcgtgattaccaaatggaacttattccaggtatacaagagtggctcaacatttaaaaattcattaatgaaaagaaaaatatcatatgattatatcaatatatgcacaaaaattgacaaaatccaaaacccatttgggataaatatcctcagcaaactaggaatagaagggaactttctcaagttgataaagggtatcttaaagaaaaacctttagctaacatcatgcttaatggcgagaaaatatatttactcttaagatcaagaagcaagcaagatgcctcctcttctattcaacaatgtaatggaagttctagttaatgcaataatacaaggagaggaaatataacatgtacagattaagggggaagaaataaaactgtctttcttcacaaatgatatgattatttatgtataaaatctcaaaatcaatgtaatcttgtaactaataagttacggcaaggccacagactacaaggttaaaatgcaaaagccagtcagtttcctataggccaacaataattattggaattattgaaatttggaattaaaaacctaattagcaccacaaaagtgaaatatttaggaaaaaaacctaacaaaatatgtataagagctacacaagaaaaatacaaaactctaatgaaaataaaaagtctaaataaatggaatgatattccatattcatggatagaatgactcaatgtcagttcttccaaaattgatctagagattcaacacaatttccttgataattactgagctaattgcttcataagtcaaaggtagtgttggggtgcagagaataataccccaaagtatgaggtgctttggcatgctgaacatttttgaaataaaggaaattggaaggccttagaagctgccttagaaccaaggactttctaaccctcccttgtttctccccacatcctcaagcgcagggaggggttctctctggaagttccttcctctgactgaggaaaacttcttctgaaagaaatgcagttgtcttaagatgccttccctaggaatctcatcaactaactgggaaagtttaatactggagaagagaaaaaactaaatgtagtcaccatgcccagacagacttttcctctgtttttcagagggcagctcgtagagattacctaagaaactttatctgcataataaaacaatctttgttcacagtggatttctaccccacaccttctgtcataacttataggtcccatttagcttccaaagacaatcatttacaaactattttctgctctttgggctcattcaattccccaaaattattatttactactcctcaaaattgcctacacctcccatttctgtctcctcataaataggatatttaagcctcaaccatctggcccttctttgagtcttatattttatatggctcccatgcttatatacattaatacatgtgtatgccttttctcttattaatctgtatattgtcagttgtttagcactttagagggaagggaaaattccttttgcccctacagtagtttcttattgcaaaggatgtgacaaaaaaaaaaaaagatagattcacacaaaatcactgcatcttacaagagtccactggtaagagaaatggaaatgcaaaagacacttgctccattggagaaaaaaattgtcagtttcatctctttgtctacacattttgaatttgttctcatgttgaaataacaatacagtaattattcactctcatatttatgctatcatgttcagtcttttgaatatgccagatgtcagcaattggcagcccgttgccaaattcagtttgattcctgtttttgtaaataaagttttattggatcatatcccaggttattgatttgtgtatcatctgtggctgcttttgtgctagtggcaagttgagtagctccgaccgtgaccacgtggcttgcaaagccaaatacgtttactatctgactctttacggaaaatatttacagatccctggcatttataatttttagaaaaccttcagcacccacaggaaatgtgtagcagaagtacagctggtttgttaagttcaggactgccctaacagggatactgtagctttgttttaagttgtgctaaagaaagtacaaaaagtatatttatggttggctgtgaagaagactcaaagtaaaacatttttatgcaatacatatcaatgtccgtttcacaatggtttaatttatgctgtaacagtgtgtggtgctaaagttgttttataaaaatcattttattgcaattataattctattatacttaatggatggttgtgccagccaaaaaacctactctactaaaaatagagttttaaagatagaatggatcttagacataattggattcttttttcaagagggaaaatcatactatagaaattaagattttttctaatgaccataccgtgattgaatatcactttacctctgaacccgcctgaacatattcttgaaagaaatatgaaagtagttcaatattggacccagtgtcattgaacccaacctgagggtctacaggcaattttttggtatttgactgattgcctactatatttttccttgttatttttcttcttcatttggtggtaatctaataaataatgaagcatgccctgcatcatcaagatggctaactttccatgtgacccattatgaggtctgctacctttgtctgtgtttccaattgtttggtgccaaataatgccctttaattgttgaaggtagtaaaaaaaagaaccatggatgaggggtgccagaatatgccacctcaaaatatgcctctttgatatatggattattttgagctaaagatcattgagaatcagcagacacaggaaaacctttagaaacagggcacaagattttgtttcatatgtaaatttacatgggtaaagaaaatatccatttgtcaaagatatctccttctccaactatcagcaagagaataattcttttttttttttgagatggagtctcactccgtagccaggctggagtgcagtgtcgcacgatcttggctcaatgcaacttctgcctctcaggttcaagctattctcctgcctcagtctcctgagtagctgggagtacaggcgcgtgccaccatgcccagctaatttttgtatttttagtagagatagggttccaccatgttggtcaggatggtctcgatcttttaacctcgcgatctgcccagcctcagtctcccagagtgctgggattacaggtatgagccgctgctcccggccagcaagagaataattctaaacaactgttatttaaatgatttaaatctgcatgagaagccttactaatcaacccttgcttactacactttacctggtcatctttccacaacttgcctcccccactgggaaacccaaagtcctgtttgttttgtttagcctaagatgttatatcagcccaaatccgaccacaccttagagttaatcatccttgtctgctcccatgtatacatgtgtaaactagaaatacaatcctaaatgcgccaccaattgaatgaaccccttttggccaagaggaccccagcaaaaccttaaaaactgaattactggccatgacaggaaggggagtcaacacacctcatcataacccctccattttggagtttaggcacagcaactgaccaggactgatattaaaatagacatcataagactgacaaagcagactcattgtggcagtaagataccaaattataaataagacctatggccaggccagacaatggttaagtcatgcctgtagggcatcaaccttgctacacagcatccttatcttaaagatgcctttctgctgactccaagtttgagacagagccttgctctttaaccaattacaaattaaagaatctctgaatccacctatgatctgtaagccccctctgtaagctatctcaccttttggggctggaacaatgtataccttctatgtactgatttatatttttccctttaatttatgtctccctgaagtgttaggttggtgcaaaagtaattgtacttttcgccattgaaggtaactgcaaaaatcatgattacttttgcatcaacctaatataaaaccaaactgttaccctgcctcccgggtttttctcaggattccttgagactgtgtttccttggactgaattcactcattggtgcagaataaacatctttaaaacatattagtgttttctttttctgttaacgcatgcacaaggcatgtggtaatgaacttttgtttttctcttgttaatctgtcttttgccagttcattttacagggccccacccagagttcctaagatgagtagagaaagaaggtattattttctcccctaccctgtccaggtacataaatgatgcatttatttttgtgaacaccaaatggcctcaacccaggttgcttgggtgaacttcactgcgtgtatgatgagcagaggtggccctgatggttttgtgcatcactctgctgttggctatgccagaatcagaacacttgcatgcggtagctgcttccacaattatgttctgagcaaccatttagtctcagcaaagcagcagcttccatcacgttcaattactgctaatttagattttattgctctgtagttttgtttgcttttaactgacaaaattgctttgatttcattgtcttataaaagctaaagatctatgagttaatcatttgtatttgtatctatatatattatgtatataaatgtatctacatatatacattatgtatgtaaatgcatctacatatatacattatgtatataaatgtatctacatatacattatatagaaatacaaatatatatacattatatagagatacaaatatatacacattatatatagatagatgtagatatatatatttatacatatgtacatatcaagaaggtaatttaagtcaacactagaagtcaaggagactgtttcttttatcattttttgatgtttgatttattttacaaaattgtagaacatatacatgacataaaatctaccattataactatttttaagtgtacagttcagtggtattaagtacattcatattactgtgcaactatcactagcatccatctctagaacttttttcatcttcccaaattgaaactctatacccattaaatactaccttctgattctcccctctctccagccctggcaaatatcattctgctttctgactctgtgaatttaatgtcttgaagtacctaatatgagtggaatcatacaagtacagcatttgtccttttctgacaggtttatttttcttagcatgcctttccctttgcaggacatcaaagcaatgcacatgtttgagaaagtctgtggtctcctataaagcatttacacctggctcttctaagttaacttttgtcacacatgcacaggaatgtgtgactgcctgaggaggtggattgcagatcacgctggctgtaaatagtgggagtatttccatagcctagcaatttgtggggacacatcaactgaagtagccctgccttgctgtttttacttaatttagcaggagaggtggggctgctgaaatttagcccctctcagggtgggctatcaggtcagatttcatatttgtgtcatgtgtctctttgttctataagcctttagttgggtttggctctggaagctcagttgcaggcagactgtctactccagctgccaaaaatgagcaggctcccttgtgttgtagcctgggctccttatagaatcttggtgtgatgtgctgccagggctgtcctgctgagagacagtggtgaatgcttccagggcacgatgtcccataatgttctagactctcatttctgctgaccttttattacatatgataataatgatggtggtgcctacaatagtggttgatattttctagaagaaataatacatgtggattgattcctccagccacagaagcatggtttcctctttttagactattagagttcattcaaacaacatgtgattgggtcatgtattgttcaccagtataaacacagcacctatatactcggattgcctctcttcttttctggttgccttgagacaattgaaagaaactacttggtgtcagggccattgtaaacactggtaatggccaggtactgattgatcatgatggaccttgcataagctgttattacttctataaaccttaattaagaagggggtgtattagtctgttttcatgctgctaataaagacatacctaagactgggtaatttatataggaaaaaggtttaatggacttacagttccacatggctgggaagcctcacaatcatggtggaaggcaaggaggagcaaatcatgtcttacatggatggcagcaggcaaaaagagagagcttgtgcagggaaactcccatttttaaaaccatcagatctcatgacacttactcactatcatgagtacagcatgggaaagacctgtccccatgattcaattacctcccaccaagttcctcccacaacacatgggaactgtgggagttacaattcaagttgagatgtaggtggggacacagccaaaccatattagggggaataaaaagtctcttcttcgttgcaattttttttttctgctctaagctgattttgctttgagcactgtgagacccatcatttatttcccattgatgcacatataatattttggagtaacttctgaccatttttctccttgacctctcttctccacttattcaccaagtccaaaagagtcttcccgctaagtgcatcttgtagtgatcactcttttccttctccttacccataggctaatcttttcattagactttggcagtagcttcctagctcatattgtgttccaccttcacccccctcattatacaacgaatggggttatcttcctagattcaactctgctcaaaacttctgttggtcagatattgtaacaggtaatatttaaggccctataaaatgtggccattatgagaatttctgttacttgccacgagaacacacttacgtgatttttctacttcaaacctctcatagccaaactgtcatcttatgtacatatattgtctgctgattcatagaacctcaaagctctgtgtgaagcagtcctccctgcctccctccttcctcctttccttccttttcaatcttacccctcattctctatgcaccaacaacactatcttcctttgtatctgaatacactaagcctctcactgctcagcatcctttgtagacagtgttccctcttctggcaaacgcttctctaaacctcttcacatggcttcatggctgctgcctttttatctttccatttgcaaatgaaatgtcctttctgtagagaattcatggattctatttcttgcaatgccttggtaaaagcagcctcccagaagtttcatgcaacaattctgtctacagcccacttgtaaacacaagaaccttcaggctttttctgctcatgtatggcaaaaattacatactccacattttttgtctactacatgtgacaaatttaccaaatgtttttaaggtcatcaggtatctagcctaaaatatcagtgtctttgctgcctgctcctaatataagcaatgccacatttttgttgtaattgttattgttatttagcaccatacttctgttatcattttccatagaggttaggacataagctaaattgctgtaaaactgagatccaaaaacatggtagtgcaaacaagataagaatttatttctttctgacccaattcagccccaactctgtatatagttaggctttgttctaggaagccatcgagagatagggttttttggcttgttctcttcctcaccaataggctgcctgctgcagagtgggtattttatttctcattcagcctcatctcacctagtatttgttggtgcttgtccccatccagggagacttttgcatccaacttgacatatcctgcctgcactgatttcaacaagagctcattgttttagcccttcatggaggaccttcagttttggggagctgacctgtgctgacttagctgagacctgcagatgcagataccttctctaggcaccttcctaccacctattgacagttactctgatagcctttcattacacattgcattttgatgttacacatttttcccttcgttttaccaaagatgaaatttgtgtttctgcttcttatttgcctaatttttaaggggtgatttccaaggagctctctggaagtcaggtgaggggggtgtaaataatgtgaagtgcattatttctctgacataaggtaactttaaacattgaactcactggggcactgaggccataatgtataaaaatttaagctaaacaggaacagagtacacatcctaacaaataattttaatttttcttatttctacatatggtgtaaggagcatcaattatgcaccattttagatgtgacctgttatttaatctgctccagatatgaaagacaaaaggaaaaatggtgacttagcaaagttaagtaactgtgatggttaattttatgtgtcaacttgactgagccacagggcatccagacatttggcctaacatgattctgcatatgtctgtgagggtgtttctggatgagattctcatttggatccacagagtgagtaaagcagattgtcctccttgctataggtatggcctcatctggtcagttgaagacctgagtagaacacaagggctgagtaagagggaactccttctgactcactacctgagctggaacgtggatctggaacattggtttctggagttcagactcacagtgaaatattggctgtttggggtcttgaacctgtcaccttgtggactagaaattacaccattggctttctcaattccctggacttgaacttgaactgggctctcctgagcctcaagcttgctgactgcagatcttggaacttctagcctccataattccatgagctaattcctcataataaatgtcttcacgtataggaatgggatagataggggcgtaaaggaatatcttaaggaattgaaatgtccaatatttgtatctgagtgttggctgccctggtagaagcatttgccagaattgattgagttctactgtaagagtcctgtattttgttggattcaaattatgccccagtaaagccttattaacatgtcaagaaaatcacacaactagttaatggcagagattgcattacagcagatttctgtgtaatctccaagtgcatactctgacctccatatcacactaacctgcacagtgggaggtatatgcagtgactaatagtgattaccaatatgctacttagaaacctttcagggttcatgttttctactccagcatttcttattaatttgaattatgagttcgtatttagttagacaggatgatcgattgagattggtgtttttcagtgcattgcatttattacattccatcaaggagtaaggagatggcacacaactgaattctccaggtaacttaaactccagtgtaactttttcattgatcaaataaatgagctgttagactggttgtcatgggaaatcttttaacaagagtgatgtatatcccctccttcagggtataatgattattatggagccctttgcttgactgccaatgttgtgaacttcagctcttcccttctgctgtgtgtcttcgtataggcagacagatagctataccattacaggcttacattcagagtcataaggaggcgaatttctttttgttcccacacaaaatggcaatgagatggctgagttttatttttttttccctctgttttttaactggcagaacatcacttctcagttttcaacactgcccatttttctgacctccctgcttagttctcctttctacccagtttattatctcttatagttgcctgtataatatcaatgcatgccattacggaaaatgctcagcagtcataattagaagacacacactgatggaagtccttgaatggtgagcattcctttctaaatttgtaacagctattttacctgaatgcatcatacgtttttgagaaccagtaggtttgttggagatcataaattttccatgtatatctagtggaaaatggagaagtgcaagcgaattacggcatgcatcagctgaaaaagcttttcgtattttgtgtggcgtgttttattttgtgtgtgtggcatttggtggtttcctatatgactctaagccagattcccattggctttcagaccctttaggcaggcttggtacgcagtggggtcttttccaggaacaaggttgcatgatggactgatctataggaacctcagagaatggaaaaatcagaaagaaattgggaccaattcaaagccatagtctttcaagagagggtagtcctcagtaaattaatgtttcctgattcaaatctgtctccaatccagggaacttggacttatttctttgatttttacttttaattttaattatttcttttcttattttttttagaggttgggtctcacttgttgcccagcctggagtgcaatggggcccctatagctcactgcagcctctaacttcagagctctagcaatcctcccacctcagcctcccaagtagctgagactacctgtgtgcaccaccatgcctggataatttttaaattttttttgtagaaactatgccagccaggctggtctcgagcttctagcctcaagtgatccttttgccttggcctcccaaagtgctgagattacaggcatgagccattgtgcctggcccatgaacttgtttctatggaagagaaagaatacaagtctaaacaaaacagcagcaaagtaaagcaaagcctagcattttgtgtggcatgttttattttgtgtgtgtggcatttggtggtttcctatatgactctaagccagattcccattggctttcagaccctttaggcaggcttggtacgcagtggggtctagtatggaaagaacaaggatcctcgttccatttcagggcagagtgaagctaggcaccccatttcgaagcctcagcgtgtggtgcaagtgctcacttgaacatgctgcatggtagtgcctgagtcagaggtgtccgctatggtgttgggaagaccagtatcacacctttgcaatggaatattttagtgtgtacagcagcatgaaatgccataatgataacccatatttattttttgaagatgatgatgctttctcttggttttactaacttcttacagagttgcatgctgtgatttcaatcaacaccatgaaatctacacatttttgagaaagttattgtaaaatactggactaattgttgggaaaagttgggaaaatcctgctgattccaccaaatactgttgacctttagcaaatagctggttcactttagatttgaaatcatatcctgccagcatagctgaaagtttgctgaaggaggccaatacatttggccaaagaatcagaaaccactagtgtagcagaaacagaatgaaaggcctaagagttaattccaaatgctcggcaacagcgctaccaaagttgtagaatgatggccagagtgtcatgttcttgctctgaggaatggtttaattgaggtatgaggcagaggcacaattttttcaggcacaaggaattgggggtacaatgctccggtttttttttttcctctttcctttcacttattggaggcagcgtgcctagcgagagcatgtgttctagtctgaccctctatgctctaagttttacagggtcacattcccacttaatatgcggggactgggatggtttaacatcgctcttgattgggtgggaaaataaattcttctgggatttggatttattctgtcattgataagacacaatagcaataaaatgtctatgtagaaataactagttcccactgaaatctactgagatccttaggttcctttggggaaaacgggtaatttttttgagtttcttcttctgtaaaagggtgtgggaagagggcttctccctgcataagtttcagatttgttaaactttctttagtggagatgctgtgtacattgtttacttctggttgttgaaatagaaagtaatcatgggcatacgatttccaatgtgaatttcaaataattttaaagatgagtcataaaaggaattttgttactttctggtaactggcgtgatctaacaacaagcaaacattagctaaatgaaaaatgcatccattcattttgcccaatgggaataatttatttatacaataagcaaagatactgcttttcttgtttttaaattttgatattaggctgatttattttttcttctttggtgtctaaaagtctcagaagttgactgtagtatttatttcaaaggtcattatggtggttgtctagccaatttggcatctcttgtttcttgtatattcccagttgagtctatgatgtgaatttgattctatgatgtgaatttatgacttatttatatggttttggacagttttttttaacaatggtaattcaaacttatttttaactgtgcattttggttttggaaatttcccatcctgtcttgacatttggagatggattttaataatttacatgtgtaaacagtagaaaatataacccatttgtgaccaccaagaataattccaggcaccaaggagacattggtgggaatatggagtctcctgtgcactctctttgcatttccacaagaacacctattagcacaaaactcctggtcactctgctttgcactcactagccccccaggtggacagactcctcgtacctactgtgagcttgggacaagcagtttggagtacatagctctttcttccctcttaaccttcacttccgggatgcaggctacccagcaagagcatgtgttctcatctgatcctctgtgatctatgttttacacggtcatatccccatataatgtggggtgggtgggatcacatagcactgcccttatttgggtggggaaatgaaatctccttctcagatttggttttagcccatcattgataagcatcccatgcatatcttctaatctagccttcatcggccataaaggtgatagttaacctttattgccgatgaaggctagattagaagatatagtttagatatatagtttcttagtcatttccccaactgctttgcagaagacaaagaagtgtgatttgagaaggctcaaatactaaattctagcactttatctgtgagccttgaggaatagacatggattggaatttgagaccacaccatgaagaattgagggaggttttgagtaggggttgggctcatggcttcaggccttgggatgaccaagtggcttggctagagttgaacttttttccctttggtgggccactccagttttggtcatactgatcgtagacaaatgttttcacagtgacaggttaccttaggcagaccttccagagaaaaagaagaaagagactagcctgagcatgcatgtatgggattcagcaaagatgcgagtcttgggttgcaggaggaggcagcttcacattggatcacacaggccttaaacatacaaatgtctccacagctactgggaggcttgaagacttctaagacatcatatatgaagaaaggacttgattccaataaattatatatatttttaatatgctgaattctcagatcttacggggtgaaaattggcaatcttgtttgtttgtttttattgaggcaggatcttgctctgttacccaggctggagtgcagtggcatgatcaaggcccactgcaacctcaaccacccaggctcaagtgatcctcctgcctcagcttcctgagtagctgggactacagatgcacaccgccatgctcagtgatttttttttttcttgtacagatggagtttccctatgttgccaaggctggtgtcaagcaattttcccaccttgacctcccaaaatactgggattataggtgtgagcccctgtatctggcctcttttgcctttttttctttaaaaaaataaggtgttttatagtcaggatctcctgtcaggacttgaaattgcattgagttcaattgtgggactgtctgtgtttggaaccacgtaaatatgtgaactttaaggtttcctgaaatttatttttttgtcttgatttcttaatttttttaattgatatatgataattgtacatatttatggggtacgtagtgatatatatgttatgtacatatgtatagtgatcagatcggagtaattagcatatccatcatctcaaacatttatcatttttgttgcgttgggaacattcaatgtcctcctcctggctatttttagaaactattaataacaagcggtcattagcagaagaataaaaaatagctgatcaactctactgcatttgaagttgttaactgcagttacccaagtaaagtatggagggaaagtctcttgaattatttcttcaggttattaaaagcctctcagcaccatatggactaagttagttttaggtttgaatattatttcagcttataaaatgtctctaggtgtcaaaacccaattgtagcatgacctgtggcagagtggtagattttaataagtgaatgcatgaattgaaatgaaatgacatgtcatttctataaaatgactatgttatcatcttgattgaaggaaataagagaaattagtcaacttggtcattgcaaaccagaataaggcaaattaaaggtctttgtctgaacagttctctgggaatcagatttgctcaggaaaccagggagtaactggagagttccagaatgcatgcttctgtggaaactctggaaaactcctcaaaaatacattctagaacaccttagacaggtggaagctgggtcagaaagcacaagagaataaaggaactccagttcagcacttaataatagttccttcttgaaggaagattgatttccatgcaagctgagcttttaaaaactcagccaacttttcagaaaggacatagaaagagtagaggagaataaaacattagaatctcatcccactaatggagaaaaaggtaaagcccaaagaattgctactcatggtttagaacattcaaatgcagaaaaaagtcagttatgagtagaacaagacagaggatgcagttgtccacagactgctagcaaaatagctcaaaaatgattatcactggagcttatttagatttctgctgagggtgattctccagtatgcagtacaagaaacctgagtccaggtttgggtgggctgaactctaaaacttttggagcccacaatatgtaattattacaaatttatttttaatttttttttttttttgagacggagtctcgctgtgtcacccaggctggaatgcagtggcaggatctcggctcactgaagcctccacctcctggattcaagtgattctgctgcgtcagcctccctagtaactgggattacaggcatgcgccaccactcccagctaatttttgtatttttactagatacggggtttcaccatgttggccagcctggtttctaagtcctgatctcaagtgatccacctgcctcaacctcccaaagtgctaggattacaggcataagccactgcgcccggccagaaaatattacaaatttaaatatagaaaatgaagtaagaaaattgcacagctatgtagactcggaaaagaaatcacaacaaaatgcaaattttagaaatctgacaaatatcagaaacatcaaatatccagaaaaaaagagacaataatgtcttaattaactgctaaacttccttgtgtaatactttttcattttattgcttcttcatatgacagaataacatttatagtaccactgttcataaagagacttgaacaaaaattcttgctgctagcatttaataatttatggctgggtgtggtggctcacgcctgtaatcccagcactttgggagactgaggctggtggatcacctgacgtcaggagtttgagaccaggctggccaacatggcaaaatctcatctctactaaaaatacaaaaaaaaaaaaaaaaaaaagttgggtatggtggtgcgtgcctataatcccagctactcaggaggctgaggcaggagaattgcttgaacacaggaggcagaggttgcagtgagccaagatcacgccattgcactccagcctgggtgtcggagtgagactctgtccccccccaaaaaaaattatttatagctttaaatagtttattttatcttcaaaagtcattatgagtaaagttatttaaatttcagagattgtgtcaaatttaggaaaacatgttgcaaatttctttttcaactgtgctataagagtagaagaaacttccacagattaggttcttgttttatccatttcaagtcttgtttcttttgtatttcaaacctacttgctggaaaccatagaacattttcatgtagagttgatgcagcacactttcatgtcatgtccccaagaaagtcagcacagtgggtgacaagaggattcctggaagcctctcctattctagaatgttgctgtggatagaatagtgttcatccccccatatgttcacctgtcctaggcctcagaacctgcaaatatgctaacttccacagcaaaagggcctttgcagatgtgattaggaatcttgaaatggggaggctagtctggattatccaggtgggtccaatataatcataaggtccttataagagggtcagagaaggagacataagggtgaaagatgagattgcaatgatatgggtgcacaagccaaggaatgcaggaagtcactagatggtgaaaaaggcaaggaaacagattctcccctagagcctctagaaggaaggtcagccttgataacccaatttggacttctgacatccagaactgtaagataagaaatttgtgttatttggagtcactacatttgtgttcatttgttacagcagtgtattagttcgttctcatgttgctataaataactacctgagaccgggtaatttatgaggaaaagaggtttaattggctcacagttccacaggttgtatagggagcgtgactgggagtcctcaggaaactttcaatcatggcagaaggtgaaggggaagccaacatgtcttacatggtggaagcaggaagagagagagtaaaggagaggtgctatatacttttaaacaagcagatctcgtgagaactcactcatgagacagcactggggggatggagctaaaccattagaaaccacccccacaatccaaatagctcccaccaggccccacctccaacactggggattacaattcaacatgagatttgggtggggatacagagccaaaccatatcaagccttaataggaaacttatatagctgactagcattaccttaagtatagaaaaaatgttgagatccaagaaaaacgttctactaaatggaaattaaatattatcccaactcattcaactcttaacatgattctcaaaatgtacttggatagtcctccccaacctaatttgaagggtaatacaatgggagagattttgacagcaaagacacatagaggtcttaattgattgcagtgaaagtctcttacttttgtaattattgcagtaatattggccaggtgaactggaccaattattagcgctcctggccaggattccagttaggcatgtgaagtgattcactcaagtgcaaggttcctgtccttacctaacattttaatattttgttcattgtgggactttcttgcattaatttagattttattttattttatttttatttttttctgagacagagtctggctgttgcccctgctggagtgcagtggcacgatcttggctcactgcaacctccatctccagggttcaagagattttcttgcctcagcctcccgagtagctgggattacaggtgcccaccaccatgcccagttaatttttgtatttctagtagagacggggtttcaccatgttggccaggctggtctcgaactcctgacctcagatatgcccacctcggcctcccaaagtgctgggattacaggcgtgagccactgtgcccagccagattgttaaaataatgcattaaaataatacttattcaggttactttccttttgggcatgctcttaaattttgtgctcaaacaagtgcctcctttagttcagttttgccccaactatagaagtgaaaccagagcttcaggtttgcttagctgtaccataaatctgcctgtgcaccagttgaagaaatatgggaagaaagcagaatctgtccataacaggcaggttttgaggcctcggcatagtgagaggcaacaacaaaagattcaactggtggactcgccacacaacgcggggtcccatcacaatacagaacccatcccaaaggcagccatgtcgttccagaaacacagggctcagagggcaaagtgaaaatggaaaggtagtgaacgtgttcacatggaagggcctcatacctgccttgacatctccatcaatttgcaagttttagaaaacagatctcctaagatatgtacccttgagagaaaaagcacatcaagattttgaatatgattagagattcttgcatttgtacatcagtgtgtgttcctgcacccatgtttggattcctggatcttatgaaacacccactcatacatagcacatgtggcacatccttaagggccaagttaaacattttttgttgtttgtttttttagacattggttctcgctctgtcacccaggctgcagtgcagtggtgtgatcatagctcactgcagcttcgacctcccaagctcaaagcatcctcctgcctcagcctcccaaagctttgagattactggtgtgagccaccaccctcaccccaaattaaactcttgatgctgtcactattaggcatactgatcatgggaaagagacaatagtctctcagcctccttgggatctctgaggaggccagacatattgtctcttccctgccacttctctctgacatctccttgtccctgctgtgatacagcatccgtatctgatgagtggtcacacagttgttgtggcacggagtctgagaagaagagtaatgtgcatgctgattactttgaagtagaaaattgggtctgtttagagttttcctttcctccatttttggatgcagcctttttccaagagagcaggcattgtggactcctcttcctcaccatcgtatcgggaggcgttccccacccagagaagctggaagcagaggtctcatgggggtggggggctatgaggatgtccatttttctgcacattgaatctgtatctttcaatcccaatttgccaggcacaaattgtaaattttgatttccagctgcttgacttctctccctatctctcgattgtttccaaattcaggtaagggaaagctgatgttaataggttcccttgagaggtgacagcgtgctggcagccctcgctcgctttcggtgcctccttggccttggtgcccactctggccgcacctgaggagctcttcagcccactgctgcactgtgggagcccctttctgggctggccaaggccggagccggctccctcagcttgcggggaggtgtggagggagaggcgccggcagaaaccggggctgcacgcagggcttgcaggccagcgcgagttccgggtgggcgtggggtcagcgggccccgcactcggagaggctggccggcccgcaagcccctggcagtgaggggcttagcacctgggccagcagctgccgtgctcgatttctcactgggccttagctgcctccccacagggcagggctcaggacctgcagcccgccatgcctgggcctcccccacacccgcctcccctcccccctccccctcccccatcccctcccccctcccccatccccctcagccatcggctcctgcacagctggagcctcccaaacgacgatgagcgctgctccctgctccacaacgcccagtcccatcaaccgcccaagggctgaggagtgtgggcacagggcacgggactggcaggcagctccacctgcggcccagtgccagatccactgggtgaagccagctgggctcctgagtctggtggggacttggagaacctttatgtctagctaagggattgtaaatacaccaatcagcactctgtatctagctcaaggtttgtaaacacaccaatcagcaccctgtgtctagctcagggtttgtgagtgcaccagtcctcactctgtatctagctaatctagtggggacatggagaacttttgtgtctagctcagggattgtaaatgcaccaatcagcaccctgtcaagacaatcggctctctgtaaaatggaccaatcagcaggatgtaggtggggccagataagagaataaaagcaggctgccctggtcagcagtggcaacaccctcagctccctttccacgctgtggaagctttgttctttcactctttgcaataaatcttgctgctgctcactctttgggtctgcactgcctttatgagctgtaacactcactgcgaaggtctgcagcttcactcctgagccagcgagaccacgaatctaacagaaggaagaaactccgaacacatctgaacatcagaaggaacaaactctggacacgccacctttaagaattgtaagagggtgggcggcttcattcttgaagtcagtgagaccaagaacccaccaattccggacacacccttaatctccaatattggaaggtcagtgagtctttgttgaatccataaacagcctcatgtttatgactgccctcccttttatgcatttgggtagtttcaagaaaatatgaatcatttagctaagattaccatagaagagaagactaagattactcactaatcttaagtatattttacatttgaatttgattaactttattttttggtgactgccataaaaccacttatgcatcctatccctgttcttaagaaacataattttcatttaaagcatcccagtgtattttgtgtgtatgtgtgtgttggtaggaggagaagtgtgtgtgtgtgtgtgtgtgtgtgtgtgtgtgtgtaaataagggctttaagcatgtactttagtttgatttgaattcatctgttttaaattcagggtgaaaaataaaatccaagtttgacaaagaaagagaacaaaaagcattataaaagtcaccaattttcaaacacgtccttcatttggaaacaaactctcaaccaacaatgattcaagcagacagatctaaattgattggtttggttttagattccaccagattttccagactgggagctctttgctcatgaagctgcctgtgtgctaagtggccaggatatcagacacgttgaaaaccagaaatgctttcacactgtccagttcaatcagtgtgacagagccatgttccatatgtgtaggtcaatggttttaacctggcatccgtggctaaaatttgaaccgaagaccccagtgttttccatgaatgcatttctagttcagatatatcttcaaagtctctcttctgaggcattcctcggcctctgtccactcccagccagtcccctaaccatttgtctgggtcttatctggcatgtgtgtgtagttctcacttcaacatctttaagggcttcagcatttttaaaaaaacaaggattttttttcttcaaaacattcagaacatttaaacggctgtgaatcatccaaataacaatcacagtttatttgaaaaggtacaattaagatattgaatgttgttataacattcttgtgtgtgctgactggtatgttaaagaccaaagagtgatactgtattcattttagcttagtgcctctttctgccccaattccttggccaggatttgcagaaatttttactaaggacactgtcggtgtggctagcataccatcctgttgtgtacaagcagaaatcagacttgtgacctacccaaatccccaccacccttcttctcaatactcatcaaaaaccccattgccaccatctcctgggtgatactgaggcttctgcaaaacacacaaaaacaaatgcctcttatccaaaaaaaagtgtgtgtgtatgtgtgtgtgtatgtatgtatttttctcatcttaactttctttttctttctttcttttctttttttttttttttttttttttttgagacaaggtctcactctgttgcccaggctggagtgcagtggcacaatcacggctcactgcagcctctgtctcccaggatccagcaattctcccacctcagcctccccagtagctgggatgacaggtgtgtaccaccatgcccagctaatttttgtattttttatagagacgggattttcccatgtcgcccgggctggtcttgaactcctgggctcaagcaatccgcccaccttggcctcccaaagtgctgggattacaggcatgagccaccgtgcctggccagcatcttaattttcactgtagcatttccagcgtttgtttcatcatatcgttcagaatgtttccctctttctctgtgatgtatgagaagttgtgccccacctcatattctcaagtacaacacacgatgaggaatattagaactataacatccttcaggctgaaagataactcattagtgctaaccactgctgttattattcctgctgccattttactattgggaaaactggcaattaatgtcctttcccaatgtgcataatcccttctgagaatgggttttgagaaaaatgagaaggtttgcgtgggatgtgggacgtggaatgaagtggaagccgttattttccagaggcccaggctactggaagcagctatttcaaagagctctaccccatcttccacgtcatggttgtgatgaaaccccaaatgctgccacacttttagtgattttcctttctggtttgaacccagattcatccacatgctcacaaagctctgacggttaactcagtcacagtcagccaaactgtggcctcaaagctcatgaaccttctccctcagaaagacaaacagaagagcaaaacccctccctaaatagcattcttagttctcaaattctttagtaaccaccctcaccctcaaatgcacaatggtatacatttatttgttggtttacatgtatgccctttgtctaccttactggactaaagttgcagaggtggctggcaaacttagccccatttagtctaacagtgctgtaaggagtaagtcagatagcccctgggacaagttgcctgataggatacatgttaacccattgaatttgtatttcagaaaagcaataaatgtgtttttttttttaagtataagcatgtcccatgcaatatttgggatatgcttaaactaaaagtgatttgttatttatttggcattcaaatttaactgggtaacctgtcattttactaagtcaggcagccctatcccaggagcattgtgactgattgccaagagcaccagtcatttatcttcttgcttccagcttccttcctactctctgctgctatcccctgtgtcgcggggtgctgggatcctacaaatacatttctcagtctggagcctctgagtatgggtgttggattagtgattaccaaagagaagaacttgcatgagttttgaaagggtcggggtgggggtgaactgtgtgagattggaatatggggctcttccaatgggaagcacagacaggaactggaaggcttttgggttccctccctttgtccagagcctccataagggaaagactggctcccacgtggtccccaggcagtgtggtcgcagtgaggcagcagtgtcgagcacaaatgcagcagcctgtggggcacggcaggtgcaggctctggctcaagccatggtggtgacgggctggcagcttcaggctcccagagtcctgagacagcatcagggccctgggctcctgcattcctgcaaggtggtggtcttggttctaaggctgccatgaatactctcagagcctcagtggtgggggattacgggctcttggtgaaaccattttctctttcactccttcagcacagaagtggtaggagctttctgcagttcttaatctcttggccatcttaccttccctttctaccttcttctggatctcctgcccctttctaaatgattcattttcaatagattccttctgttggaatgcatagggtggtaatgccttcttaccagaccctgccagaagtagtgagctaagtcttttattcttatcatctgcaatcaacaagagcctctcatgcatcattacattcatcatttcatcaccaaacacatcattgcataatcagacacgtcattacatcatcacacacatcattacctcatatgtgcacctcccactctccacctagacacagggaagagaggaaggcaccaggaaatcagagtggtaaagaaaacttcaggaaatcaggtggttttaagaccctttattatgacttaaataaattctgaaattagtttctttaaggaaggcccctaaaccgggaatgaacatgaataagaattatagtcattttagcgaccatagtttccccaggaattattgcactaaggcatttaaatttttttccaaatgctaaaatattttgtcagctttattgaccattctttctaacccctcagtaaattatatctctatctgaagtggaacataggagatgccctaagcttctcaaagatgttttgtaacgatctaggtaaggactgtgtctaatggaaatgacaggcataatttatttgtgaaagcagaaatgaaattcaaccttgacaacagattgcgcatttttccataatgccatggaagtgaaattcttgtgatgtagattaaatcgtggaatttgacttattgttcaaaaacattagttcaactctaaacagttgaattactcagcagctgtgtacaaatgtatgatacagataacaaaatgtattaacaattccctagatctacagaaatctatcactgctttttaggataagcttgacttttgttcaaataaaaatgcaaaaggaaagtgtatcctaaaaggcaatgacagtttaatgtgtttctgacatgcaaccttcaagagatccatatatgaaccattttgtgtggatagtacaactctaaacataatgttatgtggaaatttgtatacagaatatttagcaaagaagagtcaggatgaataaagtgaaaggaaagactttcccaatgttattttttaagtgatatgagatgcatcaagtgagatgtgtttgacaaaactttattcaacgttgatcctgacagaaaagaagcaggaaaaaacaattaatacacttcctatgtcttgaaaagtagcaattttaattttattgtgcattttgcttgacgattttatatatgacttccagtcaatatttcatctggaggactgagcaggtattatgattcccattttatggcagattgcaaggtgaatgtcacctgtcatcagcgcatacctggccaggggccacgtcttccagattccagcccacacggcatgggtgcctgcatttccctgttgctcttctcctcacactgatattaatgaagcacatctacttttagtcaataaccacttttatgttacagacacataacaactgggaaataaacatctatataattaatctcaactaagccagttaacccttactttttacctaggctgtatgctgaaatgtgtgccttttctataaaggggtttgtattcctctcattatattgtatcaggaggaatcactctaagataaaacagtttatctccaaaagtctgcagaaaatgttgataacaacctgcaactctctggtaaaggactgtgaaatgcaaaacaaaccaaaccaagccccaagacctactcatgtaagatgatgctatgatacattgcattcatctttagctttttagccgtctaaattgtgttctatgagagtcttaaatatcttccctttatctccttaagaaagtcctaaattcttagccaattttttttccttttttttttttttaagaaaggatctcgctctgttgcccattctggagtgcagtggcacaatctcggctcactgcaacctccgcctcccgggttcaagtgatcttctgcctcagcctctcgagtagctgggaccacaggactataggtgtgtgccaccatgcccaactaatttttgtatttttagtagagacaggatttcaccatgttggccaggctggtctcaaactcctgatctcaagtgatctttctgcctcggcctcccaaagtgctgggattacaggtgttagccactgtgcccggcccttagctggtctttgaggacacaatactgtcctgtgcattctttcccagacatggccttacatcaactggaatccccaaccagtcactgtcttgcattgttttttaaatacattatagtttccactttctggtactggttcttttccttctagttgcaagtacctgatacctctgtctatagcaacctttcttcatggccctgctcaaatgctccatcctccacaaagcattcattcattgattgcaccagccagaagtgaagtctgcatcctaagattacatacaactctttcttcaagccctttattccaatcatatccatacggctctggattgttttcatgaatgtccttatctaatctctcctgagagaccctaaattcccttgggagagggactttattttagagctaaggctgccttcaatcttctttatttagttatagctgctataaaccttctttgacgttagaaaaagcataccaatatctaccaatatttagtatttattaagttcctgttatatgtcaggaattctgcaaaggattttacatacgctatttccatttgccttaagagttctgcaagatagtataaaccaaaaggtatctgagacaggtctcaatcaatttagaagtttattttgccactgagaaggaaataatcgtgaaggaggtttgtgcctttctccaaagataatgttgaggacttcagcatttgaagaggaatagctgtctggaggggaaaaagggagggtatggtcacattactgaatccacatgctgcaagtgaaaggaagcaggttggggaatagtcaataatatatttatctcttgctccataaatcagcactttacataagataaggtgaacacagagtagctacctatggagacatttaaccttttatcttagctgtctgtagaggaacaagaggaaaggcagtttcttgcacgactcaattttcagcttagtttgttttcttctggcatagtgagttggggccccaagtttttattttcctttcagaatagatattactattcatataaaaggccccataacttataaaagactgtcagcgctggtgtaagtcaaatctgacctaactctagcctaccatactgatattacactgttgtgcaatcatggtctgctatgatttgagtgtttgtcccttccaaaattcatgttgaaacttaatccctgatgttgagaggtggggcctttaagcggagcctgggtcataaagactctgctgtcaagaatggattatccacttattaattaatggattaatcagtttatgaattaatgtattgatgggttgtaacaagagtgggactgatggctttatatgaagagcaagagagacctgagctaacacactcagcttcctcaccatgcgatgctctgtgcctcctgagaatgctgcaggctgcagagaggtctcctgcaacccccaactagcaagaaggccctcaccagatacagcctgttggccttggacttctcaacctccataagtgtaagaaataagttcattttctttataaattacctagtttccagtattctgttatcagcaacagaacagggactaagacatggtctcaataataatctcaaaaactatttctgtcctcagaggtcataattgcgttgaagacttaggttccaagaagggacataccacaaagtgggacactacacataatagaagtaaaattgctcttctttcaaccacagaggcagagctcattaattctgactgtgaggaaggatttgaggtaggcttaataaaagagataatatttgagctaagccttgaaggagaagggtgatgttgacagaggagaagatggaagggcattttagagagagagaacaggtatgattaaagccataagctccatgaacagggatgagttgttggaaggaaggggtgtaggtttggaacagggagtgagttatgaagctgcaacaaagactaaagtccaacttggaacaacgctgaatgcaacagaaagggagtcagcattttatctttatgaagtgagaaagcatggagtgggaaactgacatgctcagaaatttgttttgagcagatggatctatgaacagcatgagaggatatatctaagtgtatcttttaactgagatacatatctagaaatgtgcatttttaaaaaattcctgacttactacctaaaagtctacacatgtctttatttgtacatccattctgaccaagttggaggtaaaatatttatattgtagaacatccttccagactcatctcacagccaagctgctgtgagctactttctgtttatttttttccagttacattttttttttcaaaaataaaccttgtattaaggtgttggggttgatttaggggaaaaaataatctcacatgttttctgaaaattacaacttaatgtaaaataaatagaaaatgttttctattaacctgttagtttcctagctgaatattttgactatcttttgcttgcctgtctactgcacaaatattttatcttttaacatgtcaaacgtcaatgaagttatgacagacaggccacatccccacttccatagagaagaatcataattgtccctcttagtgccttgtgcattttaacaatttgagaggaaactcaatctttatgtaaagaatgtgccaatttaagcattttgtctcacccatctgccctctgatggcctcttatagatgttctgccttttaagaataaattaggccaagtgcagtggctcatgcctgtaatcctagcactttgggaggttgaggagggagaattgcttgagtccatgagttcaagaccagcctgggcaacataggaagactccacctgtatggatcatcaaaaaattaacggggcgtggtggcatgcacttgtagtcccagctacttgggaggcggaggcaggaggatcagttgagcctggaaggttgaggctatagtgagctgtgatggctccactgcactccttgaataaatcagatccatgaatactttatccattactgggggaaaaaagaagtcttatgctatactatacattgttatacattgtttcttgaccaaatgaattcatgttatgcttgtaagaactcatatatattaaaataattattaaaatctggagaggttcatgcctgatataattaggctttgtgtccccacccaaatctcatttttaattgtaatccccataatctccatgtgtcaagggagagaccatgtgggggtaatcagatcatgggggcagttttcctcatgctattctcgtgatggtgagtgagttctcaggagatctcatgattttataaggggctctttacccttcacttggcacttctccttcctgcagccttgtgaagaaggtgtctgcttccccttcacctactgccctgattgtaagtttcctgaggcctccccagccaggctaaacagtgagtcaaaacttcaagtttcctattcttccctaaaattgataaatgttcaactgatttaatgtagctagaggtctagcaattaagggaatgatgcaaaaattaaagaacaggaacaaaaaggctcttcttcttggtaaagttatttccaagataaaataggtcagagtcctttttagtattgggttgtctttatgtttggtggtatggctgcaatagagttcatagcgtcaggccactgtggaaccattgtttcctgaaagttctgtatcattaatatgtttctctgaaatgatttaacttctaaactggtacagatctcagtacgtacatgtgaaggggctgggcatggtggctcatgcctgtaatcgcagcacttttggaggccgaagtgggcggatcgcttaatctcagaagttcaagaccagcatgagcaacgtggcgaaacctcatttttacaaaaaacacaaaatttagctggatgtgggggcacatgcttgtcatcccagctacttgggaggctgaggtgggaggattacttgagcctggttggccaaggctgcagggaatgagccttgatcatgccactgcactccagcctgggtgacagaacaaggccctgtctcaaaaataaaaataatacatgtgaagggtgaacttaacataaatagactgtgctagggacagaaaatatttaaaaactctaatccaaaagcttttgacagtattttctcttttttgaatgattagaagtgtgagacattgaaaacatcaaggatcacatgtaaggcaattagaaaacattccaccaaagactctgggggagcatgaagtatctgtcagtgaaccagcaggcaggagagctgatgtttgcaagaatgcagcagaaactataatgcacattgctatcctaagttagcttgttcttactcaaatcattaaaacaataacctcattttctgtctcaatagaatccttctattaagagtgttatacattttatagatgtagaaagaacttaacctcatcttcagtgttccacctgggtgggtgtggctgatgcatttgcttcatttcagactccaaaaagcatattggtttatattcattagctttactggttccttttctctaaagaacccaaggtgctcttgagagctgcttcatataatgagcatgtagtgcctcttaaatcaggagaacaaagaggcagtcaaggagaaagacaagtaaatgaggaatgaaagaccttgaacatgaaagtgggttgagtttgatgatgccatacatttggcattgcttatgcagttttcagtaaactaaaatcattttttcgatgccattggctgatcaataagaccaagaggttatagagaacaccaggtattcaattcctgtgacttcagaatatcagttatctccaagtgctgataacatcattgataatataaattatttctcaggtgtttaaatctagtgttgactttcttgaatctgaaacattttagaatgttttctcaacaattaatgccctttattccatctttccattcattgtcccttccccaccgccatgctcacacttgattcttgactgaccacttccccattttctttctcttcataaccattttattttttcagcctgcattttcaaagccacatccttctggtttcttgtatttgcttgccttttgaccccagccccttttcattcctacaatttcctttctttttatcctactttttctccagaatgtgatttttcttctacatgtctctttctgctttgcatgtcctgctgaagattcctctctctgtcctctgtgtgtgctaactccatggaagccctttctccatattatactttacatcaaattgtttgttatccccccaggaaggttttttattcctttacactttctccactttccacgtctaggtgaccacattgggcatacttgattccagttccttcccattggcgggtgctcagctgaaaatggcagctctgtctccctcccctgtcactgggactcttctctccaaggtgaaggaccatctgaagttttgtttacggaattatcaggggtcctgaataaggactgccttccttatccaggcacaattccctgatttccaaccagacaccaggaaagctgaggactgaattgtgccacccccaccaccaaaaagtccatatgttgaagccctaacctccaatatgatggtattggagatgggccattgagaggtgataagggttagatgagttcatgaggacctgtattagttagggttctctagaggaacagaactaataggatagatatatacataaaggggagttcattacattacatattaacttacacaatcacaaggtcccttacatgattgcgaggccatctgcaagccgaggagaaaggaaagccaatccaaatcccaaaactaaagaacttgtagtccgatgcttgagggcaggaagcatccatcatgggagaaagatgtaggctgggaggctaggtcagtgtagtcttttcatgtttttctgcctgctttatattctagacatggtggcagctggttaaatggtgcccactcagattaaggatgggtctgcctctcccagcccactgactcaaatgttattctcctttggcaacaccctcacaaacacacccaggatcaatactttgcatccttcaatccagtccagttgacactcagtattaaccatcacaatggcagtgtaagttacttcaatcgttgtggaagacagtgtggtgactcctcaaagacaaagacagaaataccatttgccccaggaatcccattactgggtatatatgcaaaggaatataaattgttctgttataaagacacatgcacatgtatgtgcattgcagcactattcacaataacaaagatgtagaatcaacctaaatgcccatcaatgatagactggataatgaaaatgtggtacatgtacatgatggaatattatgcagccataaaaaagaacaagatcatgtcctttgcagtaacatggacggagctggaggccattacccttagcaaactaatgcaggaacagaaaacaaattccacatgctctcacttgtaagtgggagctaaatgatgagaacatatggacacaaagaggggaacaacagacgctggggcttctcagagggtggagtgttggaggaggaaggggatcaggaaaaataactaatgggtactaggcttagtacctgggtgatgaaacaacctgtacaacaaagccccatgacaaaagtttgcatatgtaacacacctgtacatgtacctctaaacttaaaagttaaaaaaagaatgcagagtatctccactgctattgaatatgatgctaaaggtgtttttctaaacaagaaaaataagtaaaccagttagaggcataaggactaggaaaaatactaattcctattattttttagatgatacctggaaagctttagataattaatgatcaaactaattcacaaagtacaataattcagtaaattagcaataaaaataacatacagaagtcattagtatacacccaaaacaaaaatttatagagtattcagtattagagaaaactctatgtacaattacagcaagatgacataccccttagaaataaagacaaaaagaaatgtgccaagtgtataatttaaaaaacctttaaaatctgaaagaaaaaaacgtagattaaacaaaaggccaaacatccttgaacaagatggctcaaaaacataatgaagtcaattctaaatgggtgaatttataaaattaatgtcacaatttttgaaaactacgaattgtcttatggagtaagattagttgacacggaagttcatgtggaataaccagcaggcaagaatagccagaaaaacccttagtagggtcaagccctttcagaatttcaacacattattaagcatctttaatgaaaataatttgttacaggtacatgagaagacagaaagactagaggaatagaagagaacatctagaaaccggtagaagtacagaagaaggcagtttcgtatttaataaggatggtatctcaaaccactgggcaataataaatttttttcttgagacagggtcacacgctgttgcccaggctggagtgcagtggctcaatgaaggctcactgcagcctcagcctccaggctcaaacaatcgtcctggctcagcctcccaagtatctgggactatgggcttgcaccaccatgcctggctactgtattatgtttattcttaatttagagacagggtctcaatatgttgcttagatgggtcttgaactcctggggtcaagccattcttctgccacagcctcctgagtagctaggactacaggtgtgcaccacagtgtcaagaataatggatttttaagcaaatgttgggacaagctggaaaatgataaatttagatccatacttcatttgtacacaggagtaaactccaaatgaatccagtatctaaacatacatgcacatacacatgcttagatgtatgcatacctacataatacagccatgtaagtgctagaagaaaaatgaattaattcttctataatctcagtgtggggaaagggctaagtatcactcaaaatcaaatgcaatcaaatatatataacatttgaatatgtaattttctaaaaatttgctgggcaaaaaatgcaattaaaaagtcatgagaaatatacacctgcaccacataagaatatttcagtcagtgacagaccacatatttgatggtggtcccatgagattacaccgtatttgtagcatactttacctaagtgtggataggtttaggtacacaaataccatgtgtaacatgtgttacagttgtctacattattcagtgtggtttcagggtgcacaggtgtgtagcccaggagcaatgggctacaatatacagcccaggtgagcagtgtgggctgtgccttctgggtttgagtgtgttcactctaagatgattgcacaaggaccaaacaacctaaagatgcatttctcaggaagtattcccagcacagagttgtataagtagcctcataaaggagctaatgttaatacatttttaaaaattgaaaattgaaggaaaaaaattttttaaaaatacatatgctatgggtacaggcatatttctatttagatactttctatcatgaaaatattatccaaatataaatataagattaaaaggtttctaaactgagtttacaattcaatcagattttaaagataagtgatattcctctaggcaaggccatgggtcaaagagacctttaaacagcaaactgggcctacagtgtaaccaatttaaaaactaaacttaatttacatttagaatttatctgataagactttcactcagggcagtcttagcaaatttgaggctcagtatctgcttctgaagctgggagacaatccctgagttcatcattttctttcatcactttgtccactgaacttaggagcaaccaaccaacttcattatgttccttggttctccacatatggtcaaaggtattatctatagagtcactaaactccttgcctttcacaagtagtgaatcaggagtgtcaaatgcatttattttgcataactctctaaacatttcacaccaaagactatcagtgttctccatactattagaaataaagtccttaacattttggggtctaatcatgttaagcaaccaactccagaaaccccaaaactaactaaagaactccatccttaatattctattcctctagaaccacttctggtaccaaaatctgtattacttggggttccctagaggaacagaactaataggagatatatatatatatatatatggcagttcattaagtattaactcacatgatcacaaggttccacaacaggccgtctgcaagctgaagagcaaggagagccagtccagtctcaaaactgaagaacttggagtctgatattcgatggcaggaagcattcagcatgggagaaagttgtaggctgggaggctaggccagtgtagtcttttcatggtgttttttttttttttttttttggcctgctttatattctagccgtgctggcagctgattagattgtgcccactagattaagggtgggtctgccttccccagcccactgactcaaatgttaatctcctttggcaacaccctcacagacacacccaggatcaatactttgcatccttcaagacaatcaagttgacactcaatattaaccatcacagggcccaagcttcatgatgggattagtggctgataagaagaggaagaagatttctctctctctctctctctctctctgtctgtctctttccccaccccacactaaccatttgagaacacatagagaagtggctgtctgcaaactgggaagagagcactcactgggaactgatttagctgaaatcttgattttggactttcaaatgtctgttgtttatgccacccagtctatagtagatttgttattgttgttgttgttgttttagttgttcttttttttgttagtttggtttttttttatagcagccctagccgactaagacagatacctcaaagcctctgacctacgcctactaccgtggcaatacaaagtcactgtttcgtaacactgtgacccaggataatattttcagttccataaacacgtgtttataaactgaaacctcttaggtctttcttttcacaatattctgaaaaccaagtggatatgttctcaaattatttatggtcaaaagggaaaaaataggaagtgatttatattgtaagggacagaaaacactacagtgaagatttactgagtagtgttggtgtttgaaatatatttcgttgttgttgttgttgttgtttttgagacagagtcttgctctgttgcccaggctgtagtgcagtggcaccatctaggcttactgcaacctctgcctcccgggttcaagtgattctcctgcctcagcctcctgagtagctgggactaaagacatgaaccaccacacccggctgtaatgtttttgtatttcttagatttttttcaagttgttaacaaagtgaacttaagaatgaggacaccatcatttgtaaatactgactaattccataggctgtaacagaacaatttatgctagactggtttccccatttttcaagtctgtctttaaggcagtgaaaacaggcaggactctacaattagctttttagtcatatgattaaacaaagaatgcattgggcctggtgatacagggagacctttcctcttactgatagtaaaaaaaatgaaattcgtttttcattttaaaaaaagtgatcgtaattgtttggttttctggttgattgaaagatccaaaaagagggttgtggtgccactgcctggtatttgttttaaattaattttaatgcaagttgaaattgtgatcaaagatttagctttatccaagaaaaacagttctttattcctaatgcatttcatttcacgccaaccaattaaacctggcaaagagacaagggcattagccgttaattaaacaggggagccccagaatgcaaaatttaatgcattctacctctgttctacactcccaagttaccaccacatttttattcataaactcttataatcccataggacagttggcattcccagatatttctccttaaaagtacttgatgggattttaaatatcagtcaaatattcataattttaaaattgtatttagaaaagcaggaatgaatcctaaagtccattggatttcagtaactgtagttgtctctaaaaatacaaaaccattttcttgacttctgtttcagacaaattagagtgacatataacactgtaattatgtttgaagtttggctcaaccatagataagctaagaaaataataatttttaaaagttaaagttaatggaaggctgaatgacatttgtttaaaagccatttttaaaacttcagcaaaaattctcaaggacttaaggagagttgctgcacaaactttccttgtgaaagggattgagaaagattccaaccaactcctccgggtgccgtgagtcatactgtgtaaatgcaaaagatttcagactcaagtcaaccgattttgaagtgcttttgaagtttaaagtgctttaccaatgagtaccaaacatcaaatgaaatcttccgggcaaagcaaatcatatgttcaaaaccaaatgcttaggagagctctctgaggtattagcatctcagatgttaagaagaaaaaaaaattcatcaaaaaatgtttcatctgatgcatctcctacttgcaaatagctatcactgatacttttcaaaggtgttagtctttcctaaaaacccagttggggatgagagtgaaaatgtatgttttagacagtattcaagtcatgtctgaagtgctttagtcaagtatacaaataaatgctgctcccgttctgggtgaaaacatcatgtcgggcaaaagattaggacagaataggcctttttaaaaagatttttttccaggtgtttttgggccaagttgcccagttatcagagagcaatgaggttcactttccacgacagtattatccatgacaatacaacctccccagaaggcatttggcaaagcaatctcatgcctttgaactgtgaaggccaagatccttgaccccagaggtctgctgaaaaatcactaccatgaggcaaattgattagtaggagaaaaggcatacaaatatatttaatgtgtacagacaagagtcttcacaatgaagactcaacctctcaatgaggtttgaagcttatgcactatcctgaggttacagaaagagtgggggccttggagccttgtgaaataggtgactggagggggagaagaagaattctattgtggggcagtaagtgattactagggagaatgaatacatgggaaacagggattaacttgtaaatagttttctttggaatttaactgattcttagagacagtcatctggaaaaagggtctgttcaggtgtggtaatatgttggtcatctttccagcaatgggtaaggagataataggagaggaacaagaacaattgttctccttggtgggtgagtcctagccttatgtagataggaaaaaagttttttgcagcacttgttgatctctaagggcttttcgttcaaaatactcattatatcagggagccctatttttcggtgaaatattttgatttccttcacaaccatagtatcatgtggctgcactttttgcaagttgatgaactggaagaaaatgcctgggtgctgagtctgatacccgtaggctatgggaggtccccaaaaccaggtgggacctcaatcctggccggtgtccaggctcttgataccatcaggagaagaaattcaaggaagagtcaaaaaaatagtgttaagtgtggacatttattgcataccaaaagtacacaccgaagaaaggtgagtgcaggtgtactcaagaaaatgagtcacgcacaacagagtttggggctgctacctttatggttttcttaaaccaagaggtggaatattaacgaagatttctggaaaaaggtgagatttctcggaactgtggtgccacccagttttacaccaaatatgggtgttcccagatctgtcatggtgcttgtgggtgtatgatgtagtatgttaatgagtgtataatgaggccttatgtgaaacgaggtcaaatccagcatcatgttgggcctagttggttttagccagcttggtccacatcctattttgtaggttcttatcagcccctagcttatgcagctatttcagcggtttccttttgctaatcatgtgggactgctgcctgaaatttccttttctcctgccaccaccctgtatcattcctgtctcaggtccatcaacttttccacactgcttagcctgcaagaggttaccttcaagaggaggaaaagacctgcacaaacaaatgcaggagagacataggtgggaattgtgagtcgtcaattggaggtcatgggctccctatgcaagcagaatctgaatcctgatggtgtcagtttctgcttagagggatctatcccaactcgcttgacctcacaggatttcagtgtgctcgctgtacaacagggatagtaataaccacctaaaactaatggcatttattcatgcacaagggtggaggcacagcatagagtggtggttaggattatagggtctggaggctgactgggtgggaatcctcaggcctcccctccaaggctctgtgctttagcatctctgctctagagggcacatgtaaatggggacagtgactgttgttaccctgtgggccttactaaatcatgtgcatgaaatatttagcatggcaactctcccactctaaatttgcaatgtatttgatctgaatgacaaataaaaatgatttctggccgagtgcagtggctcacacttgtaatcccagcactttgggagcctgaggccggcagatcacttgaggccaggagtttgagaccagcctggccaacatggtgaaaccctgtctctactaaaaattcaaaaattatccaggcaaataaaaaataaaaataaaaaataaaaatgatttctgaagggccataaggaaattatgagtaagggttaaggacattcacaggaacccccaatgtatttctctatcaatattccagaaggaatttataatcaaaggactaagaaattcagagatgctaccattttcaacagatggagaagtgagaatagtaaaaacagacaactgcaatagatactatatgtttaactgttttaacatgctaccagtatttattcaagtgattagagttagtaacggaaacatgttccattaatttaggaaatgctgattaaggacctgctttgtgcttcaccatttgtgtatctgtgttagaaactagggttataaaaataatgtgttctccgtaagggaatgtattttaaattgtaagagtgttaagacattcagaatagtagggcaggagtcaaaggagagctgtatattgacctcttaatagatgctccaaggtggactcttctgtcccctctgccagctccctgactccttccctaggatggaggacctggataggacggggtcacaggcaaggctatggcaggggtaggggggagctggaaggcaagggtgccctcagcctttgctcttctctttctgctcctggcttgtttttttcttgtcttttctcccagttgaatgaggtgagtaaaggcctgtggggcagaggggagccctcgtaggtgtctgtgtcagccaaatggtgtcctctccatgttccagactaaatgagcagacaatggataggatgataaatccaaactcctcttctcttcccagactcctgtgtcctttttgctctgatacaacaaaacaagaaagctggtcttgtaatgtaggttattctgagttataaaggttactgtattcatttactagggctgccttaaccaagtaacacaacagaaatgtattgtctcacagttcttgaggcttgaaatctccagtgttagcgggggctggttccttctgagggggatgagaatgaatatgtttcccgactctctcctagcatctcatggtttgcttgcaacgtttgacattccttggctggtacatgcatcaacttcatgtctgtcttcatctgcacatggcgttcttcctatcccttcacatcctcttgcctcatgcatgtctgtcttcatctgcacatggcgttcttcctatcccttcacatcctcttgcctcatgcatgtctgtctcagtgacgagatctccccctcttagaaggacatcagtcccggtggattagggctcaccctaatgacctctttttaacctgattgcctctgtcatgaccctgtctccaaataaggttacattctgagctgataggaattaggactccaacatatggatttttgatgtgcacagtttaactcataacagcaaccaatagtgaaagtctaaatagtgatataattattttaaaaaatgggataagaagagagggaggtactgtgagtactttcatgtatcataacagcagatcattatatggagttgatgaaattttaaaaagtatcagtagaaaggtatcatttggtaatatggaggtaattactaaaataaaagcagaaatggtggtgagttttgcacttgagaattggttgagttaaaaaaaacttttggatctgactctaaaatctgtattatagagtttatattagtggatctcatgtatctcttctcaaattgtatgtgccttcttgttcagagaaatttcatttttaatgagaacttagacaaaaactaattaaatcaatcaattcatcaattgcaagtctaaggaaatttataggaaaagcaacatgttcaactctatagctggcagcgcccagtgtatcagtgtctcactgtgtccggaattggtgggttcttggtctcactgacttcaagaatgaagccgcggaccctcgcggtgagtgttacagttcttaaagacggcgtgtccggagtttgttccttctgatgttcggatgtgtttggagtttcttccttctggtggggttcgtggtctcgctggctcaggagtgaagctgcggacctttgcggcgagtgttacagctcttaaggtggcgcatctggagttgttcattcctcctggtgggttcgtggtcttgctggcttcaggagtgaagctgcagaccttcgcagtgagtgttacagctcataaaggcagtgtggacccaaagagtgagcagcagcaagatttattgcaaacagtgaaagaacaaagcttccacagtgtggaaggggacccgagtgggttgccagtgctggctctggcagcctgcttttattctcttatctgaccccgcccacatcctgctgattggtccattttacagagagccgagtggtctgttttgacagggtgccgattggtgtatttacaatcccttagctagacataaaggttctccaagtcccccaccagagtcaggagcccagctggcttcacccggtggatcctgcactggggccgcaggtggagctgcctgccagtcccacgcggtgcgccggcactcctcagcccttgggtggtcaatgggactcagtgccgtggagcagggggtcgatgctcatccgggaggcttgggccacacaggagcccactgagggtggggggaggatcaggcattgcgggctgcaggtcccgagccctgccccacgggaaggcagctaaggcccggcgaaaaattgagcacagcagctgttgacccaggtgttaagcccctcactgccccgggctggcggggccggctgaacccacggccacctggaattcgcgctggtcccagcaaacaccgcgcgcagccccagttcccaccggcgcctctccctccacacctccctgcaagctgagggagccagcttcagccttggccagcccagaaaggggctcccacagtgcagcggtgggctgaagggctcctcaagtgccaccaaagtgggagcccaggcagaggaggcgctgagagccagggaaggctgtgagggctgccagcacgctgtcgcctctcatcatcactgctgtaacaaaatatcacaagcttagtggcttaaaataacacaaagtcactatcttatgttgctggaggtgaaaactctcactgtgctaaaatcaaggtgtctgctgggtataatttcttctggaggctcaaagggagatttcgtttccttgctttttccagcttctatagccattcgcatcccctggcttgtggctccttcctctatcaaagtaagcagagtagcatcttcatatctgtctctgactttcaccctttcctgcctccttcattcacttacaaggaccttgtgattacattggcacaatgagctaatataagatcatctcctatttcaggatccttaacttaatcacatctgcatactcccttttgtcatgtaagaaaacatatttgcaggatgtagggattaaactggggacatatttaggggtctttattctgcctaccatactcagtaaaagacaaaggctgttttagtttggatgtacaacagacaaagacaatagagaacagcagatattctggtaaagaaaagccatggttcccataattctcccagcaatgctagtgagcgccttttccagtggggactatctatcaagtctcttgacaaaagcaaataggatgtggcaaggttgaactactgatcagtatgcccttgaaacccttggagggttatgctcaagtaatgttttaacaaggtgggcagaggataattatttctctaagccacaggatgaatggtaattgataaaattccaaatagaaattgtgagcatgtgtaattcgattcattatttttaactttgcaaaacatcatttatctaactttgcaaacttacaactttgcaaaacgttacaaggaaaatctttgcgttttagtttccaatgctattaaaattgaataatttaaaatgcagactctgacagaataacttaagtgaaagaaaaataaagttatacagaatttatttaatcaatagatttgagaagacaggaaaatttaatgttgagggtatcaaataggcgcccagtggacagaattgtctatgtggtggaatgagatacagcaccactgacacttgcacctggaggaatgcttatttagacggtaataacaaagtcagtgatttttcctactattttcgatgctatcctcaggctatagatttaaactttatgagaagttcaattaaaaaggcgatatctactaatttctcaaatggcctttatatgagtcttatatagacacagggacaattacatacaacttgatatgaaaataaagcaaaccaagaagttaaaagaagtcttatggttcatgtttgtaaaataatacattggaacatttttcctagttgagatttaaacagaaaaattatatgtgttgacttactgcttgcatgtatatttctgcaagagataaaaaccttaggattaataattaaaaccattctggagttttatatcagcaggtaccaaagctgtcagttgcatgatcttaaccacaattaaattcaggcataacactccctgattataccaatatagggagaaaaagatttcttctcgcccaggtcagtttttatagataacaaacatttaaccataaaagaaaacatgctctctgtagagggctaattaaacaccatagtaataagataggaaaggttgtttcaggtgagtgaacccaactccagtcatggaagaaagaaaaggaagcccttgatttccatggttgggagaggcacaggtggcagcaggaatcctcaggatgtcctaaggaaaggtttcctctccagcttttaagtcagccatgttggcttcatatgttaaagcccttgctgtttacacagtgctgtttacactatttattcctgaacgctttgccctgcgtttatccccctgagaaaggataagcccttccaaactaatgacccccaattcctttgtggttggtcatcctttagtgcctcgttagccagaattacttaatgtcattcatcagccttgcaacactcacatggcatttacttggctagcaattttattggaacttaattattagcgagaaaaaatagaaacattaaaatggtgcaaacctatagcaatgaaatgcttagcatgctgttaatgctgcagagaatcttaaaactaaattgaatctggcctcatggcacttaggttgtgagaagcactgcttgcatttaaatattttgctacacatagatacaggaaacatgattttgatgtttgttaaataagagttaatttttcttatataacagaaaaaagccctccctatttttttcccaatcaagttgtttatttctaattagactaaatataaggtgaaatgtattcaacatatccaaaacactattttaataaagtgagcaaattgtcaagatccatatatttatttcagactttttaaaagttaagacaattttaatttattattctataaaattcagtttaactgtcagtttagttttgaaattcagaagtcaatttggaaaatggaagtgtttatcattagttgcattttgtcctgatctcagaaaattacgtatatgttttcctgtatatacttccatatttgtcattggatgagcaaatgataaaaacacactgaatttatgtaatttatctctaatccctttaataaaacatttcataattttcagagaattcagaattcttaatgagtattcttcttcatgaaacagtgtcttctgttcatattgaatgcagcagactcaggaataactatgatttatcaatggcatatttttaaggctaacatcaacagtagactcttgaattcaatcatgtcagcacaatttcaaaggattgcctttgctgagtacaaagaatctacatggttagctaaaaatggtgcaaacttaagcattgtgtaaaggaaagatctattgattttctgtgtttctaattggtgttaggcaccacattagatcaactcatcacttacctgccatttctccctctttttactttgtgttgaagagtttggaaatcttatgactagcctacttgttctgtgcccatgaagcaaattaggtatcatgaataaaagatctgggtcagcacaaatgtagccttactctctctgtttatctaaagacctaagcctgttcacatctccaacaccctttgcatgaaggggaaaccaggtgacccaaaccaggtatctgaaatgacattgcatgcctgaattacaaatcctcctcctagctttacaccaaagggctggcagtactgacctgggtgtctgagaactacaagaggagaatatactgaattttcagttccttctgggtcgattctaactattgggccccagaatgcagtcagtcatggattctaagaatcagattaaaaaatggagtttaggggtcagtccattgggcatatctgaaaacgcaccctgtcgttattttccaaagacctgagggcacagttggaacatagctgatacagtcagcaactgggaatatcctacccatttgaccctatcacccatgcagtaaagatttttataatagaaataattaagtagaagtctaaagacctggcttccctactaagatacttgaacaaatttaatattgcattcctggggagaattgcagagatcagtgttaccattaaaacttgaaaatttcaagtgtgttgttttccatcacaactccactggacttccccgttcgagatgtgtagttgatagaagacacttgaagaatgatgtagtttagtaaactcaacaagatgctggatctctttgcagctttggttcagatgccatctttttattggaatgaataacacacagcctaccaccagacattcagttaaaggtttggtcgattttgaccagtatttattctcccagtatccactctcttctagatacttttattcacataagctgtgccaggttttagcaagcatatggacatccggttagtccctgcacttccctgactactttgtagctgtacgtggtcatgtgaccaagtccaggccagaggacttggtcacatgaccacatacagctgcaaagtaatcatgaccaatggtgatgacatgaacaagttctgtctctcatccttgagaaataaaggcaaatgcattccattatttcttccttcatgttggctaagtggaacaattgacttaaacccagtggtcttaagccatgtattaaagataacaaggctatcctttccatccttggccatctacttccatctgttgcacgaaagagaagaaaacttctctcctatttgaaccattatattttaaggtctttttgttacagcagcttaacatgtttcccaactaatacagcgtgtaactctctgtccacttaatgcactattccacattgagctcaggatacttcttcaatcccaaaatagatgcttctattttcttggtcattccaagttcctcctccttgggaatgcttgatttctctgtgtttatcctctcactgttctacacaatcccaatataaacttgaaggtgtgctccctcatttgcccaaatgagaactcatacaacacatgtgtagatgtagaaaatttcacaggttattcagataacctaaaatcaatacttacttactgttaaaaaatgtccttcaaaaataaaagaaaaagagtaatgtttatagtagagaaacttgacaaacactcgatcaaccagatgatcaggtcaacatcaaaagtgacaagtcatattgacagtatgtacccatggcatgatgtgatgagaaggaaacaccacctctgtggtcttcttcccaaatagccataaccccagtctagtcatgaggaaaacactggaaaaacccaaatggaaggacagtctaccgaccagtattcctcaaagcccttgaggtcatcaaaaacagaaggtctgagaaaccgtcatggtctaaaggagacttagaaaacatgactgtcaaatataatgttcagcagaacattgaaaacaaaagatgaaaaaaatgaatgtaatgtgatatcctggatgaaatcctcaatcaagggatattaggaaaaaagtatgtaaattcaagtaaatgatagcctttagttaatgataatgtatcactatcagttcattatttgtggcaaatgtaccagactaatgtaagatgttaacaatagggaagtctggttatgtggtataggactttctgtaatgttcttgcaactttttttgtaaatccagaactatttataataaaaattttattaagtatgacccaggaatggactttcaatgggaagttggtatggtaaacactggacctcactatttgaacacattagctggatacctgaagaaatggagataggagatagatgatatgtaaggcagaagatatggggttaaggagctggagactagctgtggtggtgcatacccgtagtcccagctactgggaaggctgagatgggagaatcacctcagccaggggaggtcaaggctgcagtgagccgtgattgtgccattgcactccagtctgggcaaaagagtgagacaatgtttcaaaaacaaacaaacaaaaaaagatgaagatggtgcatgaggacatgaactagagcaaaaggagcactcatggccagagacaggaacatttgatgttaagatggtgtgtgagatgaaggcatcccaagtgatgacaaaaacgaaggtaggaaatgtgtggagcagtcaatgtttggagatgccaatggtcaaagcaataaagtcatcataggttatttattatgtaaaggaaaatgttagaagaagtgggaagatggaaagaggagcatgaccgagggccaggaactgatgaacaaacaggggaggttaaggaagggcaagaggtcagctggtggctggagaggagaagtgataccaattagatatgagaagtataatcaatatggcattattgtatttcaatagtgttgaaaataaatgaaatttacttaatatagcaccatatcaaacgaaatactttttctgaactggtttggttccagattcttattgaagtaaaacataaatctacttatgggtattaagggataacgtatcattgtgtggatcatatgtttgtcagatacattttggctgacaagtaatgcgaacgataattgtgatttctggaaactggcgtactgcatctgaaggtcagtgtgctcatttccccttggatgcatacattggaatgttattgtaattcagaaggttctttctcagctgcactgcatttccatcggggaaaatgccaaccctcggaataagagcatgtgttatagagacatgatgtagttgctaaagcaaagtgattttaattgaattgtgattctttctcctgtaacttgagttgtaccattttgtgttgatgtgataaaatctgaattctttgttaagtgatggcttcaacatgcacaggtcatatgacattttaaatatttcgttgtattttcagtttttacttttagctaactgaacttgaccctagaactactatttttcctttaactcctttctttttttttttttaaagacagcaaccaaatgtgcttgtcttttaagggacatatatgtcaagagttttgaaggatgctacagtaagtaatttggatggcactggaattaaaatccagcatgtatttttgctggatgtgactttcaggaaaagatcttataacttgttacagttccaaagccattacacagtatacagtcatgtgtcacttaatgatgggataagttctgagaaatatttccttaggtggttgcattgttattcaaatatcataggttgtaggtaaacaaatctagatggtataacctaccacacatctaggctacatggtatatagcctgttgtaacaaagctgtaaacttctacagcatgatattgtactgaatactataggaagtactgaatactaactcaacataagtatttatatatctaagtaaatttaaacagggaaatggtacaataaaaatacagtataaaagataaaaaatggtatacttgtatagggcactgaccatgaaaccatgaatggagcttgcagacgtgggagttgctctgggtgagttagtgagtgagtggtgagtgaatgtgaaggccattactgtacactactgcaggctttataaacactgtacacttaggccccactaaatttatttttaaatgtatttatttaataaattaacctcagcttactgtaactttttttactttataagcttttagatttttgaaaactttttgactcttgtaatagcacttagcttaaagcatacatggtatggttgtacaaaaatgtttttttctttatatccctagtctatcatccaagtttttttctacttttaaatttatttttttactttttaaaattttttgtgaaaaaatgaagacacaaatatactcagtagcctaggcctacactagagtcaggatcatcaatatcactgccttccaccttcacatatggtcccactggaaggtcttcagggacaataacatgcatggaggtgtgacctccaataacattgcctttttctacaacaccttctgaaggacctgcctgccgctgttttacagttatatacatatatatagtgtgtatacacacacacacacacacacacatatgtatatatatatgtatatatgtagaagcaaaacactaaaatattagtaaaatatatagtatcataaatatataaactagtaatgtggttgtttattatcaagtattatgtgctacacataattgtatgcattgttttctaacactggcagcacagtcaattttattttattttattttttgagatggagtctcactctttcaccaggctggagtgcactggcacgatctcggctcactgcaacctccacctcccaggttcaagtgattctcctgcctcagcctcccgagtagctgggattatgggcacgtgtcaccatgcctggataatttttgtgtttttagtaaaggcagggtttccccatgttggtcaggctggtctcgaactcctgcgctcaagtgatccgcccgccttggcctcccaaagtgctgagattacaggcatgagcctctacgtccggttgcagtcgacttttttacacccccatcaccataaatatattagtaatgccttgtgctgtcacattacaaaggctatgatatcattaggcaacagtcatttttcagctccattataatcttatgggaccacctctgtagggagaccccctgaaactatggctatggaataaaagatgaaatgctcctgattattgtaaatacaaaattgcatgcaggattgtgtaaagacaatgccaggttggactgccagaacgagccaacagcacgtgatgtgcttccccctgcagagagcctatgaatggacatgcagtcagggaggtttcacatcaccaagattcctatcccagaaaagcagatgttcatagctctgggaatggaatgcgacccttgtggaaagcctataaacggatgcacggggggcacttgtccatatggataagatagggctataaacgccctcatcttgccacggctcttctagccctctttagggttaaggcatactcccttctgagaatttctggtctaactggttgtctagcttcacatcctgtttccatggattgtttgtaactagcttttgttgcaatcgttactgctgattaatatcttgctaatcataggttacggaaagattgtgtttctgttttaaggctctgttagaaattactgatgcacacactatattgtaaattcttatctctgtatactgtacttctacatacaaatgtactgtacttctacatacaaatgttatgttaaagaattacttcatccccatgtgaccatctcacctcataatcaaatgaccctaaatccctcactaacctacccccaccctcactaaacgtaataataaatgctggtatatccagtgcattgttggcaccgcgggaccagaaggcagtgacccacctggacccagctttcactgtcttgtgtgtgtctattatttctcaacctgccgatccacctgggaacaaagagagccccattgcattgcgggctgctggccagatccctcaatacacctccatatatgcagtctgccattaaccaaaattttgctatgcagcatatgactgtaattgattcaagatcagttatttgaaaatgtaaccccttcctactaatagaataatctttataacactggaattgaaaatccttttccggctgggcgcagtggctcacgcctgtagtcccagcactttgggaggccaaggcgggcggatcacgaggtcaggagattgagcctggctaacatggtgaaaccctgtctctactaaaaaatacaacaaaaattagctgggtgtggtggtgggctcctgtagtcccagctactggggaggctgaggcaggagaatgacatgaacccgggaggcagagcttgtagtgagccgagatcgcgccactgcactccagcctgggcgacagagcaagactctgtctcaaaaaagataaaaaagaaaatccttttccaaatgatggaatatagtaacagaaaacagaatccctactttagtgctagagagatagtttatttttcaaggtcatgtgacacttaccgaatactcttaaaattgtaagcaaataacatctagattttgccgagagctccaactttgcaagcgtgcataaaaagcctctgtttcttcctaagtcaaagaatggaagacagagccctggagtgtctgggagatacttattctacatgtgccaggtgcttagtgcccaggcaactggttagaatcaagttaacctcaattcgttttccatcaatgattctggaatttctatgaaaacagttgacctggagaccccagtagttgctgaagaaatctgggctttcaatcatctcctacttttgactccagtctattccagaactaggcatttagcctctattatgaatactctcctcactggcaaagaaaaggaggtgggtaatgattacctaaacttcagagctaactataagcataatttgtggccaggtgtggtggctcacacctgtaatcccagcactttgggaggctgaggcaggcagatcacttgcggccaggagttctagaccagcctggccaacatggtgaaaccctgtctctactaaaaatacgaaaattagccgggcgtggtggtggacacttgtaatcccagctacttgggagcctgaggcagaagaattgcttgaacacaggaagtggaggttgctgtgagccaagatcacgccactgcactccagcctgggtgacaaagcgagactccgtctcaaaaaaaaaaaaatataaaaagatgaattgtgatagataatgcttagtaaagatgcaatggaaattgctaattcagcaacatataagccgttttatggtatcattaggcagagaaaatcgatatacctaaggtgaataatgtttctacttgtaccacatccgtgatagtctaaactagggattctcaaagtgtggtgtttgaaccagcaacatcagcatctcttggaaactggatagaactgcaaattctttttttttttttttttttttgagacaagtcttgctctgtcgcccaggctggagtgcagtggtgcgatctctgctcactgcaacctccgccttccgggttcacgccattctcctgcctcagcctccagagtagctgggactacagatgcccgccaccatgcccggctaattttttgtatttttagtagagacagggtttcaccatgttagccaggatggtctcgatctcctgaccttgtgatccgcctgccttggcctcccgaagtgctgggattataggcatgagccaccacgcctggcctagaactgcaaattcttaggccccacccaagacctattgaatagaaactctactggtggagtccagctatctgcatggacaaacctccaagactgatgatgcatagtcaagtttgagattcatgactctaatccagaggtcagcaaactttttctgtaaaaggctagatggtaaatactgtcggctttgcaggcagtatggtcttcacctcaactactcaactctgctgttttagcctgaaaacagctatagacaggacgtaagttaattgggtttggctgtgttccagcaaaactttatgaaaaaagcagctggatttggtcaatgagacataatttgctgacccctactctaaaatacttcttactaattttagaccagtggggcttgttttatatgagtggattgaaagcattcatctatgtatgttatttttaaaaatagattctctttatataaaacgtatgtctgtctattcctgagtacacattaaaaacatcatttttaattatctgaatttgtaagtttcatgggtaaatagaaaaggagatgcttatgataaagttaatcataattaaaattaaaattatcacataatatattaagattcacataacaaaatgttaatattctctttaaatatcattactaacacataatcaacaaaatcttaccttggattttattacatagtttagaacttttattgcatgtcataatctttgtagtataataaacaaattttaacatttcctctaagcacaggagatcatatatgtcatcacccttaccttacagctaataaatagttgttcatttcagaattcgggcagttgaagctgtgtgaacatgaaccattcatcattacagatgatcctgatcacatagatacatggtatccagcaattgcaacttagaaagtgttatcagtccaagatctgattggttctgcaaatttagatgactcgttttctaatattttcaagttgtagcccaatgttctcatacatgtcatttctgatttaccattaaggatgttctggtaaattgtttctctcgactgctcatgcagtgttttgaactggtgccatagtagatttattttcttcccttcagtatagacacatacatgtgcttatttctaaacctcatcacttgacactgaggaccaggaagcaaaacctaagtgactgaaagtcttttcaagttattctttgattggcttttggagtgagtttgatgcaatctcctcacttttctagccaaggcgatttggccaagttatctgttctcaacctttcggctgtaatactgttttgccaaacacagaaacactaatgtagatagctcacacttacggtttcagaaatttttttcatacaaggaagttttcttaaaatgtgtaaatctctttttttctaaatctacaaacaagatttaataatataacacatatacattgtaatacattttgtaaatatttgcatatgcatatgcacaatatatagtaaacgtaaaccattttatatttccttgtatttcttaaagccaatgaaaaacattttaagtacaatcatataatttactgatcaaagaaaattttttcccactcttctataaacttcacagagcctgagatttttatcaaataaatcttggataccttctagcacttgcgtagtacgtttttttaaatatattttttaaatttagcttttattttcagtagagacagagtcttactatgttggccaggctagtttccaactccctgggctcaagtgattctcccacctcggcctcccaaagtgctgggattacaagcaatgagccaccgtgctggcctagcatagccctttactaaaaaaaaaaaaaaagccactataaatatttgctgagatactgagtgaatggatggactaacaaatgaattaactaatgaagcagtgtctgaatttctgaatttaggagaaattctttttttttttcaggaacattatttaaaatgtatttaacagctccatgcaacttctccagaatgatggacattgccctatggacatacatgaaaaatgtatatatttatttatagcatatatatatagcttccttgattagtgtattcactttatgttgtatgtttttttctacagatgactgtaaaagcctgtttggttatgatacaatttctataagcactaaaacaaacaaactaatagtcccatccctattagtgttgaatatttgaaaggtgttatttttgggtcatttttaaccacgttgatatctctttttctgaatttgactttgtaatacttttttattttttaatttatttttaattttttttttatttccataggttattggggaacaggtggtgtttggttacatgagtaagttctttagtggtgatttgtgagattttggggcacccatcaccgagcagtatatacatcactcaacttgtagtcttttatccctcacccccttctgaccctttccccaagtcccctaagttcattgcatcattcttatgcctttgcatctgtgtagcttagctcccacttacgagtgagaaaatacgatgtttggttttccattcctggattacttcacttagaataatagtctgcagtttcatccaggttcttgcaaatgccattaattcattcctttttatggctgagtagtatttcctcaaatatatatatatatatatatctcacagtttctttatccactcgttgattggtgggtatttgagttggttccacattcttacaattgcaaatcatgccactataaacatgcctgtgcaagtatcttttttgtataatgacttcttttcctctgagtagatgcccagtagtgggattgctggatcaaatagtagttctacttttaattatttaaggaatctccacactgttttccataatggctgtactacttacattcccaccagcagtgcagaagtgttccctgatcactgcatccaggtcaacatctactgtttgatttttttgattatggccattcttgcaggagtaaggttaccaccttactccttatcgcattgtggttttgatttacatgttcctgatcattagtgatgttgatgcatatatttattataacatacatgtaactttcttgattagtgtattcacttaagttgtacttttatttttttctatgaatgactttaaaagcctgtttggttataatacaatttctataggcactaaaacaaacaaatagccccattgctatttgtggtcagaatttgaaagttgttatttttgggtcatttttaaccatgttcatatctctttttctaaatttgactttgtaatgctttcttattttttaatttattttaatttattttaatttttttatttctataggttattggggagcaggtggcatttagtcacatggtatttggttacacaagaaagttctttagtggtgatttgtgaaattttggtgcactcatcacccaagaagtatacactgaacccaatttgtagtcttttatctctcacccccttttcactctttccccgagtccccaaagtccattttgtcattcttatgcttatgcatcctcatagcttagctcccacttacgagtgggaacatgtgatgtttggttttccattcctgagttacttcactcagaataatagtctgcagtctcatccaggttgttgcaaatgccattaattcattcctttttatagctgagtagttttccattgtgtatatataccacagtttctttatctactcgttgattgatgggcattagggttggttccatgtttttgcaattgcgaattgtgctgctataaacatgcgtatgcaagtatctttttcgtataatgatttcttttcctctgggtagatacccagtagtgggattgctcgatcaaatgatagttctacttttagttcttcaaggaatctccacactgtaatgttcttttaaaatatgtgctttttatttcttgcttgtatttttttgtattttgaaattgatttaggaagtatatataatccatagagacctcagcccatttttaaagattcatgttactaacactccaatagcttcctgtgggtttggcgtggtaggaagtacaggtgaaataaggcaaataagacagaactggtattctggagcttgagaaaatgaagaaccctggcaatcacaatgcagtgtgagaagtgttatgagacatgcatttgcaggacccctaggggcacgtgtctgtctcctagtgcagcccaggaggtattgtcttggaaggcatccctcttaaatcatctcccagaggatggcatctgatgagggtaggatgcatattccaggcaaaggaggcaaaggcactgggttattaaagtattgcaaataactcctgcacacttctggtacaagtacaaattggtacaatccccgaggagaaatatttggtaacatctaccagtaataaaatgtattaatgatcagatatgggacccagctctcccagctgttccatttttgagaatgtttcctgcagagacacttgcccatggatgacgtggcggatgcacagttttgttcacggcagccctagccttcgcacagagttacaaacaccctagatgttcctcaggagaggaaggattcaataaaacactgtgtgtccaaatggtgggaatgccactacaatcaaatgataaggaaggctttctgagatatgatgttaggtgaaaaaagtggtttgtaaatggatgtgtatgatatactatatattatgtgaacaagggaaaatacatatatgcctttacttgtttcttgtaaatgtataaagtcatctcaacgtgtaggtaagaagctgacaaaaatatttgtctcagtgtgtggtgttgttatatgggactagatacaggactcgttggggtgaagaatgagagggagagaatggtccaagaaacagctacagaccttctccaagcttccgcagtcatcaactcatggccaattccatttcatcccaactcctagacatttctgcctgccccagagtagaatatcttgtatatatacagatgtgcgcgcacacacacacacacacacacacacacacacacacacacacacacattcatgtgcttggcttatggcccaaataagatccatgcataaaaattaaaggtaaaatttttattttaaatatgtactttgtcaaacttctgcaataattataaaagccttaaattatgaatagagtaaagggagtttgttattagtatcaaactctcctagacacagttttatttttattatgatttttcttttaactcatggtgatctttgtgtgtctttttacatttttaaatatacagggccattgaaggttttctttaggcattaactttttaatttttgtattatagttagaaaatttcagattctttgaaatttgagaagacatactttatgtcaagtgggtaaccaagttttagaaaattttctggaacgcttgaaaagaacgtgttctccaattatttcatgtagttttctatatatgtccattacaaggagcttattaaactattaaatcttttatatttatattagtttgatctctatgccagtcatagaccattctcacagctggtgagaatatgctgaattatcccagtataatggcggatttgttcatttctattttcattctgttaatttttcttttatgtatattatatataaatgccatttaattagatgcatatagatttaaattcttatagctatctgagaacttaacagattttctcaaatggatgactgttttatccataaggatgactttagcattaatatttaattcatctgatgttgatacagttaagcctcttttccttgggttaacatatatttggtctttggttttccatcatcttcttttcaaaccttttgtgtctttatcttttcattatagagtttaatctgtttgtatccattgtgtttgtggactcatttctgtcatcttatattgtactttctgttagtatacttgctgttcatatcacttttattctgtctaccttgtttgtgtttgttttattttagcttattaccattttattttgtcctttattgggtcagaagtcacatcctctaatttcatccttttattggatattatagaaatgttataatatatattttttgaagtgtgtacacaaataaagtgaatgagtaacctgagtcttcttcagaaaaatataaagaccacacaaagtgggcacatagctgtggagggacaaaggtgatgctgggcacacagactgaccacacagagctgggtctcttcaacaatgtcgtatgtctacgtgaagaaggatgccaaggcacactctaagataatgtgtgttgggggggaggaggcgtgtgtgtgaatgtgtgcggcacacctgatgcatgctcaggagtgtatgtatatctgtgcaccattgtttttaattcaaaaagtgcatagctttcattttcacaggaagttatgatgcctcatacagcaagtacctttggtacctttggatagactttttttttttttttttttgagacagagtctcgctctgtcaccaggctggagtacagtggtgcgatcttggctcactataacctctgcctgccgggttcaagggattctcctgcctcagcctcccaagtagctgggactacaggcacgcaccaccatgcccagctaatttttgtattagtagagatggggttttgccatgttggccagcctggtcttgaactcctgacctcaggtgatccacctgcctcggcctcccaaagtgctgggattgcaggcgtgagccaccgtgcccagcctgaatagacattttaaggtagcatgtcatttttgccatgaatttggcagctgtctacattctaaaaagctagattcaactttgaaacttccccagtctaggagagtatagtgtaaacagatcaatcaccatagaagggggattaaacagacatattctgagcaggcaactggaacatgaaaccactttaagtagcagaattgggcctgttgtgtttagaggcacaaaaggaactgtgaaatatctaaaatccaatagctaagagaaatttcacatggagagactgagaaacttctgcaataattatgaaagccttaagttatgaatgcaaaaacacagtgttgcagatgtttctgtagaaatctacaaaaatgaatctattgcccaccgaaactcaggacagtaaggaagcagaaagttacggcaagactgggctaattctaattccattggccatgcccggctaagcatttcattaattctttactgagaagagatttgaattacagttggcatcaagaagtagttacatctctatttgccaagatcaatcattcagcaaaatttaataattgattcagtaatatagtgtcagtcattcctaaataatgttttctgtttgttttatacatttctgaagcaaaaggacaaaacaattatttttaaaaatgaaaggccagtaccaaaaaggcaaagtcaaaattctgcaagttttggtgctgatcatgggttggccagatatactttattgcttttggaaatggttcttgagtgattagtgtaggaaatagtgtagaaatattctggaagggctttctctgcctttgtgtgaagatttccagttccccggagccacagagcctgattcatttgtctacacacaataataataataataataatgatgattattattattattctgagttgcttgagctctctctctctctctctctctatatatatatatatatacacacacacacaaacatatatatattctggttattaatctctcattaaatgtatagtttgcaattattttcttccattctttaggttgtctcttcattgaaagtttattataccatgcagaagcttttgagcttcatgttattccatttgtctgctttgcttttactgcctgtgctttggacatcttactcaaaaagtctttgtccagaccagtgtcctcaagcatttccccatagttttcttctagtagcttcatagtttgtggtgataaactatgagcatgcagttttgactccatttgccagtgttgtggactaaagttgtgaggacagaatggtttgtgttttcataagttttcttatgcaaagttgatttgatgacagtggcctcctaagaatgaactttcatcaaaacattgaggtctccaaccaaacagacacaaaagcactccttaatgtgggagtcttcagtaccatataaaatgtgcaaattagcaacatttctgagtattgagctccaagattcaactctggaatattttatggttttctttgttttaatacttaatggaggagacacatttttgcttgtaaacgaataaactcatgtgtctaattatgtattaggaaaatgaggtcatttccttctatgtggtaatatattcacatatagggggaaatgccataatatatgggacaataaggtgaataatactata

SEQ ID NO: 167 - DNA, 50209 bp, Homo sapiens
ctatgagaccttgacatgactacactaagttcattttcaggtgcttattcaaaggggaagtcactgatggcaaattctacctcacaacctcatctgtatagaaaagatgtgccatgatcgtgccactgcactctagcctgggcaacagagtgagaccttgtctctaaataataataataataaattccaaaacaaaacaaaacaacaacttatagtggccataagctcaagaccacaatgcaatcatggttagaaattagtactcaattgtacagaagaagccattaagcccctcctaccacagctaactgagattccggctggtggctctgaggctttgtcctccatctgtccatggtgatgctctagcatttcataacagggttggtctggtcagctctcaacacatcaacataacttactcttgcatccgagagattattcaagtgccaagtaccatcactttcttcttcttctttttttttttccttgagacaaaatcttgctctgtcacccaggctggagtgtagtggcgccatctgggctcactgcaacctctgcttcccgggctcaagttattctcatgcctcagcctcccgagtagctgggaccacagatgcatgccatcacgcccagctaatttttgtatttttagtagagacaggttttccacattggccaggctggtctcgaactcctggcctcaagtgatccacccaccctggcctcccaaagtgctgggattacaggtgtgagccaccacacctggccactatcaactcttcattgttgagtttttctaagttaaaacaacctgttttttgagctatgctgcatattacatgtttcaggaactccccatagactgatttcccagctccagaaacatgcaatccatctgctattcccttgggctttttgctttcttctttattttagagatgggggagggtctcactatgttgcccaggctggacttggcctcctgggctcaagagatcttcccacccctgcctctcaagtagctgggactacaggtgtgagccactgtgcctagctttttgatatcttgattccctcagaaccaggtggaaacatgttctgaataaaagccagtcctgggtattcttgctctactcaccggcttggttgtgttgggctgagccttatagaacacagtgctggagaccttctcagggtcacttcctgtacccttgactttgagctgcagccctctggttttctcaggtgagttttcttgactctttccactactcttcagccgataaagtgaccattccactcatgtgctttcccctggggtaactcctagtggatgcagtgttgggaccccttagtttcactgggcagtgtcacagggcaggctctttagaagcagaatttcagctggagtttggggcacaggaggtttatcagttgatgtaaagggaaggaggaggaagcaggatcgggcagggggagagctgagtatgatgcaagccacacaaagccttggccagcccagcggggagctctggagcagggatggcgtggcagagtgttttggggtaaagggcatgagcttggggaagtgactttctgcagactctgatggagctgacatctggaggctgcctgcccaccgcactccctgcagctgtgcagcgagcctttccttgaaaaggggtctcagtggtgcacatttttttttgagacagagtcttgctctgtcgctcaggctggagtatagtggcatgatctctgctcattgcaacctctgcctcccgggttcaagcgattctcacgcctcagccacccaagtagctgagattacaggcgtgcaccaccacacgtctctactgtttttagtagagacggggtttcagcatgttgaccaggctggtctcgaactcccgatctcaagtgatccgcccgcctcggcctcccaaagtgctgggattccaggtgtgagccaccgcacccagccagtggttcacatctttgtctcccactgtcaggaaaggtatggggaggagctgtgaaaagaaatgggtggccactgggtaagtaactggggacccagggaaaatcctgttactcccatgactcgcccacatggtcctgagccagtcactttaccactctgtgcctcagtttcctcaagactcagttgagggttggggagtatatccattcattcttctgacctatattgactgagtacctacatgtgccaggcactgtgccaagttataacagtcaacaaggcacacaaaacctcgccctcagggagctgacattgccaagaacccctcaaatctacccagtgacccagactgagggcagatgtcacccctggccttgcttgcaatgatcatgacgcacagtgagcaccgtggcctcgttgcatattcagacagatgacagcctgacatggaagctgaggatctaatcagtggcatccacatggtaacaggaaggaaggagccactgtgggtccttgagcaggagcacggagatatcagtgcaaaacttcagaagggcaattccagtggcaatcaatagaaaaagacctttttactgcatgtcaccctgccccttaggtgagtcaaattaaggcaaatagccgaggccaggccaccctgtctgtcccctgttatatttttggttttggtttgtttatagctgagttattccctagtggtggcagtgatgattgggaatttggctttctgatctgaccatttggtgacttctgggaatgaatgaacggatgttggcagagaacagcaggagtcaggcatgttatcctgtgtctcttggatctcttgccctgtggctaacggtgtgaaaatgaagcattaagctccctctgtggctgcagtcagactcctggggtgagtgagtaatgttttcccatctctggagggtgtctatacattattttgtaatgtcacttgaattaaaggaactcagttctgattggctgatagagataaataagcacttatacaaatcaaatattcctaaaatttaggaaaatgaggaaatcagactttttaaatggctgtcctctgtagtccaggaagaaactgaacttttagtaccgtaaatgcactagtcttgaaaaagattcctccttcagaaactaattcagagactttaagaatccaagttctcataattaagataaatctttggcaaatgacattagtttaattatttgagtttaataaaaacagtataggatgggtgcagtggcttatgcctgtagtcccagcactttgggaggccaacgtgggagaatcccttgagcctgggagtttaagaccaacctggccaacatggcaaaaccctgtctctaccaaaaatacaaaaattcgccagtagtggtggtgtgcgcctgtagtcccagctacttgggaggctgaggtgggaggatggtttgagcctgggaggcagaggttgcagtgagctgagatcatgccattgcactccagctggggtgacagagccagatcctgtctcaaaaaaagcaaaaacaaaaacaaaaacaaaattatgctattattaagtaattatcctgtaattattatggatgctttctctctgatttgttagtgttaagtataatacaagtgtgcatttatctacttaagtttgtattttcctaaattgatgaaggtttactgatcaaataagctaccacttctcctccataatgttgaagattacaaaaaatgtatccttgcatttgactaaaataaatcattaatctaataagtttatttcaacgtaattatgttttgtagtacgtcatcttgaagataacttccaagatctttaggtaattgaaaattctgactgatactcaattgacttaattaatggatgttcactggatgcccagagcatttctaagtaaggaagaaaacggaaacactgattactaagcacaattttaaatttgtataattttgcttattattatttttaaatttaattcaatttattttaattgagacagggtcttacttcgttgccctggctggaatgcagtggtgcgaacacagctcattgtggccttgacctcccaggctcaagcgattctcccacctgagcctcccaagtagttgggactactggcgcatgccaccaagcccggctagttttcgctttttgttttttgagacagggtctcactctggttgcccaggctggagtgcagtggcctgatcttggctcactgcagcctcgaactctcaagcttaggtgattctcccacctcagcctcccgagtagctgggacaacaggcacacaccaccacacccagctaatttgtgttttttgttgttgttgttattgttgttgtttgagatggagtctcactctgtctcccaggctagagtgcagtggcgtgatctcagctcactgcaagctctgtctcccgggttcacaccattctcctgcctcagcctcccgagtatttgggactacaggtgcctgccaccatgcccagctaattttttgttgttgttgttgttgttgtatttttagtagagatggggtttcaccgtgttagccaggatggtctcaatctcctgacctcgtgacctgctcacctcggcctcccaaagtgctgggattacaggcgtgagccactgcgcccggcctaatttgtgtatttttttttagagagagggtttcaccatgttgcccaggcaggtctcgaactcctgaactcaagcagtcttctcgcctcggccacctgaagtgctgggattacaggcctgagccactgcacccagccatatttttgtattttttgtagagatggggtttcgccatgttgcccaggctggtctggaactcccaagctcaagcaattcacctgcctcggcctcctgaagtgctgggattacaggcgtgggccactgtgcctggcctgctgcttgtttgtatgtgctacagagaggccctgttttggggtctatcaatcaacatatccatttttgccacatcaagatgtcatataagggatgtgggccattctagggagctggtttaagtgtagccctgagcttggctagttgactaaaatgacatttcacaattatccacaccttggtgaagtcaaagttagttctatttaatctcttagggcttattaaagaccccaaagagctttgatttacgtgggttatggctattgatacttactgggttagaaattaaaacagaaaattgtaaatatttattgagtcatagtaataacaaatgcattaacatgtttaacataaagaatatcttagggccgggtgcagtggctcatgcctgtaatcccagtactttgggaggctgaggtgggaggatcacttgaggctgtagtcagactcctcaggtgagtgagcaatattttcctgtttctggagggtatccataaattattttatgaagtcacttaaattaaaggaactctgttctgattggctgatagaaataaataagcacatatacaaatcaaatatttctaaaattataggaaaattagaaaatcaaactttttttttatttcctgggcaacatagagagaccttgtctctacttttaatttttatttaaaagtaaaaaatgttgggtgtgatggtgcatacctgtagtcccaactatgtgggaggctgagatgggaggattgcttgagcccaggagtttgaggccatagtgagctatgatggttgctactacactcaagcctggaagacagagcaagaccctgtctcataaaacaaaacaaaacaaaaacatatcttggtattactatgaaatcagttctgacctttgggcccttgacatctgtcttcaagtaaagtgtcagtttgttccatgatatgaaacttggaaagtgaatgttatttgccttggctgataacccctgagttatggaggaagctatgcaatgtattcatgtcttaggtttgtttccttggcttacaacatacatggtgattcttttttttttgtgagacggagtctcgcttctctgtcgtccaggctggagtgcagtggtgcaatcccggctcactgcaacctctgccccctgggttcaagcgattctcctgcatcagcctcccgagtagctgggactacaggcacgcgccaccatgcccggctaatttttgtatttttagtagagatggagtttcaccatgttggccaggctggtctccatctcctgacctcgtgatccgcatgcctcggcctcccaaagttctgggattacaggcgtgagccaccgcgcccagcctgttattctttactttatatttaatctgcctagagaggaaagaatgttttactagaatagttttctgtgctttattttggctttagtatgtccttaatttttttggggggggcggggcgcagcgcggacagaatcttgctctgtcacccaggctggcgtgcagtggtgcccatcttggctcattgccacctctgcctctcgggttcaagcaattctcctgcctccgcctcccgagtagctgggattacaggtgcgtgcaaccatgcctggctaatttttgtatttttaatagagatgggatttcaccagttgcccaggctggtctcgaactcctgggctcaagtgatcaccccgcttggcctcccaaagtgctgggattacagatgtgaggcaccgtgcctagccaattttttttttttttttggagatggagtctcgctctgttgcccaggctggagtgcagtggcgcaatctcagctcactgcaacctccgcctcctaggttcaagtgattctcctgcctcagcctcccaagtagctgggattacaggcacacaccaccaggcccggctaatttttgtattttttttagtagaggtggggttttaccatgttggccaggctggtcttgaactcctgacctcaggtaatccacccaccttggcctcccaaagtgctgggattacaggcgtgagccaccgctcctggcctcgtgcctggcctattatgtccttaatttttgttttgttttgttttgttttgagacagagtcttgctctgtcacccaggctggaatgcagtggtgcgatctcggctcactgcaacctctgcctcctgggttcaagcaattctcctgccgcagcttcctgagtagctgggactacaggtgcctgccaccatgcccggctaattttttgtatttttaatagagatggggtttcaccgtgttagccaggatggtcgtgatctcctgacctcatgatccgcccacctcggcctcccaaagtgctgggattacaggcatgagccaccgcgtccagccctatgtccttaatttttgaagaaaagaaatacaaagaaaaaaattttctctcttaagtgatttataatcatgttactctctatccgtatttttatgttttattgtcactttggtcaccattattgtttctcaggtacctataatatcttactcaagtgtataaaactcctcttaatttttcttttttcctttttttttttttgagatggagtctcgctcttgtcgcccaggctggagtgcaatggtgtgacctcagctcactgcaacccctgcctcctgggttcaagcgattctcctgcctcagcctcccaagtagctgggattacaggtgtgagccaccatgcccagctaatttttgtatttttagcagagacggggttttaccatgttggccaggctagtcttgaactcctgacctgagacgatctgcctgcctcagcctcccaaagtgctgggattacaggcgtgagccaccgtgcctggtcttctttttttttgagagggagtgtctcactctggcgcccaaactggagtgcaatggcatgatctcggctcactgcaaccttcacttcctgggctcaagcaattctcccacctcagcctcccgagtagttgggattccaggcacgtgccaccatgcccagctaatttttgtatttttagtagagacggggtttcaccatgttggccaggctagtctcgaactcctgaccttagttgatctgcccacctcagcctcccaaagtgctgggattacaggtgtgagccaccttgcctggccaagccaccatgcctggcttaggttttcatttttatcttcccaaagtcagacctaaatatagaaaaaaataaagtttaactttcatgatctcctttgtacctaaaactatctttgagatttcacacagggatcctagaaagttacaaggatcagttatttcactttatttaaaaaggatgctagataccgggtgtggtggctcatgtctgtaaacactttgggaggctgaggcaggcagatcacatgaagctaggagttctcgccaacatagtgaaactctgtctctactaaaaatacaaaaattaggctgggcgtggtggctcatgcctgtaatcccagcactttgggagtgagtccgaggcaggcggatcacctgaggtcaggagtttgagaccagcctggccaacatggtgaaactccgtctctactgaaaacacgaaaattagctgggcgtggtggtgtgtgcctgtagtcctagctccttgggaggcagaggtgagagaattgcttgaacctgggagatggaggctgcagtgagctgagatcatgccattgcactccaacctgggtgatagagtgagactccgtctcaaaaaaaaaaaaaaaaaaattaggccgggcatggtggctcatgcctgtaatcccagcactttgggaggccaaggcgggcagatcgcttgaggttagaagttcgagaccaacctgggcaacatggggaaaccccatttctactaaaaatacaaaaattattggtggcgggcgcctataatcccagctactcgggagactgaggcaggagaatctcttgaacccaggaggcagaggttgcagtgagccaagatcacgtcactgcactccagcctcggtgacagagtgagactctgtctcaaaaaaagaaaacaaacaaacaaacaaacaaaaaaagtgtatgctttatcggaagttcctggagatgtgtgcccttgcttttcataatatgttgcaacttagaggaaacactgaatgaaactgttatgaaatatttcctgggcagggcggtggctcatgcctgtaatcccagcactttgggaggccaaggcaggaggatcacttgagcccaggagttcaatacaagcctgggcaacacagtgagaccccgtctctactaaaaatttttttttaaaaagtaaacgggcatggtggcatgcacctatactctcagttactcaggatgctgaggtgggaggactgcttgagcctcgtaggtcatggctgcagtgagctgagattgtgccatggccacagagcaagaccctgtctcaaaaaaaagaaaaaaattattttcgttgagttttcctgtattcatcagagtcctggtggtgctttgcttgatgatattagacaacagcagtatagagtattattggtcataataattggttattattgtaaatgcttacttgctcacagccttctttaatttgaatctgacatcttctaggccagtgacgctcagtgcacatcagacttacccataaggttttattaaaatacagatgtttagattctactccaaactgactgaatctcgttattttatattcttggtatattatgcatgctacatctcaggattattatatactatatacaaatttttttttctatatactatatacaagtttttttttctggttggacgtggtggctgatgcctgtaatcccaacactttgggaggccaaggtgggcaatgacttgagcccatgagttcgagaccagcctgggcaacatggcaaaacccagtctctacaaaatagtacaaaaaattacctgggcatggtggcatgtgcctgtaatctcagctactggggaggctgaggtgggagagttgcttgagtccatgaggtcaagactgcagtaagctgtgattataccactgcactcaagcctgggcaacagggcaaaaccctgtctctaaaaaaaaaaaaaaaaagtaaaaataaagattttttcctctataagaatgtgttcatccatatttataaatgagaggtagcattcacaggtgtctttgaaaataaactttggccaggtgcagtggctcattacctataatcccagcactttgggaggctgaggcaggtggatcacctgaggtcaggagttgaagaccagcctggccaacatggtgaaaccctgtctctactaaaagtacaaaaattagctgggcgtggtggcgggtgcctgtagtcccagctacttgggagcctgaggcacaagaatcactcgaaccagagaggtagggttgcagtgggccgagagcgtgccactgcactccagcctgggagacagagtgagattctgtatcaaaaaaaaaaaaaaaaaaaaaaaaaaaacggcggggcatggcggctcatgcctgtaatcccagcactttaggaggctgaggcaggtggatcacttgaggtcaggagttcaagaccagcctggccaacatggcgaaaccccatctctaataaaaatacaaaaacattagccgggcctggtggcacgcacctgtagtcccagctactcgggaggctgagggagagaattccttgaacctgggaggcagaggttacagtgagccgagatcgtgctactgcactccagcctgggtggtagagcaagactccatctcaaaaaataaataaataaaaataaacttaatcattatctttagagacatttttgtctaaaaaaattattaggaacggcttaaaactgcaaacatttttatcttagtttctgtaggtgtgggatctgggtgcagctttgctattactaatagatagtcctggctcagggtctctcatgaagttgcgtctagggctacagtcatctgaaggcttgactggggctgggggtgtctgctcccaagaaggcccactcacctggctgatggctggtgttggctattggctggggtgcttcaggtctcctccatgtggcctctcagtctccagggcctcatttttttcatatagcctttctaattgatggctgggctccagtgagacagagagagggatctttttataaatgaatctcagaggtggtattatcatttctaccatattctatttgttttgagtcacaaaatccagaccacactcaaggcggggggcacagacaccaggatggggaatcatcagggaccacctcaaaggctgaccacagcattgcccctaaaatgtatggggccccagacaagtattttttgcaggaactctgtctatataaacaatttaaatacaaaatgtattacaagatcatgagtccatatgaggtattgggatttactgatgaagattttaatttatttattttagagatggggtcttgctctgtcacgcaagctggaatgcagtggcgtgatctcacctcactgcagcctcaaattcctgggctcaaatgatcttcccaccttggcctccagagtagctggaattataggcatgacgccactatgctcagctaattaaaaatttttgttgttgttggtggagatagtgtcttgcttttggagggtaaaggtttagaacaatgtgtcgacccattgtgaagtgaaataaatcaatcaataaataaaatagaacagtgtgtatgtctgggtgtggtgactcacccaactacttgggaggctgaggtggagcccagggttgagaaatgttcaaggctgcagtgagccatgatggcaccactgcacttcagcctgtctctaaaaagaaaaatttttaaatgaaataatgctatagctgtcataaatttgtaggtactaattaatagagtggcaagatgcaaaaagtataacctctgggaaatgtaataaataaatgatggaaatataccagaagcaggaggctttaacttacctttgtcagcaaatgacagctctagtagacaaaaacaaaaacagtataattaataaagctatatcaaattctcttttcttaaaaccatgaatacatcttttagtcagtcagcaactatggaacattagtaatcactggccataatattaggccacagagaaaagtttaataaattccaaaaagtagaatggatacagaccacattctttgaccataatgcaataaacataaacatggactttttcttttttctttccctttcttttttttttcttttcttttttttttgagacagagtcttgctctgtcacccaggctagagggcagtggtgtgatcatggttcactgcagcctctgcctcttgggctcaagtgattctcctacctcagcctcctgagtagctgggactacaggcgtgagccaccacacccagctaactttttgtatttttttgtagagacggagttttgccatgttgcccaggctggtcttgaactcctgagctcaagcaatcctcctgcttcggcctctcaaagtactgggattacaggtgtgagccaccaggtctggccaaacttggattttttaaaacaaaaataaaaccacaaaactccaatagctcagggaaaaaagatttagctctctcacgttttataatatccagtgctgtcaagagtatgaggaaaactgataatatataacaggtggcagtataaaattcagcaagcattttagaaaaagtttcacagtatttatcaaagttttacatttatatacattttgatccaggattttttttttttttggctaggaatttgctctttgtgtgtgtggtttttttttttgttttgtttttactttgtaaatttacttaaaaaaatagctgtctgcatatttttaatggatgagtaaaccaaaaatatataaacagctatttataaaggggtgaataaaaaaagataaaatagtttcttatgggtggagggagagggaagaaggttgaggagacagggatagaagctagatttatctaaatataccatattattattattattattattattttgagacggagtctcactgtgtcgcccaggctggagtgcagtggcacgatctcggctcactgcaacctccgccacccgggttcacgccattctcctgcctcagcttcccgagtagctggcactacaggctcccgccaccacacccggctaatttttttgtatttttagtagagacggggtttcaccgtgttagccaggatggtcttgatctcctaacctcgtgatccacacgccttggcctcccaaagtgctgggattacaggcgtgagccactgcgcctggcccatattattattatttatcttttgaatatactgtactattattgagaaccatgcaaacacagtatcattgtataatcattattatataaaattatgtattatttaaaaattgcatcatatcaaaaggaagttatagattactggggtcatatcaagcaagtttcaaaggctcccattggccaaagatggggcaatttgagcatcaaaaagaacaataactgcaatagattgaaatacatcacctagccctcagggcagaatgatgccacaaaatctccctggccacctttggaggatgctagtgaaccaactcattctgaaaactgataaataaagagagagacaaagtaactgactagataattgattaaagaattattatttttgagatatgatcatgatttactgctaacttgttaaaagctcttatcatttgggccgggcgcggtggctcacgcccgtaatcccagcactttgggaggctgaggcgggcggatcacaaggtcaagagatggagaccatcctggccaacatggtgtaaccccgactctactaaaaatacaaaaattagctgggcgtggtggtgtgcacctgtagtcccagctactcgggaggctgaagcaggagaattgcttgaacctgggagacggaggttgcagtgagccgagattgcaccactgcactccagcctggcaacagagcaagactctgtctcaaaaaaaaaaaacaaaaaaaggaaaagttcttatcatttacagcaacatcttgagagattcatgggtaaaatgatgtaatatctgggtgttgcttcaaaataatccagtggggatgtgggtagaggacataaaagaaacaacattggctgtgaattgataaatgttgaactaggtgatgactacatggagatttattgtattgttctctctacttttttatacgcttgaaattttccataacagaaaaataattttatggaggcaaaagctgtaaacagtgttctatgcctatattgagagtatgactcatgacttttttttaaaaaaagccagacctgaccttaaaaatttcttttattttaatttaattaaaaaaaatttttttagagacagcgtctcactttgtcgcccagactggagtgcactggtgtgctcatagctcattgtgcagctttgaactcctgggctcaagcgatccttccaccttagcttcttgagtagctgagactacaggcacgaaccaccacacccaactaatgtctttatattttatattattttattataattttattttactgtattttatttatttgtttgttttgagacagggtctttgctctgtcacccacgctggagtgcagtggcatgatctcagctcactggagccttgacttcctgggctcaagtgatcctcccacctcagtctcccaagtagctgggactacaggcatgcaccaccacacctggctaatttttaaaaaattttggtagcaatgggacctcaacatgttgcccaggctggtctcaaactcctggactcaagcaatcctccctcctcagcttcccaaaatgttgggattagaggcattgaaccactgcacctggcctattttatttttgaaaatagagacaggtggggggggtgggtgtctccctatattgctcaggctggtcccgaactcctggtctcaagtgatccttttggcttcccaaagtgctgggattacatgagccaccactcctggccactgtgctgggtttaattgtggagaactataactaagcattgtctttaaaaaacgagtacattggccgggcgcggtggctcacgcctgtaatctcagcactctgggaggcggaggcgggcggatcacgaggtcaggagatcgagaccatcctggctaacacggtgaaacccccatctctactaaaaatacaaaaaattagccgggcgtggtggcgggcacctgtagtcccagctactcgggaggctgaggcaggagaatggcgtgaacccaggaggcggagcttgcagtgagccgagatcgcaccactgcactccagcctgggcgacagagtgagactgcctcaaaaaaaaaaaaaaaaaaaaaagagtacattttgggccggttgcagtggctcacatctacaatcccagtactttgggaggccgaggcaggcggatcacctgaagtcagaagttggagaccagcctgggcaacacggcaaaaccccgtctctactaaaaaaacataaaaactagccaggcatgttggcgggcgtctgtaatcccagctactcgggaggctaaggcaggaaaattccttgaacctgggaggtggaggttgcagtgagcccggatcacgccactgcactccagcctgggagacagagggagactccatctcaaaaaaaaattaaaattaaattaaaataaaaaaagaacattttggcctacaattcctgacaaagatggaatgtgggcaaatgcatgatgacctggattatttctgggagaattgtaaagagtttctgtagtcagcagaaatgctttgaatactttccatatattagttcattaatcccccatgaagtacaagtaggggaaactgaggcacagggaagttgactaatttgcccagggtcacaaagtgagtaagtggcagaaccgctatttgaacctagctgcgctcatagtgctttaatcttcaatcagcgaggatcgtcaagttggctgctggatctttctggatctttttttcattacctcgcctttcatgttgtttgtccacatagcttgaggctttatcacagattgctcttgggggcagtgttactccagaaatgccggaatgctccgctattcctcactccacccctaaatatacagcatctcctcccgcccttaagctctgaaaaaaatgctgcggagccagaaaggctgcagaaagccgggtgtgaccactggctctgtagccaacctgttccctgctgctgctgctgctgctgctgctgctgctgctgcagtcgtttggtttcctctttgaatctgagatgattctgaggtctacactgcaaactcttggcatatatcatttctagaattccattcctactcgacctaggctgtgagtctgcactagttcgcggcacgttagatcgcgcccatttcccttattggcaagttgtcaggttgaggaagctccaggcctggaggagggcatctccagccaccagccatgaagcccagggcctcaggcaccttctggcctccgggtggcctcctctattcgctgacccagacactagtccagtggttcccaaagtggggttccctggcaggcagcagctgcctcgctgggaatctattaaaaatgcatactcccaggccccacccatgacccactgaatcagaagctgtgggcctggggcccagcagttggtgttttcagaagccctccagtggactccaatggttcctagagtttcaaaagcacactgggctaggccaggtgtgccaagagagaagtagctttttggctcaagtcctcacaggaatggtcagagggtccccatcagtctatcagtgtgcaccatacaacgctcacagagggacacacgtgtgcccgtgtgcatgcgtccctgtatggactccagttggagggggagggacagttttgccttgtggttttgtcactcgccattggaaaatagccctttcccctactactaaatagcttcccattgttttctagtccctttacttccatttcagagagtgttttctcttctgtgtttttttgtttgtttgttttttgagacggagtctcactctctcacccaggctggagtgcagtggcgcgatcctggcccattgcaacctccgcctccgggattcaagcaattctcctgcctcagcctgctaagtagctgggattacaagtgcctgctaccacactcacctaattttgtatttttaatagagataggggttttgccatgttggccaggttggtctcgaactcctgacctcagatgatccacctgcctcgacctcccaagtgctgggattacaggcatgagccaccatgctgggtccctcttctctttggaaaagtcatccacgttggttgcaagtttttcagaaaagagggaactacattatagaaataaatggcaaacagacacccaacacccaaggaataatttctcatctctgtcctttcaatgtgtatatttctaaatgtccgtgtttatatttacataaattaaaaaaaacggtttacttgtacgtgtcattttgtttttatcttaaatttttgtgtttttaattttggtgatatatcattttggttgtactttttcacttctgtacatactgttacataacatgcagttttccagtaacactaacttgtgaatgcatattttacaattttatttatatttatttatttatttacttttgagacagtctcactctgtctcccaggctggagtgcagtggcttgatctcggctccctgcaacctccacctcccaggttcaagcaattctcctgccttagcttcccgggtagctgggattacagacccgccaccgcgcctggctaatttttgtttttttaagtagagacggggttttaccatgttggccaggctggtctcaaactcctgatctcaggtgatctgcctgcctaggcctcccaaagtgctgggattacaggcgtgagccaccgcgcccggccccccctttttttttttttgagactgagtttccatcttgttgcccaggctggagtacaatgatgcgatctcagctcaccacaacctccgcgtcccgggttccaacgattctcctgcctcagcctccccagtagctgggattacaggcatgcaccaccacacccggctaattttgtattttcggtagagacggggtttctccatgttggtcaggctgatctcaaactcccaacctcaggtgatccgctcacctccacctcccaaattgctgggattacaggcatgagccaccgtgcctggcaggatagaagccattttaactggggtgagatggtatctcattgtagttttgatttgcatttctctgatgatcagtgacattgagcaccttttcctatgcctgcttgtcatttgtaggtcttcttttgagaaatgtctattgagatcttttgcccactttttgatcagattattagattttttcctctagggttgtttgagctctttatatattctggttattagtcccttgtcagatgggtagtttgcgaatattttctcccattctttgggttgtctcttcactttgtggattgtttcctttgctgtgcagaagttttttaacttgatgtgatcccatttgtccatttttgctttggttgcctgtgtttgccaaattcattttacaaggccagcattaccctaatgccaaagtcagacactacaagaacactacagccaatatccctgatgaacataaatgcaaaaagcctgcacgaaatactaacaaacaaaatccaacagcacattaaaaggatcatacatcatgaccaaatgggattaatccctaagatgcaaggatgggtcaacatacataaattaataaatgtgatataccacattaacagaatgaaggataacaatcatctcaaaagattcagaaagagtatttcacaaaaattcaatgccacttcatgataaaaactctaaactaggtatagatggaatttacctaagcataataaaggccatatatgcctggctaatttttgtatttttaatagagacggggattcaccacgttggccaggctggtcttgatctcctgacctcaaatgatcctcacctcggcctcccaaagtgttgggattacaggcgtgagccaccgcaccctgccacaattttcttctaagataaaaaagtttacataagggttctctgggatggaaacaaaagttggacagagccaggattattttaataaaatacaattaataggagttgtgataaatgaaatgatgccccacaaaagtgcccatgtcttaacccccacgttctaggaatatattatggtatatgacaaagaatagaggctgtagataaaatcaaggatgataatcagatgactctaaaacaaagagattaatttgaattatgagattggtgtctacagccataccaccctgaatgcacctgatcttatctgaattataagtgtgagcctagggtaatcacaaaagttcttaaatgggaatgagaggctaagaaaattaatgctgtgatatgagagtcagatttttttttaatttttttttaaattatgttgggctgggcacagtggctcacgcctataatcccagaactttgggaggccaaggcgggcggatcacctgaggtcaggagttcgagacaagcctggccaacatggtgaaaccccatctctactaaaaatataaaaattagccaggcatggtggcaggtgcctgtaatcccagattcttgggaggctgaggtaagggaattgcttgaacctatgaggcagaggttacagtgagccgagatcacaccattgcactccagcctgggggacaagagtaaaactccgtcacaaaaaaaaaaaaaaaaaaagtatgtatacacggccaggcacggtggctcacgcctgtaatcccagcactttgggaggccaaggtgggtggttcacttgaggtcaagagttggagaccagcctagccaacacggtgaaaccttgtctctactaaaaatacaaaaattagccaggcatggtggtgcacacctttagtcccagctactagggaggttgaggtaagagaattgcttgaatccgggaggtggaggttgcagtgagccgagatcatgccactgcactccagcctgggcgacagagagactccatctcaaaaaaagaaaaaaaaaatatatatatatacacacacacacacacacaattattcttagaatatatatatatatatatatatacatatatatatatatatatactaggtatatagtgtaaaaataatgctgactgtacttttgaaaatttatgtaatagaattaatcaagaattttatgagataaaaaagtgatgattttgaacatacaataaataacatttatgaggtaaagtctattttttttttttgagacagagtcttgctctgttgcccaggctggagtgcagtggcgcgatcttggctcactgcaagctccacctcccgggttcatgccattctcctgcctcagcctcccaagtaactgggactacaggtgcctgccaccacgcccagctaattttttgtgtttttagtagagatgaggtttcaccgtgttagccaggatggtctccatctcctaacctcgtgatccgcccaccttggcctcccaaagtgctgggattacaggcgtgagccaccacgccgggtgtaaagtctattattttcagatattcaaaatatgtttctcttttgcaatttacattattacattccacttatgttttcattgaaaaatgcctctttttttcaagctggcattggaatcttgaccctcagcttcctcattttcttcctcgtcttcacacttcttctgtaatgcaggcctgagcccacagacctgaccatttatcacctggtcttcatccacatagtgatcctccttactctggtgtcattgttgtctccaggtctgcctgagtcactgtattttcagaatgacttcaagtgtaaaggattttttttacctgaacaagatgatgagaagtttctccatctgcaccacctgcttcctgagtgtgcttcagaccataatcatcagccccagaagctcttggttggtgaggtttaaccataaatccaccattttcacctgtcatttcttgttgtttttacattttctcagtttttttttttttcagtagtaatctcatcttgtgcactgtggggtcttctaatgtgaccctgagcaatcttctgcataccagtaaagactgttcacttttccaccatgaactccatcatcagaagactgtttcttactctgtttcttactccagatatgtttttcttataggaacaatgctgctttcaagtgcatacagagtggtccttttgttcaggcaccagaagaaattctgatactttcacagcaccagcctctccccaagaccttccccagagaaaagtgccactcagaccatcctgctgctagtgagtttctttgtggtcatctactgggtcgatttcatcatctcatgcacctcaacctcgctatgggcatatgaccctgttgtcctgggtgtccagaggcttgtcagtcttttggtgctactcagatctgataaaaggataatcattgtgacacaaactgtgagacagagggttaacaagttatttttattgaaaatagattattctgtcaccagttaaattacataagtagtacagaacttgctatttaatttaacttaaatgtatggatttacactttcaatatgtctaaatacttttgaatcaaatgctgccaattctctgtgggttttttttagtttaacatacatgatggatagatactcccatatgtttacaagtgtcttctttttcattttgattttcaggccttaatacagagaacatttttctttctttttgaagtataatattaagaatatcctcctggtaatataatctctctgtcttcgtatttttgagaatgttttatttttatttattaaagatatttgactaaatattaaattcttacactcaatatttacttctccttgttctggcttctatcaaggctgtgtggatggtgcctacaaatttgtggcttacctctgttttttatctccctaattttaagatttttctttctttttagtgttatacagcttgactattatttctgtataaatgatcacctgtatttaccttttttttgaaaactatgtacttctgaattcgagaattttttctggcttttaattttacaaaaaattatttctttctaaaattacatttgtgtcttattctttgtatgtatttcagtgaaacaactgaatatactttattccttctaatctttgtctttatagatctataaatatatttacatcttatatcactttacttttattagcatcgattttctctccttaatcttccagtgcactatttatctcattagcttattctaagttaatagtttcccaatacaatgtatattgaatttatagatttttatttctcatttattcaatttacagttagctctttccatggatgctcttcaatttttaagtttcttcctctttaaacactatttttgtctcttattttatcactgaattgatgtaaacattttaaatacaattccaattattattaatttatgtagcatccaatttcttcttactctaaattgtggtagcttattttgtgtgtgtgtgtacttcataacttcttataatttagctgtcatgattgggagacctttccctgtaaatgtcttcaatcagtatatttgtttgttctacttaacctggcacaatattatcaattttgccttgtgatcagccattcgcttctcacgttgataaagcctttgaatcttttcttgactcatttgtgttcctggaaagttctgatatttttcctttcagccccattgggcattctagagatttttgtaacttttgatgcacaaactttcacactgcacacataaaatattttagttatgtaatgctaccacacatcagcatcttatgagaaatcttgagtctctttacttgaagcaccccctctccaatatacagtatgatacactgatgtgcagaatgtgattagtttattaatcatatgtgaaaatattagtagctacatatggccagaatagatttttctctctacaaatgtaagttagtgttgatagaatttgttatgcgatatttggttctttggtttcagtctcaatgctttcttcttggcatttcattgactctgtaaattaacctcagcatcaattttcttttaaattcaacagttattcaaattgatcgaaaattaaacttgtatgtagctagttatcacttgtgggttacactttaattgacggtttctgatgtcatttcatagtgtctagaatataggacctattggagatctactttcatgaaattactgacataattttgggtccaaaatttcaaaattttaaatatttttatttggaattttaaaataatttatatgctctttttactggctaataatgctattcattataatctgatattcaaactgtctaaaaaagttaacaatcattgatttatttgttgtatatacagtttatttctatgacagttttaatgtcacctaatattatttttaatgtttcaatttctcatttaaatacattttgtgttgtttattttaatctcattcaatctgtatgtgcaaatggcttagaaaaaaaggccatatatgacaagcccacagctaacatcatatagtcaacagtgaaaaactaaaagcttctcctttaagatcaggaacaaggcaaggatgcccattctcaccactcctattcaacatagtactagaagtcctagccagagcaattaggcacgaaaaagaaataaaaggcagctgggcgcggtggctcacacctgtaatcccagcactttgggaggccaaggcaggcggatcacgatgtcaggagatcgagaccatcctggctaacatggtgaaaccctgactctactaaaaatacaaaagattagccgggcgtggtggcgggagcctgtagtcccagctactcgggaggctggggcgggagaatggcgtgaacccaggaggcggagcttgcagtgagccgagatcatgccactgcactccagcctgggtgactccagactccatctcaataaataaataaataaataaataaaaaagaaaaaaaaagaaataaaaggcaacaggccaagtgcagtggctcacgcctataatcccagcactttgggaggctgaggcaggctgatcacttgaggtcaggagttccaagaccagcctggtcaacatgatgaaaccccgtctctactaaaaatacaaaaacttagccaggcgtggtgccacacgcctatagacccagctactcaggaggctgaggtgagagaattgcttgaacccgggaggcagagggtgcaactccagcctgggcaacagagcgagacttcatctcctaaataaataaataaataaataaataaataaatggcaaccaaatcagaaagaaaaaaaactacctgtttacagatgatagaatcttatatctagaaaactctaaacactccacaaaataactgtgagaactaataaacaaattcagtaaagttgcaggatacaaaatcaacattaaaaaatcagttgtgccgggcacggtggctcacacctgtaatcccagcactttgggagacagaggtgggtggatcacctgaggtcaggagctcgagaccagcctggaccatatggcgaaaccccgtctctactaaaaatataaaatattagctgggcttggtgctgagtgcctgtaatcccagctcctcaggaggctgagccaggagaatcgcttgaacccgggaggtggaggttgcagtgagccgagattgcaccattgcactccagcctgggcaacaagagtgaaactctgtctcgaaaaaaaaagtcagttgcatttctatacactaacaatgaactatctggaagggaaattaagaaaataattccatttacaatagcatcaaaaagaataaaatacttaggaataaatttaaccagacgtgaaagacatgtacactgaaaactatgtaacattaattaaagaaattgaagacaataccaatgaacagaaagacatcctgggcttgtggattgttagacttaatatagttaaaacgtctatactacccaaagcagtctacagattcaatgcaatccctgtcaaaatctcaatgacattttctacagaaatagaaaaaaatccaaaaatccatatggaactacaaaaggcctcacagccaaaacaatcttgagaaagaagaacaaaagagtcatcacactttctgatttcaaaatctattacaaggcttcagtaattaaaacagtatgctactggcataaaaacagacagacatagaaaccaatgaaacagaatcaagagcccagaaataaacctcacatatatggccaactaatctttgacaaaggtgctctgaatacacaagaggaaaaggataatctcttcaacaaatggtataggaaaaatttgatatccacatgcaaaataatgaaatggacccttatcttacactacacacaaaaataatttggaatttattttaattattccattattttaataaagaaatttatttttaaataaatgtaaataaatacattttattttattttattatttatttatttttttgagacagattctcactctgtcgcctaggctggaatgcaatggcgtgatcccggctcactgcaacctctgcctcccaggttcaagcgattctcctgcctcagcctcccgagtagctgggattacaggcatgcgccaccacgcctggctaattttttgtatttttagtagagacagggtttctccatgttggtcaggctggtctcgaactaccgaccttaggtaatcctcccacctcggcctccgaaagtgctgggattacaggcgtgagccactgcgcccggcctacatttatttttaaataaatggatttaaatgttaagacctgaacctataaaaatgggacacctgcatagggcattaaccatgagtagagcttgcaggactggaagttgctatgggtgagtcagtgtgtgagtggtgagtgaatgggaaggcctaggacattcctgtacactaccatggactttataaattctgtacacttaggctacactacatttatttaaaatatttttcttttttgggccaggtgaggtggctcacgcctgtaatcccagcgctttgggaggccgaggcaggcggatcacctgaggtcaggagttcgagaccagcctgaccaacatggagaatccctgtctctactaaaaatacaaaattagctgagtgaggtgacacatacctgtaatcccaactacttgggaggctgaggcaggagagtcgcttgaacctaggaggcagaggttgtggtgagctgagatcacaccattgcactccagcctgggcaacaagagtgaaacttcgtttcaaaaaaaaaaaaattcttcctattttttttttttttttttttgagacagaatctcactctgtctcccaggctggagtgaggtggcacgatctgggctcactgcaaccttcgcctccagggttcaagcgattctcctgcctcagcctcctgagtagctgggattacaggcacccgacaccatgtctggctaatgtttgtatttttagtagagacggggtttcaccatgttggccaggctggtctctaactcgtgacctcaagcgatccgtccgcttcggcctcccaaagcgctgggattacaggtgtgagccactgcacccggctcatttaaaatatttttcttggctgactctgggcacactacctatgagttagccctgcttctcaaggagcagtaccattcaaaaaattaaaattaaaaaaagagagaaaaagaaatttaaaaaattttctttcttcgataataaattaacctttgtttactgtaactttatggactttttagtttttaaaaaacttttttactcttttgtaataacacttggtctaaaattaaagacattgtatagttgtacaaaaatattttctttctttatatccttattgtataagttttttctatttttaaaaatattttacatattgcttgagcccaggagtttgagaccagcctgggcaacatggtgaaaccccatccctacaaaaaattcgctgggcatggtggtgcacacctgtagtcccagctactagggagactgaggtgggaggactgcttgagccggggagattgaggctacagtgagctgagattgcaccactgcactccagcctgggtgaaagagtgataccctgtcttcactctctctctctctctctctctctctctctctctctatatatatatatatatatatatagctatatatctagtatatatatatgctatatataggtatgctatatatagtatatatgctatatagaggcatgctatatatagtatatatatgctatatagagatatgctatatatagtatatatatgctatatatagtatatatatgctatatagagatatgctatatatatagtatatatatgctatagagagataaatatatatatactatatatatattttaacattttgaactttttagttaaaactgagacaaacacacacgttagcctaggcctacacagggtcaggatcatcaacatcactgtcttccacctctgtatcttttcccactggaaggtcttcaggagcaatgacaggcatggagctgtcatctcctgtaacaatgccttcttctagaatgttttctgaagatctgcctaagggtgttttacagttaacctttttgtgtacataagagtacactctaaaataatgattaaaactatggcatagtaaacacataaaccagtaacagttgtttattatcatcaaatattatgtactatacataactgtatatgtgattcagtatttttattttattttattctattctattctactcttattttattattttattggaaacaaggtctcactctatcgacagactggagtgcagtggcccaatcctagctcactgaagcctcaatctcctgggctcaagtgatcctcccacctcagcctcctgagttgctgggattacagatgcctgccaccgtgcctcgctacagtacttttataggactggcagcacagaaggtttacaccagcatcaccacaaacacgtgagtaatgtgttgtgctatggttagatgataggaattttttttttttgagacagagtctcactctgttgcccaggctagagtgcagtggtgcaatcttggctcaccgcaacctctgcctcctgggttcaagcgattctccctgcctcagcctcctgagtagctgggattaaaggcatgtgccaccacagtcgggtaatttttgtatttttagtagagatggggtttcgctatgttggccaggctggttttgaactcctgacctcaagtcatccacccaccttggcctcccaaagtgctgggattataggcgtgagcctataatctggccagatgataggaatttttcaactgtattataatcttatgggacaactgtcatatatgtggtctgtcattgacagaaacatcatcacttgttgtatgactatggcatgattccacttatatggggtatccagagtagtcaaactcatagaaacaaaacactaggatggtggttgccaggggctgagaggatggggaaatggggagttgctgttcaatggatattgcgcccggccagccacaccaattcttacaccaagaagtgatggagcacaagtgctgatgggccttaacaccatcataaacatcttttgtttgtcccggggaagaaattcccaactccttccaaaggtctgccaaagtctaccagtatcccaagctgatttccttatcccctcagcagatgctggaaagctggaagtctccttccttctcactctcctgcttgacatctgcacagccattcttcttcctccccttgctccccttcctccccttctccttctcctacttattgagacagagtctcgctctgtcgccgaggctggagtgcagtggtgtcatctcggctcactgcaacctctgcctcctgggttcaagcaattctcttgcctccacctcctgagtaggtgggattacaggtgtgtgccaccacagcaggctaatttttgtatttttagtagagacggggtttcaccatattggccaggatggtctcgaactcctgacctcaggtgatctgcctgtcttggcctcccaaagtgccgggattacaggcatgagccaccggcgcccggccctttttattattatatattatttttgagactgggtctcactctgtaatccaggctggagggcagtggcgtgatcacagctcactgcagccctgacctcttgggcacaagcagtcctcccgcgtcagccacccaaagtgctgggtctacaggcatgagctactgtgcccagtctacgatttttttaaaatttataattattttgtttattcaggcagtacaacatgatgttttgatttatgtacacattatagagagtcaagctaattaacacacccaatacctcaccaatttatcatttttgtgtggtgagaacgttaaaaatccattctttctcctctgaagctgtagaggatggggtgtccctgctttcctttttaacgataaaatcatgtttgttatttcataaaatagttagacagtgaggctttgttagtttgtttaatgtcctaactcggcaaaattgaaaggtggcaacactctgcccctctcccatgcaccatgcatacacacatatgtttacagctaggttttttttggggggggaggtagtatccatatcatgtattaattttcttacaatttattttttcttttctttcagtgacggggtgttgctctgtcacccaggctggcgtgcagtggtgtgatcatagctcactacagccttgacctcccggcctccagctatcctcccatctcaggctcccaagtagctgggaatacagacatgcaccaccacacccagctaatttttctttttctttttcttttttcgtaaagacaggatttcgccatgttcgccaggctggtctcgaactcctagcctcaagccatcctcccaacttggcctccaaaagtgctgggattataggcaatgagccaccatgccctgcctaattttcttacaatttcaaaatataaatatcatatcttaataatttataatgacgtcaccaatattctccctattgtctcaaaaaagtggcaacctttgcagaagggaggatcttctaaaagaacaaaatgaaaaaagataagaattctaacttgggtcttgcgccgggcattgcctgaagcagacagccagaggcaatctttcaggaatggagtgaggaagaaatggggagggagaggtaagcctgggggttctgtgggcagcaggaatcttcagctgctgggaggtaaggggacttctaagaaagtggatgtcctctgtttgactttgttatattttctgctgtgtggcccgggcttgtcagcttgtcatctttctcccttggccctataaacacagagaaacagagaaaagaacaagaattctggggacagtggaattagaaccagaggtgaccaaagggacatattatccaggtggtaactgccggaagtagatgttctttaacagtttaaaaagtgatgatgaggccaggcacagtagctcgcgcctctaaccccagcactttgggaggccgaggtgggtggatcacctgaggtcaggagttcaagaccagcctggccagcatggtgaaaccctgtctctactaaaaatacaaaaaattagccaggcatggtggcatgtgcctgtaattccagctacttggaaggctgaggcaggagaatcacttgaacctgggaggcagaggttgcagtgagccgagatcgcaccactgcactccagcctgggcaacagagtgagactccgtctcaagaaaaaaaaagtgatgatgatgatgacagaaagaatacaatgtagaaaagcttagacccttggctaatggggctttgtttaaccacataggatttaatcccaaccacttctgccaaaattttgttctctagaggccctattctttgctttctttattattattattattattattattatattattttttttagagttgaggagtctggttctgtcacccaggctggagtgcagtggtgtgatcttggctcactgcaacctctgcctcccaggttcaagcaattctcctgcctcagcctcctgagtagctgagattacaggcgtgtgccaccacgactggctgatttttgtatatttatttatttatttatttattttctgagaccgagtcttgctttgttgtccaggctggagtgcagtggtgcgatcttggctcactgcaacctctgcctcccaggttcaagcaattctcctgcctcagcctcccaagtagctgggattacaggcacccaccaccgtgcctggctaatttttgtatttttagtagagacggggttttaccatgttggccaggctggtcttgaactcctgacctcaggtgatccacccacctcggcctcccgaagtgctgggattacagatgtgagcctctgcgcccggccaatttttgtatttttagtagagacggggtttcacactgtttttcccaaagtgctaggattacaggtgtgagccacctcacctggccccattcttttgctttctaccctttcttaaccctgttcccaaaatgtatgcgtctgtggctggaatatgttaaagggaagtagctttccacctctgtattggttcattctgactctgctttttcttgcacctgtgctcttctttttaaaatgtttttgagtgtttttatttaacactaatacacattgggtttggccaaatagatgtcttttcatccctgtgcccctctgcaatgatacatttctggagaggagaggccaggcaggtttcattatccttacacattacctggcaagctgccatgtgcaacaggtatttaatacatattttttgaaaaacaatctctcatgtctttggaatcattgggaactacaaccaagtgaaggcagtagaagttggtggctgatgaagtgcctacaatgcatgctatttctatagggaagattccaaacgtacgtcaattgttagtaaaggaattgatagaggccaggcatggtggctcatgcctgtaatcccagcactttgggaggccggggcaggcgaattgcttgagcccaggggttcaagatgtagcctgggcaacattgtgagattccgtctctactaaaaatacaaaaattagccacatgtggtggctcacacctgtagtctcagctacttgggaggctgaagtggaaggatcgcctgattccaggagttcaagaccacgctgggcaacatagggagacctcgtcactaccaaaaataaaaaaaattatctgggcgtggtggctcatgcctgtggtcccagctacttaggaggctgaggtgggaggattgcctgagccaaggaggtcgaggctgcagtgagctgagatcatgccactgcactccagcctgggtgacagaatgaaagcctgtcccccaaaaaataaaataatgaaatcatgagctaaaccaagtacaaaattaataaataaaaagattaaaaataaaaataaaataaaggaatggatagaagggatgaattgtcaacaagatcccgatatgttttcccttctgatttcaagtatctaattcagttattcattttaccctgagggtggcagcaggagtctcttctatcgcccaagcgttgccaagaggcaacttttaggtcactctgacatgagctaacagatgcagtttctggttagagagcttggacagatccatgccatttcctctcccttacaaggttggggggaaaggctgcgtgcggcctcaggaaaccctggggagcagcagggatcctccccagctgtcgcccaattagaaagccagtgatttaacagaaggccaagaagactcacagggccaggcctggggttctctttgttccaccttttttcccatgctgagaaatgaaagagaaaaacattgcatgacaagaattaatggtgtcaaacaaatagcatcaaagacaatttaagtattgctcttctctctcggaaatggatgaagacaaagagtagtggcttcctttttacccattaactgctctacatttggaaagagctggtggacagtgttttcatactgtatccattcagcttgatgcttacaaatgtacagttcagaaatttttcaaggaaacagtttgctacaaagcacatagtttcctctgatcataaccatgacctcgtttataatcataatcttgtttataatctcaggatgccaacatgcccaaaatgactttggaatcattgttttaaaatttcatctttttttaagactttattttttagagcagttttaggttcatggcaaaattgagcagaaagtgcagaaatttcccagataactcctgcccctacacacccacaacctctgtcactatcaccacccctaaccagagctgtacagttgttgcaattgatgaacctgcaattgacgcatcatcatcacccaaagtccatagtttacattatgactcactcgtgttgtatattttatgggttttgacaaagatacaaggacacatatccatcattgcagtatcatgcagagtagtttcactgccctaaaaatcctctgtgctccacttattcatctctccttcccctcaactcctgtaaaccactaatctttttactgcctccttagttttgccttttccggaatgtcatatagttggaatcatacagtatgtagccttttcagattggcttctttcacttagtatatcagtctgttctcatgctgcttataaagacatacccaagactgggtaatttataaagaggtttaacggagtcacagttccacgtggctggggaggcctcacaataatggtggaaggtaaaaggcatgttttacatggtggcagataaaagagaatgtggaccaagcaaaagggttttccccttatgaaaccatcagattttgtgagacttattcactaccatgagaacaatatgagggaaactgccccccatgattcagttatctcccactgggtctctcccacaacgcgtgggaattatgggagctataattcaagatgagatttgggtggggacacagccaaacctatcacttagtaatatgcatttaagtttcctccatttttttttttttttctgagacagagtctcgctctgtcacccaggctggagtgcagtggcgcgatctcggctctctgcaacctccgcctcccgggttcaagtgattctcctgcctcagcttcctgagtagctgggattacaggcgtgtgccaccacgcccagctcatttttagtagagatggggtttcaccatgttggccaggctggtctcaaactcctgacctcaagtgatccacctgcctccgcttcccaaagtgctaggattacaggcatgagccaccgcgcctggcctcttccatgtctttttatggcttggtagctcagttctttttctcactgcataatattccactatctggatgtaccagtttatttatccactcacctaccaaaggacattttggttgcttccatgtttttgcaattatgaataaagctgctataaacattcctgtgtgtagatttacgtggggacataagttttcaagtcatttgggtaaatatcaaggaatgcaattactggatggtatagtaagagtatgtttagttttgtaagaagccgccaaactgtcttccaaagtggctgtgccattttgcattctcatgaatgagagtttctgttgctccacatcctcgacagcatttggtgttgtcagtgtgttgttttcaccattctaataggtgtgtagtggcatctcactgttgttttattttattttttatttttttaattttgagacagggtttcactctcgttgcccaggctggagtgcaatggcgcgatcttgactcaccgcaacttccgcctcccaggttcaagcaattctcctgcctcagcctccctagtagctgggattacaggcatgtgccaccacgcccagctaattttgtatttttagtagagacggggtttctccatgttggtcaggctggtcttgaactcctgacctcaggtgatccgcccgccttggtctcccaaagtgctgggatgacaggcatgagccactgcgcccagcctaactgttgttttaatttgcaagtctctaatgacatatgatgttgggcatcttcatatgcttatttgccatctgtccaccttctttggtgaggtgtctattcaggtcttttgcccattttttaatcaggttgttcattttcttaccgttgagttttaagagctctttgcaattttggataatagtcatttatcagacacctcttttgcaaatattgtggcttgtcatttcattcacgtttgtggggaggggggaacggagtctcactctgtcacccaggctggagtgcagtggtgcaatctcggctcactgcaacctctgcctcctgggttcaagcaattctcctgcctcaacctccaagtagctgggattacaggtgcacactaccacacctggctatcatctcattctcttgatcatccttttttcttaaattaaaaagtgagcaatttctttgcagtcagaacaacatttctgttggcagtgtgtggtggtaaagagggggactctggagttagcttggatttgaattccagttctgccacttattagctgtgccagttactgaatgtctctgtgctgcactttcctcatctttaaaatgggtatatgagctgggcgtggtggctcatgcctgtaatcccagcactctgagaggcagaggtgggtggattgcttgaggtcaggagttcaagaccagcctgggcaacacggcaaaatcccgtctctacaaaaaatacaaaaattagctgagtgtggtggtgcacacctgtagtctcagctacttgggggactgaggtgggaagatcgcttgggcccaggaggaggaggctgcagtgagtggagatcgtgccattgcactccagcctgggcgagagagtgagactctgtctccaaattaaataaaacaagatggagataaacccgtactcatagggttgctgtgaaaattaggtcaattaatataattagtataagagatttaaaacagtttctgcaatatttattattaaattatttgattagaacaaaagatatagtttgcacagtggcagagacatgcatgaaaagcaatggtagacatttctgacatgaagggcatgccttggcagccttttaagatcattctccactgagcagcagcagtttcgttttagaagtcacatcaaagctactttggcttttgcaaggcgatttctgtgcattatgcacagaatgacataccaacctaagaaaattgatctactagcaattagtgagatggagcaggagaaggagctagcttgctatggaaaaagtgacaaagagatggactgagttgagacacttagaggtctctgacactaactggctgcctcactttgtacaaatcactttattcatctgtttcaggcttccacttggttttgttttgttttttgagataagagtcttgctctgtcatccaggctggagtgcaatggcgtgatctcggctcactgcaatctctgcctcctgggttcaaacgattctcctgcctcagcctcctgagtagctggaattacaggcatgcaccaccaggcccagctaattttttttttttttttagtagagatggggtttcaccatgttggccaggatggtctcgaactcctgacctaaggtgatcagcctgcctgggactcccaaagtgctgggattacaggcgtgagctaccacgcccggcccaggtttccacttttgttatgaaggtgttacagttatcagggctggggatggatatgcacattaatcgtgttttttaattttctgtatttcatgatgctttgacatcttggggccttgctaatcttggagagactgtccctcccagggctaactaattcctacagaacttgactctgagcatgcttttgatatgcaaaccaacaatcatgagaccatacccaaaccacctcctttttctaactctcacacaccagccaatattccccctccagggccaggtactgaacaactaggggccaccctgtagcccaccaaaatcattcaaactatccagtcctaaggtttctcagcttgccaatcctgtctcatccattccttcccataaaacctacaataaaggctctgggcccatgctttctcctcactcctgactcctgactgaccctggtgcctcccatgtggcccttgcatggccatggcttggcaagccccctcctcttgagaactgtgagtaacaaactatcttttcaatggcagttgccttgtgatctgctgggctcaccatacctcaatttttaaagattcttggttatattttaaaacaatctaaccccaggtgctaactctggtggctgcttaatagctgtcccaagtgagggatgagaaaaatcttcaggttgagtcaaaatatcaatgtctgccctgagcatgggttgtgaggaataaagatgtgagagaaagggtttgtcctccctgacacagatgatctctaggggcccttgcagctctaatatctaagcattttagaaagtattttaaggccaggcacagtagctcatgcctataatcccagcaccttgggaggctgaggtgggcagatcacttgaggtcgggagttcgagaccagcctgggcaacatggcaaaacccccatctctactaaaaatacaaaaattagccaggcatggtgccacatgcctgtaatcccagctactcgggtggctgaggcaggagaatctcttgaacccaggaggtggaggctgcagtgaactgagatcacaccactgcactccagcctgggcaacaaagcaagactctgtctcaaaaaaaaaaaaaaaagaaagaaaggaagaagaggaacaggagggaggaggagggatctgagctagcacgctcagccccttgccaagtgataccctgcactgtctcaggactcttcagagtcctcaccagcaaaaagtcccccaccagatgcagccccttgaccttagacttctcagcccccacaactgtaagaaagaaattcatttcctttaaaattacccagtttcaggtattctgttataagcaacagaaactggactaagacaggaaaacacaaacattcagtccattgccttccaacacctgcctgcccccgacaattcatgtgcttctcacatgcaaactacattcaattccatccaaacatccccccaaatcttaactcattccagtatgaactctaaagtctaaagccaaaagtctcatctaaagatcatctaaatcaggtatgggtgaaactcaccctgaagcaaaattcctcttcagctgcttaaaagaaaccaaagtatttgcttccaaaatacaatgatgggacacaaagagggtctataaacattcccattccaaaagggagaaacagggaaggaggacggggtgacaagtcccaagcaagtccaaaacctagcaagggaagttctgtgagatcttgagactcaggtaatcctctttggcttgaagctttgcctccagacctactggggtgtcagtccctcatgccagacccactgagggggcaatgtcaccctcacagtgagagacaggactagctggatttcctaggctgactaagaatccctaagcctaggtgggaaggtgaccgcaatccacctttaaacacggggcttgcaacttagctcacacccgaccaatcagggagtaaagagagctcactaaaatgctaattaggcaaaaacaggaggtaaagaaatagctaatcatctatcacctgagagcacagcgggagggacaatgatagggatataaacccaggcattcgagcccgcaacggctaccctctttgggtctcctccctttgtatgggagctctgttttcactctattaaatcttgcagctgcactctcttctggtccgtgtttgttacggctcgagctgagctttcacttgcagtccaccactgctgtttgccgccgtcgcagacccgccattgacttccatccctccagatccggcagggtgtccgctgtgctcctgatccagcaagccgtccactgctgctcccgatcgggctaaaggcttgccattgttcctgcatggctaagtgcctgtgtttgtcctaatcgagctgaacactagtcactgggttccacggttctcttccgtgacccacggcttttaatagagctataacactcacgcatggcccaagactccattccttggaatccgtgaggccaagaaccccaggtcagagaacccgaggcttgccaccatcttggaagcagcccaccaccatcttgggagctctggaagcaaggacccccaccccccggcccggtaacaacagtttggcagcactcactgctcatgctgtggttgtcagggcaggagttgtagcctcagggctctgctgggagcctccatccccaccgctctactgggcattggtctcaccctttgaaatggaggtggaggctgggagtggtggctcacacctgtaatcccagcactttgggaggccaggacaggccagtcacaaggtcaggagatcgagaccatcctggctaacagggtgaaaccccgtctctactaaaaatacaaaaaattagctgggcgtggtggtgggcgcctgtagtcccagctacttgggaggctgaggtgggagaatggcatgaacctgggaggcggagtttgcagtgagccaagattgtgccactgcactccagcctggatgacagagcgagactctgtctcaaaaaaaaaaaaaaaaaagaaatggaggtgcaggtagtcctatgccctaagcccatgtactctgggcctctgatgggactggtgacctggacggtctctgaatcaccttcagggttcttcttcccttatcttgaagaacagtgtgtgttcacagccgaatagttctatggtttggtcctataggatctaagaagtttaatcatcttccttcattttgtcccattttctttttttctttttcttttttttttttgagacagagtctccctctgttgcccagcacccaggctggagtgcagtggtgcaatctcagctcactgcaacctccgcctcctgggttcaagtgattctcctgcctcagcctcccaagtagctgggattacaggcgtgcaccaccgcacccggctaatttttgtattttcagtagagacagggtttcaccatgttggtgaggctggtcttgaactcctgatctcaggtgatccacccgcctcagcatcccaaagtgttgggattacaggcatgagccactgtgcccagccattttgtcccattttctctgtttcctttagtcccagtcagcagtgccatttccagtacaatcccatcgctattgctgttttgttgagatggttaatgaagtccacagttcacattcacagtaatctccttgtcaaatagtccagcagatccttagtgttctcttccaaacatgctttgtcatgttttgtaatatggacagggacaggctgagaattttccagacccactgagggagcaatgtcaccctcatagcttgggtaagtttaagttctggttcctttttgcataacaattctgttttcaattcatatctctcttctcaaatttgactataagcagtcaggaggaaccaagcctctcctttcaacactttgcttagagatctcctcagctaaatctccatttcactgttcacaagtcctaccctctacaaaacactaaaacgtaaacacaattcagccaggttctttgctactttataacaaggatcaccttttctccactgtccaataacacgttcctcatttctacctgagaccacatcagaacagcctttaaccacccatatttctaccaccaatctgttcatgattacttatgtattctttaagaaagcagaagctttctctacagctctcctcatttctttctgactgctcatcagaatcacctttaaaggtccattcaatggcaatataggatttttctttttttcctttttcttttttttagatggagtcttgctctgttgcccaggctggagtgcagtggcgcaatcttggctcactgcaacctccacctccctggttcaagcaattctcctgcctcagcctcctgagtagctgagattacaggtgtgcgccaccacgcccggctaatttttttttttttttttgtatttttagtggagatggggtttcaccgtggtggtcaagttggtctcaaactcctgacctcataatccatccacctcggcctcccaaagtgctgggattacaggtgtgagccaccgcacctggtggcaatataggatttttctagcgcatgcacccaaatttatgtcttagtctgttttctgttgctataacagaataccacagaccaggtaatttataaagaaaagaagctcagccaggtgcagtggctcacacctataatcccagcactttgggaggccaaggtgggtggatcacttgaggtcaggagtttgagaccagcctgactaacatggtgaaacaccatctctactaaaaatacaaaaattagctgggcctggtgatgaatgcgtgtaatcccagctagtcgggaggctgaggcaggagtattgcttgaacctgggaggcagaggttgcagtgagcagagatcgtgccactgcactccagcctgggtgacagagtgagattctgtctcaaaaaaataaaaaataaaaataattttaaaaagaagcttaacaagctcacagttctggaggctgggaagtctaagagcatggtgctagcatcagatgaggccttcatgctgcatcatcccatcatgggtagacagaatggcaagagggtgcatgcgagagacagctcacttttataacaaagccactcccacaataacagcattagtccattcatgaaggtgacagccccatgacctaatgtcttcttaaagaccccacctctcaatactgttacaatggcaattaaaggtcaacatgagttttggagggaacattcaaaccatggcactcttccagcctctagtcattacaattacaaggccacttccacatttttaggtattcgttacatagcacccctcacttctcagtaccaatttctgtcttagtcagttctgactggtataacaaagtgccatagactgggtggcttataaacaacagaaatttctctcttaacagttctggttggaagtctgacattacggttccagcatggtcaggttctggtagggatgctgtttagggttgctgacagctaaattttcattgtatcctcacattgtggaaagaactctctggggtcccttttatttatttatttatgtatttatatttttctgagacagagtctcactctgtcgtccaggctggactgcagtggcaccatctccattcactgcaacctccgcctcctgggttcaagcgattctcctgcctcagcctcctgagtagctgggattacaggcaaacaccactatgcccagctaatttttgtatttttagtagagacagggtttcgccatgttggccaggctggtcttgaacttctggcctcaggtgatccacctgcttcggcctcccacagtgctgggattacaggcgtgtgccactgcgcccagcctggggtccctttcataagggcaccaatcccattcatgagggctccactgtcatgacttaatcacctcccaaaggtcccaccttctaatactatcacattaggggttaggatatcaacatgtttggggagacacaaacattcagtctattgcacagccttttaccttctgcaaataaaactgcttccagtatacccaaagctgtactaaaacctctttttttttttttttttttctggttttcctaggcagagtatttgtgtccctgggtacttgagattagggagtggtgatgactcttaaggagcatgctgccttcaagcatctgtttaacaaagcacatcttgcaccgcccttaatccatttaaccctgagtggacacagcacatgtttcagagagcacagggttggggggtaaggtcacagatcaacaggatcccaaggcagaagaatttttcttagtacagaacaaaatgaaaagtctcccatgtctacttctttctacacagacacagcaaccatccgatttctcaatcttttccccacctttcccccttttctattccacaaaaccgccattgtcatcatggcccgttctcaatgagctgttgggtacacctcccagacggggtggtggccgggcagaggggctcctcacttcccagtaggggcggccgggcagaggcgcccctcacctcccggacggggcggctggccgggcggggggctgactcccccacctccctcccggacggggcggctggccgggcggggggctgacccccacacctccctcccggacggggcggctggccgggcggggggctgacccccccacctccttcccggccacctccctcccggatggggcggctggccgggcagaggggctcctcacttcccagtaggggcggccgggcagaggcgcccctcacctcccggacagggcggctggccgggcggggggctgaccccccacctccctcccggacgggacggctggccgggcggggggctgaccccccacctccctcccggacgggacggctggccgggcggggggctgacccccccacctccctcccggacggggtggctgccgggcggagacgctcctcacttcccagacggggtggctgccgggcggagaggctcctcacttctcagactgggcggctgccgggcggaggggctcctcacttctcagacggggcggttgccaggcggagggtctcctcaattctcagacggggcggccggacagagacgctcctcacctcccagacggggtcgtggccgggccgaggcgctcctcacatcccagacagggcggcggggaagaggcgctccccccatctcagacaatgggcggccgggcagagacgctcctcacttcctagatgggatggcggccgggaagaggcgctcctcacttcctaggtgggaaggcggccgggcagagacgctcctcactttccagactgggcagccaggcggagaggctcctcacatcccagacgatgggcggccaggcagagacgctcctcacttcccagacggggtggcggccgggcagaggctggaatctcggcactttggggggccaaggcaggcggctgggaggtggaggttgtagcgagccgagatcacgccactgcactccagcctgggcaccattgagcactgagttaacgagactccatctgcaatcccggcacctcgggaggccgaggctgacggatcactcgcggttaggagctggagaccagcccggccaacacagcgaaaccccgtctccaccaaaaaaatacgaaaaccagtcaggcgtggcggcgcgcgcctgcaatcgcaggcactgggcaggctgaggcaggagaatcaggcagggaggttgcagtgagccgagatggcagcagcacagtccagcttcggctcgacatgagagggagaccgtggaaagagagggagaccgagagggagagggagactgagagggagagggagaccgagagggagagggagaccgagagggagagggagagggagaccgagagggagagggagagggagaccgagagggagagggagagggagagggagagggagagggagagggagaggaaacctctttctttagcactattcatgttctcttctcctggacgtcagtaccttaaatagagtcatcctccctcatggactccacacttctctctctctctctctgtctctctctctctctctctgagatagggtctcactctgtcacccaggctggaatgcagtggcaagatcatgggtcactgaaacctccacctcccagggctcaagtgatcttctcacctcagcctcctgagtagctgggactacaggcatgtgccacagtgcctggttaatttttgtattttttgcagagatggggtttcactatgttgcccaggttgatctcaaattcctgggctcaagcaatcttcctacctcggcctcccaaagtactgggattataggcatgagccactgtgcctagccatatatccttctctctcttatcctactccagtctggctttggtccgcacttgttcactgacattcctctctgtgacatgatgagttctctgtgggcacactgagtttgaggtgtcaaagcacataaaaatggaaaggtctactaggcagttgtttatgtggtccaactctcttttggttcatatttgcttggtgtatctttttccatccctctattttcaacctttctttgtggttttattctaagcgtgtttcctgtcacaggtctgtagttgaattaacaacaacaacaacaaatccaatctgataacctctgttttcaacaggcatgtaatcatttatatttattttgattacttatgtattggaacttatttctaccatcttatgtttgctgtttactaccccgttccccctcatcttttcccattatatgttagatggataaagtttttgaaattgccccattacacattttattttttcctttgctggttctgaagttatagatggtatttctcctcatttagtggtttccattaatttttaaagttcctgaatctcatgcttccagtatcaacatgcctaaccagcagggcctccattaatttttaaatatatgttctaaattataaatttaagagccaggcacagtggctcacacctgtaatcccagtgactttgaaggctgagttgggaggatcgtttgaggccaggagtttaagatcaaactgggtaacatagagagatcccatctatacaaaatttttttttcaatgagccaggtgtggtggcacatgcctgtagtcctaactacttgggaggttgaggtgggaggatcccttgagcccaggaatttgaggctatagtgagctaggattgcagcactgcactccagcctggataacagagtgaaacaaataaaaaataaatacttatgtttctataaatttacatacatagataaatattaaaaatatattaagccagctatagtggcacacacctgtagtcccagctacttgggaggctaagctggcaggatttcttgagcccaggatttcgaggccagcctaggcaacataatgagaccccatttctttaaaaaaaaaaatatatatatatatatataaatatatatacacacataaacacacaaaccaatatccaaaaaatatatctttaaaaatgtattgtctcagccggacatggtggctcatgcctgtaatcccagcactttgggaggccgaggcaggtggatcacaaggtcaggagatcgagaccaccctggctaacacggtgaaaccccgtctctactaaatataaaaaaaattagccaagcatggtggtgggcgcctgtagtcccagctacttaggaggctgaggcaggagaatggcgtgaacctgggaggcggagcttgcagtgagccgagatcgtgccactgcactccagcctgggcgacagagcgagactccgtctcaaaaaaaaaaaaaatgtattgtctccagttcatcagtatatgtattatctacctactcttaaaagaataaaggccaggcgcagtggctcacgcctgtaatcccagcactttgggaggccgaggcaggtggatcacgaggtcaggagattaagaccatcctggctagcatggtgaaaccccgtctctactaaaaatacaaaaaaattagccaggcatggtgacagatgcctgtagtcccagctacttgggaggctgaggcaggagaatggcatgaacctgggaggtggagcttgcagtaagccaagatttcgccactgcactccagcctcagtgacagagcaagagtccgtttcaaaaaaaaaaaaaaagaataaagacacagtgaatcaagttctttaaaagcagagccaagaagagtcctgtgataggcagcttctgacatggccccaatgatttctgccttctgatatttacacccatgtggaaatccctgcacttgagtgtgggctgaacctagtgaccagcttctaatgaacagaatatggcaaaagtgataggatgtaggatgtcacttctatgattaggctccaaaagattgtgacttctgatgtgctagttctctctctctgtcactatctcttgccctcttctttgctccctctgatgaagccagctgccacagtgtgagctgccctatggagaggcctctatagcaagaaagtgaggccttcagtccagcaaccctcaagcaactgaaacctgccaacaaccacatgagtcagcttggaagtggatccattacccatcaggctttcagatgagaccacagccccggctgccaccttgattccaacttcatgagagatccagagacagagaacctagctaatctgtgactagattcctgactcacagaaactatgagataataaatgtctgttgttttaagctgctaaattctaggtaatttgttacacatcaatacatggctaatacaaagattttttttttctgtgacaactttttttatcatatggagaggcaaaggtggcacagactctacaatcagccaaacgtggctgtctcttgccttgggcaggttatgtaatccctgagctcagtcttctcacttgtaaatcttttttgttttcttccccttcctccctccctccctccttccttcttttttttttttctttttttttcttgacagagtcttgctctgttgcccaggctggagtgcagtggcatgatctcggttcactgtaacctccacttcccaggctcaagcgattctcatgtctcagcctcccaagtaactgggactataggcatgtgccaccacgcctggctaatttttgtatttttagtagagatgaggttttgccatattggccaggctgatctcgaactcctggcctcaagtgatccacccacctcggcctcccgaagtgctgggattataggcctcacttgtaaatctaagctaacaatgcctgccttgcatatgagcttttcagattgttaataaggtttaagagggcatggcacacagtaggtcatcatctttatgacctccattcttgtaaatctgatgctcattccaatttcagtgttctgggttcttcaaaaagtccccaccactaaaactttgctttatcatgaagatttcactcagtccattgtgtgatagtattcataaagcacctgaaagtactacctctcaaatgagtatctcccgttctcaaaatcaatgccacacatagactctaattcaaccatggtacaggggatggtgaattaggcctggagcctctaagcaatggcctgccatccaacatcaaatcatgctgaaaatcctttttttttatactaagacaaaaacacaatcaaagaatcattgcagtttctatgtgaatgaacctcatatgaaatcctctgaacagcagtggctcatatctgagagggaaggaggatgtgagaacatctacattactagatcttcatgaatgggctgctgaagtctggcttttccctgtactaaatctctctgtaattttgtgcctgctcatggaaactgcattcacaaatagtatattatgcatatacacagacttacacagacaacctttgcagataaaaagcaaatccctgccaatgataaacaaaatgaacataaaacctattacagtcttagattatcttctaaaccttacattctcttatgcttaattcttttcatttttaattttaatttttaatttttttattttcctgttctcctcagctgctcataatttgtatttttagagacagggtcttgtgctatcacccaggagtgtagtgacctgatcatggctcattgcagcctcgacctcctgggctcagtgatcctcctacctcagcttcctgagtaactgggattaacatgcccggctaatttttgtatttttagtggagatggggttttgccatgttggccaggctggtctcgaactcctggcctcaagtgatctgccagcctcggcctcctaaagtgctgggattacaagtgtgagccaccgtgccaggcctatgtttattatgtatatatttttacatttaatatgcataccttttcttatattcttgtatttcatacacataatggtcagcagcctgtatatactaccctggatcttttttttttttttttttgagatggagtttcacccttgttgcccaggctggagtgcaatggcacggtctcagctcactgcaacctccacctcctgggttcaagcgattctctggctggcattacaagtgtgagccaccacatccagccttaccctaggtattttagaacaattacagacagtaaatacctatcaatctatacctatatctacatatcttaagaattttatta

SEQ ID NO: 168 - DNA, 15255 bp, Homo sapiens
attgtgacagattgtggacatgtttatgtccaaaggagatgaatatgaatgttctgagtgtggctagatgtatatgtacaggtttgagtgtatgcatatgtagtgtgtgagagtctgtatgtccaggtgtgtgcacttgtggatattttatgatagtgtatgtgtgcgtcatacacacatacatcttcgggggaggtaggtacatatgtttctgatcaaggagcaagttgcatgtgagtatttaatggtaaacttgtgtgtgtgtgtgccaaaggagtaatggtgacttactcagggctgtgaatccgagtgtactatgtcctctactgcttgcctggggagcagaggttgagtgctacagaaataggctctcatggctgggctggggcccaggcacacaaggccctagacacatagccttaatctgcacaggaggaaggctgtgtccacgcaagaactgtcgtcatgtttagaaacttggtgggtagtctggagaacaaagggaatgtgaccttcttccatgatcagatttgccacaggtttattcccctgctctttcttccacctcatagataagaataaggaagtggtgaaggtgaactcacagccctcagctaatttctcctatgttcccctctccctgcccccttcttccccttgcagcacccccagtgtctatgagcagcaagctccaagttggcctctaaagtcactggatgctctgttccctgtggttgtctcaggcctgttactgtaagcagggatgcctgggcaaagcccacctctattcctggagctcagctcactgaaaacctaagttggttgatacccacccaactgccttttcgcttgtctcctccaggaatcaaaggtctcttgtcctatcctatcccttttcctttctcccctttttatttcccctggttaggactgggctagaggcccactatcttagtccattttgcattgctatacctaagactgggtaatttataaagaaaagaggttctgcagagtgtacaagaagcatggtgctggaatctgcttctggtaaggacctcaggaaactttcaatcatggcagaaggcaaagggggagcaaatgtgtcacatgacgagagagggaggaagaaggtgagggggtgtcaggctcttttaaacaactagcttccacgtgaattaatagagagagaactgaattattaccatgaggatgacgccaagccattcctgagggatccacctccatgactcagacacttcccattgggtcctaactccaacactggggatcaaatttcaacatgagatttggagaggacaaaaagccaaactgtatcagccaccttaccccctcctcccagaaaacagaaaaagaggccagtgcatgtctagggggagaggaattgttggaggattatcagagcctggggccagagcacttgcctgactccctcacatcagctcccttttcttgctccacagactgtcaaactcaccttcttccactgtgcctatttcctccagttgtcagagctctagaagttcttttgccagatggcctgggatagagacctgtgggctctgcaaatgtctgaaagtcctttataagggtggatttaatggttgagactggacaaggttttggtcaagggtctgggctttggattctcttttgcctctctgggatccctggggcccatgctaaggacccatgacatggcaaccagggtgcctgacttggcccaaagataactgagccttagtcctgagttcaagcctgtctttgtctcctttatataggcagaaaatgatgttcatgttctgcaaagtggacattttcctctaccaggccatcaaccatattcattgcaagcaagctgatttaggcagagctgcaggcagtctgtatgttgatacacagatttcctcttccacatcatctccacctttcagttcctgacacccacaaagctccttcctctatttttttgggctgtttacaagtcttggaaggtctaattctctccagcctctacctagaagtgaaaatatagggatagaaaagtggtttaggattttggataacttaagtttcatccttcccaattctgccacctgatgcaaatctctttgctgctctggcctcagtttcctccagctataaaatggattcattgtaagttgccctgcccacttcccagggcagttggagaacagtctttgaaggttgggtattgacatgtctgcatgcaaaataagctagatgacatgtagacctggtttcctagagaaattagattgtgggtatcagagcactgaacaatgtatctggaaggtgaacatccttgcagaacaatatgcaaatgatttctctggtcttgagcttgagagcacagttaatttttgaaatattctatatagccctgctcatagcacattgcctctttagggaaattcctagttctaacctgaaactccttctcaatttgttaccacattcttctagggttttgagcctggctctggttgctcaagcaacatttgggaacctctgacttgaaggaaaatgactagcaaagatgtttccctaaccttttcattctctgcttttttttttttttttttttttttttttttgagacagtctcactctgtcgcccaggctggagtgcagtggcatgatctcagctcactgcaaactctacctcctaggttcaagcaattctcctgcctcagcctcccaagtagctgggattacaggcactcaccaccatgcctgttttagtggagatggggtttcaccatgttggccaggctggtctcccaggctggtctcgaactcctgaccttaagtgatccacccgcttcagcctcccaaagtgctgggattacaggcgtgagtcaccgtgcctggcccattcattgctttttgatcctttgaggatatgcagtcaactcgctgtcttatgctgtttccagggttctgtttaaaaaggggtgtggcactcctgcttgaaggtgaggcctgaaaagtgggaacagtgggttatctggattgctgggatgaggacaagaggacagagtgtgtatagagtcctcatttgctttttcagggcccataatttgggttctgcaccctaaagctgactactccagcatcctttaacatggctagaggagtatttaggggctctttatccccaaatgtgagataaactgtggctgacttgctggagaaacttccctttaggcttcttcaccttcaagtcagtggtggtggagagcagagaggagcattgacctagacaggccctgagattatttttccagagataagtgtctatctcatgaatgcacagtttatcaggacccattcattaggtttcttctgggtggagtgttttcatggaagttggaaaggagccttcacactttggtctcctgctcactgaggaggcaggacctatgtatccagatattgaggtgccatcctctagttagactagatggcagtaccacatggggtgaggggttgtgggggtggccccaggctgagggttcagcttcatgccttttttaaagctccctctgtacaaccttctcttttccttttttcccttaacttcttttgtctcttgattgttactcactcctctcattccccaacagccctctctaccattcttccattgttttgcttcctgcctatcattccctggccataagcatccaaaatgaatactcggctgggtgtgatggctaacgcctgtaatcccagcactttgggaggccgaggtgggtggattgcttgaggtcaggagttcgagactagcctggccaacatggtgaaacccagtctctactaaaaaaaaaaaaaaaattagccaggcatgatggtgtgtgcctgtaatactagctgcttgggagactgaggcaggagaatcacttgaacctgggaggcagaggttgcagtgagccgaaacggtgccactgcactctggcctggggtgacagagcaagactctatttcggaaacaacaacaacaacaacaacaaaaacctaaaatgaatactcacaaatgcattcacttatacccagctgtacaaaagatggctctctaattcctgggggaaagccaagcaaggtgaagaggatacagatgttgtagagcaattcattgctcccaaggtcttcaaaactcagcagaggtcccagtgagaattcagggatcaggctagccaacctcggttgagaaagaccccatgtccttcccttcccttcctttccttttttgttttttctcttccttattcttactcctttgaaaaattccttgctttccttttctttaaatatgacaaaggctccctcaccaggggtgactttcaagagcagggccatgcaaggaataagaggactgtgtggaaatggctctctcctcctcacaatgtttctttaactgaagagagagcaaggaaaccatttccattcctactgcttccttaggtctccccaggaacagatggttactgtcaaaaccagtgagtggataagctggttgagaggaagcccctgctagcagagtatagagggctgggccctggattaggagtccagagccctttatatatccatgggagggaggtaaacagggagagagggagaaggaagcagagggagagagagggaaaaggaagtagtatattctaagctatttcctacagaatctttttcttgcttagatgtaagtccaggtctggcaagggcagggtgggcagagggaacagtggtgggcatgggatgggcacaaaagtgcctctgtcctctgtgctgaggattcaaggtgaggtgagaaccagacttagtgtctccatgaatcaaaaatatggagtggaaaagcaaaaaatttagttgaaggaactttttatttggtaagcttcatgccaagaagctcagctaattgttttccactaaatcaatcaggtgaaccaatttgaccaaaacggaccaaatggtctgcttagttttgatgtcatgtaaacaataacttctccctgggccccagttttcctactaatactagtcttatgtatgatgcctattacttatataatagcaacactatagaattatttcttaggttagtttctctggttcgggatacacttctcccccaccttcaattccaaaacagctgctcagagctagaagagagctgcattccttttttttaacagctactcagaggtagaagagagctgcattccaccccccacacacccttttttttttttttttttttttttttgagatggagtctcactctgttgcctaggctggagtacagtggtgcaatctcggctcactgcaacttccacctcctgagttcaagtgattctcatgcctcagcctccccagtagctagaattacaggggcccaccatcacgcccaactaatgtctgtatttttagtagcaacggggtttctccatgttggccaggctggtctcaaactcctgatttcaggagatccacccatctcggtctgtcaaagtgctgggattacaggaatgagccaccgcacctgggcatgcattcctcctcttaaaatttcattctttgacattccagtgaaggatgaggagtttatctgcaacatggcagctgttaacctggaaggtctgcacaaagtggcccaattgtagtagcattccagttgggatcagaccccagtgctgcctcctctaaccagcatccaaacttctaatcctaggctggctggatatccttcaaatcttctgggttccatggagttggttagacttttcctttccttcccacctccagtcctaccccatctctcccatcctttacctggcccagacacttttctaggataaaggcttattttcagcactctatcgcttattatctctttctttttctcaggtgattttgccccctcccgccttgagtcttgatttggctacaacataagaggatgtctgatgcaaactagctaaaaccatgtaaaagctttcaacttgggaaacactaagctccccaaagtcaggtgccagctcctttctaaagccctggcttcctagttcaagccccatacctaataggctatgggttgaggacaaagtttgccttagatcatagagatttccaagttgctgcaggtgtttgagtacctagtcactggaaatgggcattgaggggtaggaggagttgggccttgattatcaaaatgtgattttgactagaatgatctgagatctatccagcacggatattctccgtctaatcaacttcatctctctgagcctcagtttcctcctttgcaaaatagagataactccgctgggtgtagtagctcacacctgtaatcccagcactttgggaggcgggaggatcacttgagcccaggagttcaagagcaacctgggcaacacagagagactccatctgtattagacagacagagagagagagagagagagagaaagagggagctctccacatcctgccaacttcacagagctatgggggtgctaattagatggccatccaggtggtaacctattatggccagattgccctggcattctaattgttagatgttgaaaagtagctgaagtatatggaatactccatggatgtaaagaggttagataacaagtattagaatcatccgagctccagaatcagcatccctttggggtgaggggacaactccaggagacaatggcattgtatgctccaggtctgaagaggggaatggatggaagagaaacttgtggtctgagcccttcatgtatggaaagttgtcttgctttactcctaggagttccaagccaaccaggaaattgatttctaagatcacttcatttaaacatcattgggctgcataaattccatctcagcccacaaaatatgctttgacccctgcctaagctcctattacccccactggtctccattttcccttcacttattatcctttcctcccctcacccaattttctaagcaccacaaccagcctgccagcagccagctcactcagggcctcatcctttggacaaattcctagaactcacggcccagatgggagaataatgaagattcatttaccccaggactcttgcttgatttgttgttgagcctctgcctgattttcagtcatcagcccccaattttattcccagagccagcaagggccaagcctcattttcctgggggcccaaatcctcccccattttccttccatccaggcttcaagccagaggccaaacgggggtcaaggatgacggctcattggcagggccaagcaggtggccctgccctaggttcagccctagggagcttcttgttttctcctgaacttccaagaatctccattcccagatgaggcatgctgtcagatcttggcatatgacaccaaatatgtccccctttccctcttctgcctgagtctaaatgtcccttttcctttgacctacaatgtagaagattcttgctaagagctggatgaggaaggcttcatggggtggggcggggcggggggtggtgggtcgcatcaactagagtgcaattctatgtgcgaagagggaaaagcccagcttccgaacctccaagatagcttgtttaaaatttctattgaaagaatctaggggtatttacctctcagctctggacgctgagttttcagacctgcatattttgggtagaagggcctgtgtcaggctgtgaagccagttcctggcaggccaaatgtggcaaagaaccattcagtaaagcagccagcccagcaacacaggcccaggaggcagcttcggagctggttcagctacagaaggtctgagacgcctcttccaagcccctttaggaagcctgactctctggctttcaagctgcctgctgtccccaatccctctctttctggtgcagacactgaagaaaacggttgtctcttgtttcctgcctggagcagctggggctacttgaatattctgcgggatattcctggaaggtgacctccctgtatcctcctctttcggagacaaaggcaaagcaggatgtggttgggaattacacttttaaggaacaggaccattaggtgacgctaagcctcttagccactatgtggcgccatttacccatttttctgtgcaaggttagtgggcggtggctacacgcaaagcaaaccaaatatcaaaactcgaaaacttttcagggatctagttctgactaggctcctaatatgttgagggtacttgggcaaatctcttgacctctaggcgcctcagttcctcattttgtgaaataggagacagatggtgggggggtccctgaaatcccttccagcttcataattttgcaactatgtgagtgaattcccaatgaacatccaagcgatgcaattttgggcctttgggtcacacacagggtgggtaaaaaaaaaaaaataaaagcgcacaagggccaaggcatgggtttgggggtgagggtgagaagggggtggtcatggaagcagggatcctctacaacacatgggccaggatttttcttgagctttccatggcgctagggaaaagataaggagccattcatttgcttagtaaacattgatcacaaactagatgccaggcactgtgtgatagaggcaaggctgcggtggtgggtgggagagaagtgaatggtgggtgggacaccaagatgagtaaacctcaaagtgtttaccagccagtggggaatagatgagtaaacaaataaccagtgcacaaggaagaatggagtctgtgctaaatagaactataaactgctggaggtgacagggaggaaggagggatatattctgaccagataagaaaggtctcacagaggaggagccattttaactgggctttgaaagatgaacagatgtctgtgtgtggtgggggaggggtttggagaaagggagagcaggagggggagggaaaggcaggcattctgggcagaaggaatggcttaaggaaaaatgagggatgggtacattatgctgttttggcggaatagggagtagtctgaggtggcaggagagacggagtgggaaaagagttcacaaaaatggtttggggccagattctggatttacagagacttttcacctggtcagataaggtacagagcgtatgggacaggctcccaagatatggacagagttctagccctcccgtatggagagggcaagacccagtacttcatacgtatacaaggccaccaagggacagttaaggtgaacaaggcaggcaagcctgactgaaagtatggtagattaaaggggaagggagcctgagagggcattctgaaggagggcagtcttccaacagcgagtattccactctcctctgtcctaaaacctacatagtagaagcttttaaaaattatttaacttattattattatttttttttgagacagagtctcgctctgtcacccaggcaggagtgcaatggcatgatctcagctcactgcaacctcagcctcctgagcagttgggattaaaggtgctcaccactatgcctggctaatttttgtatttttagtagagacagagttttaccatattggccaggctggtctccagctcctgacctcaggtgatccacctgcctcagcctcccaaggtgctgggattacaggcgtaagccactgtggctggcttatttaacttttattttaggttcaggtttgttatataggtaaattgcatgtcacgggggtttgactgtagattatttagtcacccaggtaataagcacagtacccgataggtagtttctcaatcctctccctccttccacccttcaccctcaagtaggccctggtttctgttgtttccctctctgtgtccatgtgttctcatcatttagttcccacttataaatgagaggatgcagtatttggttttctgttcctcattagttcacttaggataatagcctccagttccattcatgttgttgcaaggcacatgttatcactccttttaatgactgtgtagtattccttttctttttttggagacagattcttgctctattgacatggctggagtgcagtggcatgatcttggctcactgcaacctccacctcctgggctcaagggattctcatgccttagcctcttgaatagctggggttaccggtgtgtaccaccattgccagctactttttgtatttttggtagagatggggttttgccatgttgcccaggctggtctcgaacccctggcctcaagtgatccaccagccttggcctcccaaagtgctgggattacaggcgtgagccactgcatgcaggctttttatgtctacatagtattctatggtttatatgcaccacattttctttattattattattattattattattgagacaaggtctgactctgtcgcccaggctggagtgcagtggcatgatctcagctcactgcaacctctgcctcccgggctcaagtgattcttgtgcctcggcctctcaagtagctgagactacaggcgtgtgccaccacacctggctactttttgcatttttagtagagatagggtttcacgatgtttcccatgctgtcttgaactcctgggctcaaacaatcctcctgccttgacctcccaaagtgctgggattacaggcatgagccaccgcacctggccccacattttctttatccagtctatcattgatggtcatttaggtttattccatgtctttgctattgtgaatagtgctgcaatgaatataggcgcgcatgtgtctctataatggaacaatttatattcctttggttgggtgtatacccagcaatgggattgctgggtcgaatgggaattctgttttgagttctttgagaaactgccacactgctttcttttatttatttatttattttgagacagggtctctgttacccagggtggagtgtagtggcatgatcatagctcattgtagcctcaaacttctgggctcaagtgatcctcccacttcagcctcccaaattgctaggattacaggtgtgtgccaccatgcctggctaatgttattatttttttattttgtagagacagggttttgctatgttgcccagactggtctcaaactccttgtcgcaagtgatcctcccgcctcagcctcccaaagtgctgggattacaggagtgagccaccatgcctggtcctacactgctttccacagtggctgaactaatttacattcccaccagcagtgtattcacattcccttttctccacagccttgccagcatctgttattttttggctttttaatgctagccattgtgactggtgtgagatagtatctcactgtggttttgatttgcatttctctaatgataagtgatgttgaacgttttttcatatgcttgttggctgcatgcgtgtcttcttttgaacagtgtcggtcggacgcggtggctaatgcctgtaatcctagcactttgggaggctgaggcgggcggttcacgaggtcaggagttcgagaccaacaatgtggccaacatagtgaaacctcgtctctactaaaaatacaaaaaattagccaggcgtggtggcaggtgcctgtagtcccagctacttcggaggctgaggcaggagaataccttgaacccgggtggcagaggttgcggtgagctgagatcgcaccactgcactccagcctgggcaacaagagtgaaactccatctcaaaaacaaaacaaaacaaaacaaacaaacaaacaaacaaaaaaagaaaactgttcatgtcctttgctcactttttaatggggttgtagttttttgcttgttaatttaagtttcttatagattgtggatattagacctttgttggatgcagagtttgacagtattttctcccattctgtagattgtgtttactttgttgatagtttatttttctgtacagaaactctttaactaggtctcatttgccaatttttatttttaaattttctatttttgttttttttattattattattttatttatttttggagacggagtctcgctctgtctagcaacctccgcttcccgggttcaagcaattctcctgcctcagcctcccgagtagctgggactagaggcacacgctgccacacctggttaatttttttgtgtttttagtagagacggggtttcaccatgttgcccaggctggtttcgaactcctgagctcaggcaatctgcccgcctcagcctcccaaagtgctaggattacaggtgtgagccaccgcttccggccttattttatcttttgagacacagattcgttctgtcacccgggcaggagtgcagtggcacaatcttggctcactacaactctgcctcccaagttcaagcgattctcttgcctcagcctccctagtagctggggttacaggcgcccaccatcatgcccagctaatttttgtatttttagtagagatggggtttcaccatgttggccaggctggtctcgaactcctgagctcaagcgatccacctgccttggcctcccacagttctcggattacaggcaattttaatttttatttttgcaattgcttttggcatcttggtagaagctttaaagatctgacctatgaggaacaagaagaggtcctgcttcaaggatggaagagtcattccaggaaacctggcaaactgcctctgctgtggctgcatttgcaggactagtcaccagtttgtttccagttagacctcaccagcccgcggcaaataggaaaaggctgaggcattatgggagctggcatcaatctagttaggataataaagcaggtgggatttaggtcagtcttaaggaaagcagaagactgtattctgaagagtgagagatctggtaaccgtaagaggttataacttgtgtttgttcaatagccgatgagtgcccactcaatgccaggagcatggccggagggaggagtatgaaaagtactctaggaaaaaaaaaaaacaaagcaggttatgagaatgcagaggacaggaccctgtcttggaggaaaggcatcaaggaaggctcccacaaagtggtgagacattagagatggatatggaagaagtagttgatatacagttggaggggatagagcagtgtcccgaagaaaagcaccatgcatgaaagagactggcaggtttagggaagcaagaagcaaatgagctggagtggttgaggagaagcacaggtaaggggaagggaaagggggcgggcagagaaagggagctgatgcttctaccctccccactctgaaaatctccaagtgcccaagttcttatttgccattttttgttaagaatccagctccgtagagctgaactcaggggtccctgtatacctttgtgtttgtcaccactcccctccgctctcattctagccatgaagtccactgaggaaaccacccgctgcaccagccttacagcaagtcagtaatgaagagggaagaggagccaggagcctgctcgcatgtcttgaaactctcaattcagctcagccctggctctgagggaggaacgggctgaaaaggaagagttagggaggttgttggattgtggtaggaatttttattcctcatagaaatttctggtctggtgaagggagagaggcatggagactgggccaaggggtgggggctaccttggaatttagattcatctgggtgatccattagcaaactctcattagcaaaataggagactggcccaatcctcagggatgggtcctggaggcaggagtcggggaagggtggaaggaggggctatggcttgtctcaaaggggctggggtatctgccagttctggcacaggccacaggcaagcaggattctctcttgttcctctgcccctccccttctccaatctctatcccctgccttggcatgagggcctctagagaaaagaaaataaaaatgagtgggcagaaacagctggatacagtcaggaacacatctggcctcccggactgtctcctggtccttgttttgcttctccccccatgccccttcctcctctgcaggcttctgataggaggactgtagcatagctgggggaagggtggggaattagagtggggctgggtgatgggggagaaagttgttctaaatattaactggtcttgtgagatgtcttcttggctggagcctgaccacctaacttactgtttttcctccaactgctgcctcctcctttccctctgctgcaggctggaactaagggcggcgggtggcggcgggaggaggaaggaggagaagcaaagttggccagggtcctgctggctgggggccaggactgcctccctaaacaagcaggcgggggcacatatagccctgggttgagttgttgcccttactcatctggccacagcaggaagaagaggcgcccggaaaaccttagctcttggctatctcttccctgagcacaccctggccctggggcctgagatctctccatgcaggggcagccatgagctccgggggcagcagcaaggctggccacaccacccatcagccacctccagccccgccgctcaaccagccatcagtcccttaactgccagtgttcgtggaccatgcaaaacaaccaagtgagtgaacaggggctggctgagggttgggagaggttcctggacaggaagtgccagcctgtgccctctttttttgccctcagggacaaacatgggaggtttaggcaaactcttctcagggggtaggggacactgaaatgttgatcagtgtaggtgttttgacccccaccccccaaccatttgcttttctgtgttcctcttgccctctctccctctctctctctctctcctctcccaactccccactctgttcttattcctttctattcccaggcaagggactcattaagcccaaagcaattttagggtgcccagtggagagactcacagaggctgctagtgccgatgctgctggtgctgctgctgaggagtgcccaggaccaggtgccaggggagttggagtcaataaccaccactgtcagatctactgacccccaagccagtttctccagtcaggtacctcctactccctgtggaggcctggggatctctaaggccctacagcttccctgtcactcccattttcactccactctctatcccctgcacttagcctcccttggtggctcttccatttacttctttccccaccccaccccaccccagtccca

SEQ ID NO: 169 - DNA, 2316 bp, Homo sapiens
aaagactaaaacattttaccaattttgcattgtttgtttgaaattgcattgacgactggtatgttaattttgtatatatttttatgagaacaatgttggacatcatttaatttttttaggtttttttaattgattattgattggttcatttgcaggaactgactattagtaatcaaggatacaaattgttaagagaatatgttacagagaaaaacttgacaagctagacttagatttttgtcgttaaagataatttgtgggatatgatttttataaggagttgcattaaatagaatgtcttacacagatttaagaggttaataattataaaattaagatgagttcttataaaatattcttgaggtataataaaattatacttgtggagtatatctttgaataacatttaaaagcaaactaatactttccaggtaaaataattatcaacataactttttaaaaataattcatagtacttcaggttatttctatgtttgacacattaacttaaaagaaaaaaggaaaatggtgattagttaatgccatacacactggacagaaaagaaacttagctcttatggattcctctccatattttgcagcagggtaaatgtaagttttcttacgtagctagatactgtgttccagtgctgttgatgttgtactgttttagcaatgaagagattgatatgggctgattgggggttagggaaagtgaagcagcagaaccagaacagagtggacatttaaagggtgctaataagtaaataattatgtgaagtagcatactggtcgaaatgcataactcaaagataatcgggaagcgtattttcttttcttttcttttttttttttgagatggagtctcgctctgtcgcccaggctggagtgcagtggcacgatcttggttcactgtaagctccgcctcccaggttcacgccattctcctgcctcagcctcccaagtagctgggactacaggcgcctgccaccatgcccagctaatttttttgtatttttagtagagacggggttttaccgtgttagccaggatggtctcgacctcctgacctcgtgatctgcccgcctcggcctcccaaagtgctgggattacaggcttgagccaccgcgcccggccgggaagcatgttttctgaaacataacctaagaaagtataaatgctgccttgtgcctacaatcctggtgacaagagcaagacttcgtctcaaaaaaaaaaaaaagtataaaagctccttaaaggatgtttcaaaataatgaataatattaatttctatattgtatattcacaaatgttctttctagaataattatttgcttaatggggtgcatgtttagttggtgagaaatgaattaataggttagtgatttattatctgttgggaaaaattttagacattcacatgaaagtagagagaataacataaatgaatttccatatatggatcacttagatttagcaaccgttatgattttgccttacttgccttttcccccaaaatactgtaaagtaaattacagttatcatgacattttcttctaaataagtcaatataaacatataataaacaaggacctttttctatatagtcacaatgccatcactatacatagtaggattaacagtaattccgtaattttttttttgtttttgagatgaagtcttgctcttgtcacccaggctggagtgcaatggtgtgatctcggctcactgcaacctcgacctcccgggttcaagtgattctcctgcctcagcctcccgagtagctgggattacaggggcctgccaccatgcccggctaatttttgtatttttggtagagatggggtttcaccatgttagccaggctggtctggaactcctaatctcaggtgatccgtctgcctcggcctcccaaagtgctgggattacaggcgtgagccaccgcgcccggccattccttaatgtttaacacccagtgcatattcagattttcccagttgtccgcaggatgtcttttatagctgctttcttcaaaccaggatctattcggagaccacacattgcatttgatttttatgtcttttgagccttttaaaatttagagcagttccctataaccccttcttttgtttgttttatgaaattggcttgttgaacttcacaaaacacgagttggggtcatgccaactgtaccgttagtgattagtttacatatagggaaaataatttgtgaatgttggtccattcactctgccagctataccatggcagcatttccagtatcaggaaagcaaaccaggggatctaaaactgagc

SEQ ID NO: 170 - DNA, 3855 bp, Homo sapiens
aatgcttttaaatgatacgataggaaaatgagcaggataagaggcagccaacttcactttggcctttttttaaaccctcttaaattctggatatcttttagtgttctctgttatattagttctttgctgtaattgcccaaataatccagtctcagttttctggacctgcagactgtatttgcggatatcacccttagaatctagcaatatgtgatggaaaagtggcatgctttgggccacattagatgggaaatagatgaaccagtaatcagccaactctcaactttagtgagcacttatctcctaactcttctttataccaataacctttgcacatctattttcacctttcatcttctagatgttctgtggtcatgtctgttgtcctattttatttatagagatttcagtcagctcagccagctattcccacctctgagtcttcaagtggtcatctcaagaaatgaaaaactagcaacagtttgtgaataagctaaatgtcttaaagtgttgtcataggcaataaagcaggatcaagagccagccaacctgtaaagtttatggaaaaatggtctcctaatattaacattcctagcataccactgtccccttctttcattctctatcttatgtcctggatattggttactaagctctgccacattagtgtctttacttatgttgtctgaagaatctagtctcactttcctgcaccttgcacactttatttgtgcatgtcaaccatacaatctagaaatatgtgacagaaaaaaaaacaaaatattttaaaatagaatagaagcaagtgaactaggaggcagacaactcctgctattcagaaaaaaaattgggctttcagtgtttgcctcttgccacaacctgcccttttcttatttacacccttacatcctgggtatttggtaggaaaccatcttatattcgtgtctttgctaaagttggcataagaatctagtctcggttttctgtatctgtagactgtgtttgcacatatcatgatagaatctgggaatatatgatagaaaacataatacactttgaaccatgttagaaaggaaactggtgaatgaggagtcagccaactcttgcccatcagccatcccttttctcctaacttctttatttcttccaatgttctgagtttacttttccccttttatctttcaggtatttagtggtcatttctgttgtgttatttatatagagagatcagtagggttgggccaaatattctcacattttggtctgcaagtggtcagctcaagaagtgaaacctgggaagaggttatgaacaagtgaaatgccttcaaatgttgtcataagaggaaagacagcatcaggtgccagccaactcctgcccttttacaaactttgtctcctaatattcctcttcttatcactcccctcttcttttcattcactctttttttttttttttttttgaggcagagtcttgctctgtcgcccaggctggagtgcaatggcgctatctcggctcactggaagctccgcctcccgggttcacgccattctcctgcctcagcctcccgagcagctgggactataggcgcccgccaccatgcccggctaattttttttatatttttagtagagacggggtttcaccgtgttagccaggatggtctcgatctcctgaccttgtgatccgcccgcctcggcctcccaaagtgctggtagtacaggcgtgagccaccgcgcctgtcctcttttcgttcactcttttcccttgtggatatttgttggtcacttctgttatattactttctttgctgaagctttccagaggccgaagtctcttttgtaacttggagtttgtatttgcatatatcaacagttgaatctaacaatttgtggtataaagacatgcttgaacccaaattaaatggaaataggtaaaccatgaaatagccaattccctcccattagttgtaagttccttatttctgtctatgatatttctcattttattttctcctattcccacatggatttttaaaattatctctgtaacattagtatcttttgagagatttgagagagtttccaccttgaagtctgaggtcacaacatcaaacagagaagcttagcaagcattatagaaaagtgaaattccttaaaataattaaataacaagaaagtatgaaccatgagccagccaatttttgtctttgtgccaaactatttatcctaacttccatcatcctttatagcccctccatcatcaccattctattgccttccttatacactctggttgttgtctgggctcttgtctgtgttattgtctttatattggtttcaaggattcacagctcagctttaccaccttgactactgtgggtgtcttgcatgatgaaaaagatttaacaagatagtataaaaatgtgtattcccttaatatttttggattttataaaaagaagttccagaaatcatacacctcctgtcctctatcgagatcctcaatcctaaaataactgtgatcctcagtctccctatttcacttcacttttacatatattctcatgcttgctaaatgtttcatggtcacctctcccccatcagtgtctttgctaagcctgtgggaaaaatcaggcctctgtgttcaatcttgtggactacagtttcttacaatacaaagtagcagtttatgaagaaaaacagcacgtgcattacaaaacttaattcagatggaaggtggtccagatgccagctgacttctaccatttatttaacacctctctcctagcttccatcttctactgctgaccttctttcctctattttcccctttatcgtccaaatgtttaatattcatttttgtagtgctagtgtatttgcaaaggttttagagagactcagtattatcaacttgaggcacttttttttttttttttgagacacagtctcactctgtcacccaggctggagtgcagtggcatgatctcagctcactacaacctccgcctcctgggttcaagctattcttgtgcctcagcctctcaagtagctgggactacaggtgtgcaccaccacacctggttaatttttgtattttagtagagatgagggtttcagcatgttggccaggctgatctcaaactcctgacctcaagtgatctgcccacctccgcctcccaaagtggctgggattacaggcatgagccaccattcctggccaacttgaggaccttttgtggccaactcttaaagagaaatctagcaagagttgtgggcaagtgaaataccttaaaataatgagataataggtgaaaatggaccaagagtcagccaactcctgccctcagccagaacttgtatcccaacttttaatttctataactgcctgtcacctttcttttccccttcactattcagattagtttttttttaatttgtataaatgtatggggtataagtgtaattttgttacatagttaattttaaaactctactgtcaggagtgggattgttgaaggttatttttgttgcattaatcccacctcaaggtctctgtgtagccacttcttgcaagaaatgaattctggcaagagttatgaacaaattaaatgtcttaaaataatcatacaagtggagaaagtaaaccaggagccagccaacttctcccctgaatcagaacatttctcctaacttctatcaccctaccacaaccctccctgccatcaccattttatttccctttttatatactctatgttttatagtgtcctatactgttttagtgcctttacattgatttcagggatacatggcctcaatataaacaccatgagggttttgtgtgtccaatgacta

SEQ ID NO: 171 - DNA, 9046 bp, Homo sapiens
aagcctgaaagccctacaaacctctgtgcttcataagcctgactgccccacaagccaaggtaccccacaaaccctagttctccagaatcccaactgccaaacaagcccaactgccccacaagccctagtgctccaaaagcctgagtgctccacaagcctgactgccccacaagcccgagtgtcccacaagccaactgctccacaagcccacctaccacacaaggcctagtgcaccagaaacacaactgctccacaagcctgaccaccccaaaagccaaagtattccagaatcccgactgccccacaagaacaagtaccaaacgtgcccgacttctattattctatttatgtgaccttcttgaaagagaaaactgaaatgatggtgtacaaatgagtggatagtagagttagtggtggagaggtgggattaactataatagcaggtggaggggggttttggggggaggaatgtgatgaaattgtttgtattatgatagtcgttttggttccatgaattaacacatgggctaaaacccatagaactggacaccaaaagaaaagaaaataattttagtgttgcaggaagtcagggaccctgaacagaaggaccggctgaagccatggcagaagaacataaattgtgaagatttcatggacatttattagtttcccaaattaatacttttatagtttcttatgcctgcctttactgcagtctctgaacataaattgtgaagatttcatggacacttatcacttccccaatcaatacccttgtgatttcctatgcctgtctttaatctcttaatcccatcatcttcgaaagctgaggaggatgtatgtcacctcaggaccctgtgatgattgcgttaactgcacaaattgtttgtagagcatgtgtgtttgaacaatatgaaatctgggcaccttgaaaaaagaacaagataacagcaatgttcagggaacaagagagataaccttaaactctgactgccagtgagctgggtggaacagagccatatttctcttctttcgaaagcaaatgggagaaatatcgctgaattctttttctcagcaaggaacatccctgagaaagagaatgcgtccctgaggggaggcctctgaaatggccgctttgggagcggctgtcttttatggtcacagctgtgcgatgaaataagccccggtctcccatagcgctcccaggcttattaggacgaggaaattcctgcctaataaattttggtcagactggttgtctgctctcaaaccctgtttcctgataagatgttatcaatgacaatgcctgcccgaaacttcattagcaattttaatttcaccctggtcctgtggtcctgtgatctcgccctgcctccagtgatatcttattaccttgtgaagcatgtgatctctgtgacccacaccctattcgtgcactccctccccttttgaaaatcactaataaaaacttgctggttttgcagcttggggggcatcgtggaacctgccgacatgtgatgtctcccctggacacccagctttaaaatttctctcttttgtactctttccctttatgtctcagaccagccgacacttagggaaaacagaaaagaacctacgtgaaatatcgggagtgaattttgcctgatattttagtatttggtactttacagaataaaatttaaaaagtaagctagagtgactatattacttaattttttactttataagaaggaaaattgccatggataaatagggacattatgcaatgataaaaaatagtcacttaacaggtaagacataataatcctaactgttaattcacctaaaagcagagcttcaaaatacacaaaacatcatctgatagaactgaaaggacaaataatcaaatctacaatcatattttgatactccaacactcctctctgagtaaatgataaatgaactagacagaaagtcctcaaagttatggaaagacctgaacaacaaaatgaaccacctcgagctgattggcttttgctgaatgcgccacagcaaagcagcagaatatacaagattttcaagtatatgtggaagttttaccaaaataaatcataaatcaacccataactaatttaaaataattgaatatgtacaaagtatgtttttaaaatctgtaatgggataaaataaaaaatataacgaatgagatacctgtattttttaaaataacatatttttagtgatccatgtttcaaaaaattcttgaggaaagttagaaaatatttccaaataaattaaaacgtaaatgtcatgtttaaaaatttgtggaattcaggtaaagtagtgcctatatcattaaatgcttgtattagaatgtaagaaaagattcaaacaaaaaatctaaactttgatcttatataatgagaaaagaaaagtaaattaacctaaggccaacaaaaatatatggatgatacccagcactttgggaggccaaggtgggtggatcacgaggtcaggagttagagaccagcctggccaaggtggtgaaaccccgtctctactaaaaatacaaaaattagctgggcgtggtgatgggcacctgtaatcccagctactcgggaggctgaggcaggagaatcagttgaacctaggaggcggaggttgcagtgagccgagatcacaccactgcactccagcctgggtgacagagcaagactccatctcaaaaaaagaaatatatgtatatatattttttatacatatatatatatggatgatatagatagggaaataaaaaatttcagaaattatagaaaaataataaatgaggttgatggaactaaatttactttttaaaaaattttttgagatagaatctcactttgtcgcccaggctggagtgcagtggcacgatctcagcttgctgcaacctctgcctcccgggttcaagcgattctcctgccttagcctcccgagtggctgggattacaggtgcccgccaccgcacccggcaaattttttaatttttagtagagacagggtttcaccatgttggccaggccagtctcgaattccttacctcaggtgatctgcccaccttggcctctaaaagttacttctttaaatagataagactagttgaaatgtctgacatcaatctgagaatttttttctaaaagttgttcagaagcaatgactttgaacaaagcttcaaatagaggaaagtatatgtaaactataattttcttgtgataacactcttcgttctttagagaagattctgagaagacaagattctccttgaaattgtcttaatttttaagtgcctactatgtggcagattttttttttgagacgcggtgtcgcactattgcccaggctggagtgcagtgacgtgatctaggctcaccacaacctccgcctcctgggttcaggtgattctcctgcctcagcttcctgaatagctgggactataggcgtgtgccaccatgcccggctaatttttttgtatttttagtaaagacggggtttcaccacattgtccaggctggtcttgaactcctgacctcgtgatccacccaccttggcctcccaaagtgctgggattacaggtgtgagccaccacgcctggccgtgacagttgttttcaaatgcattagcccatccaatttgaagagcatcctgtaaaggtcagcagaaagagttcaccttcttcactccatagcatttactgcacttccttttgcagtgccatctgtcatctcaggaggccgaagatttcctccttccatctgatgcaggggcagaattttgctcagagtctttgataccttccacataaccattcttgcctgaacacctgtacaggcaccactagtcacactgaaagccagtatgttcctggggagagatgccagacaggaggcagtggaaggctgattaattattcttttcaaattctagctggcatgtcaatcatggaaccatttttcacctcctgggagaagcccagggtttgtaggaattcagactcagttgatcgctgttcctcttagaattcttatgaggggatggaagttttgagcacctaagaaagcctgtccctgtgtttgcccgttcagtccccaggttcagataagaaggtcattaaaataaaactgcaaatatgctagtgactggacaaactctctgtctaccttcaggcctgtaccctaagaaccaggaaattatgtttcaaatcatactctacttgcagcccactgggaaaacaaacagtatgcagaggatttcccagagggaataccaagcgtctaaagttgcagtccagggtggctgtggctgtgagacaagaccaagggtgtgtggtggcagagtcaagggacttttgcaggggataggattactccatgtcccagggaggggaggtgattctgcacagcctccaggggaggcagcagtgaagaccggacagcaggccagttcccctagtcagaagggagggcacatgagggtgactgagaaagggtgctgtgacacgagaaactgtcggggccagaaacaaatcctgggagtgtacttgtcccatgtgcccaggaaggacaggaatgcaagatgtggatgagcacttgaagcctctcccacaacctgatgagcacccatagtaggtgctcaacagaaagcattcagccatgagctcccaggggacttagcacatgccaccccctaatggtgtttgattctcattgtcacctttgtagacctgcttttagtaccttggtctcagggttctttctgtcacctgagagacatggcgcagtgctgagaagatgcagtcaggagatggggctcaggctggggggagggggaacagcataggctctggaggaattcagaccaggggtctttccagccctgtcccttagtagccacgggattctgggaaatacccaagccctgtgaacctcaagctctacgtctgtgaagcaggtgtgacaagtcctttccactaggactgttggagtgtgtgccatgcaagtgaagcacctagctcagggcctggcgtaaattacaagtttaaagaacggcgaatggctgttttttcctatattattttaccccaggccttaacactctgggattttgttgttgttgtcattgttctccaggacttatcagataatatacagcttggtaagacatggaataatcagtcaaagaatgaagtttcatctataaaattcagtaaatatttcctcttagaggacatacttcaaactttggttgttggggagttttcccaagccagatgcagctcacagctcctagaatttgagtcaaggaccaactccttccttctctgcccgctgcttttccatccaaaccactacttttttttcatttcattgccacccaaaatctagccgttgctaaaattagccaaatggcacttgagatgacctaattagaatgtcattttaatagagtcagctttggctcccagccaggcagaagagtacctgtccagtggcttctgggcctcacttccagggatattcacccttatctctcagaaaacacttgcaggtgatgcgtatccatcacctagctcttgtgctgtgttccacctcactggaacaggagcacagaatgctttccattcctgccccagatggaaactcctctctgctttatccactattcaaaaggaactgctgagcagttttctattccaggcttttctctcatgcctgagaatctggctctggcaccacacagcttcattacaattagctccccgagaaggaactacagtttcccaaagtccaaaaggttttggctcagggcatgtacactcaactattaatactctcacctgttgctccacaccctcaccgctctcttattttccctccagatcttagaagacatctagccactttaattatgtgactgcagatcctagactctaccgccctaaggttaggggtggatgtggcttaccttagcatctctactattaacctaagccttccaaatagcagatgctcaatgaatcttttgagaaaaaatgagccagtgagcagggggacctaattattcatatgtaattctcttgcatgatcaaataagccaagcaaatctggtaagacttcaggatagtgggttccctcctggcccaggacaggtctaaaaatgccgtccaaaagccaagttctgaaatcaagaaccccaaaagacagcttggttgtcttctccactgtgggttctaagggccctcactgaaaccagttatgtgaaaccacctggtagttttcctgaaccaaatcttgtggaaaataaacttattaggctgtccgccaggcacaagaattaccctgtgaaaggcatactggaaaacctaccatcagctcccctccatctccagttaggtcagcctcaccagatattctggtactagaacttcagtttggctgggggctctgaaaacagccccttaggcaggcttcccatgagctaaaccaactgaaactgagcagaccaaagaatgagccagatgaggaatctacccattctaaccaaccagcctgtttgtcttactcatccacgtacaaaagaaagtgttagcagctgcacagagtccttcctgttgagctagaaggttgcagttccatgatctagtatcccatcacgggctaaactgaggcagggagtgaggccaagtggatcttgaagtctgactataaaagggatccctagcaaagtttaaacaaacaattgcatcaaggatgtttctaaatttagccactgggtggattaaagaatgtcttgggtcatgtaaagatatgggcttggcatgggatatccaatgttctatggaagctgatcattgtaaaattctaactacatgtcaccctggacccacacaggtctgaactgcatgggtccacttatgcatggattttcttctgcctctgccatccctgagacagcaagaacaagccctccttttcttcctcctcctcagcctattcaatgtgaagttgatgagaatgaagatttttatcattatccacttctacttagtgaacagtaaatatgttttctcctctgtatgactttcttaataaccctttcttacctctagctttctttattgtacaaatatagtacataatacacttaaaacacaaaatatgtgttcatccataatatttccagtcaacagcaggctaatagtagttatgtttctgggggttcaatgtttatacacagatttttgactgcattgggagtcggtccccttaacccccacctcgttcaaaggtctagcatacaggtgttatcttgccaagtgaaagagggaagcataagcaagaaaaaattaagagggataaggatgtcattgtgaaagggagtcttgtttcaacatcttcagagaagctgtctacaggatgaagtcatcgagttctcattctggcttatagcttgaaagtctgcttatggcttcaggcattgtggtgaactctctgagtggctcacacatcaggcgggagggttgtttgttgacgtttacatgagatgttgagctgcagcttacagaggacctgagcagttcccgttagtatgagacttgcagccagataatggagaaaattagaacaatttagaatcatgtatggcctgcaattagactcgaaaacaacgaacagagctacaagctaataacaagtataccatagtttttttaattttcctgaaacttaatttttctctcttctgtctgcatttctatcaaagataactagagtaagactattttgataaaaaaataagtttagtctcatcaaacttagaatgattacttatgtaagtgcagcaaggatccattagccacataggctcttttaaagtttgctttgttggaacttttagggaggattctcagatttcagttttcaaagcctctttatgctaggaagccaaaccaaggtggacttcagactttgtctgctgcacctatagatttgggtgaatttctctcttctcggggtcccccaaatattttgaggttcctgggctttccaggaagtgactttttttctcactataaatctgggaacacttaaagccatacattctatggacgttctcaaacatggtatcgcagtgacaacctgggtagtataactagtattcccagttgcatcctgttataaagagagcagactgtgattgaacttatgcaaacaactttgccataaaatccagaacacccacaaattgtctctgggaggcaagttttacaaaaaccttttttagaaatttgtgcacatgaataggcatccatgtgggggcctatttcagagggcctaatttttaagcacatttttgggatgaacagtattgttcatctgaaatgtttcacatgatggccattgtaagtctaaattatccttatgaagattgcacctttttgaaaaggtttgctgattctgctgcgtaatacttacgcatatagaaagcaggcatagccagaaggtggagtacacagttgtctggaaagcaaggatcccatttttatgttgattcagagataagatcaaagtctaagaaggaaatgccacgggattgggtcctggtttgctttccagtgaaccttgctgcatggatgctgtcttgaggctgacggtgacatggtatttaacttatttgtttcatgaccagctgatcctaacacagacgtcttatttttaggtggcgagtgctctaatcgctcctaagtgcctaaactggagccaccagtcagtcatggctatggctctgagcttcccctgactaacgtagccagtgaatctctcctaccgaagcatacaagcaaaagaaactggagaacccacatccctgcaaatttccaaaagccagagtcacacactgcatgtgataatctgctcctgccatcagttacctttaaaactacatgtattgtcagtgacttgttagctcccacaaacccccaggtcatgttctctctcacaggacaaatgaatcctggaatcaagagcca

SEQ ID NO: 172 - DNA, 2560 bp, Homo sapiens
aaactacaatttctcacaaattctctgctcttgccaaattttgttttcctcttttagcccgtcggttccgcaatttcgggcgcaaataaagaccttctggcatttagtggaaagagcctagttgagcacgatccgcagaagcggaatcaggtggctttcggataggcagcgagatccgaggactaaatcccgaggtcttggcgagcaagcagctgccctccgccaggcatcgaggagcgagctgccgccgcgtttctgtcgcggcgccgcggccgaaccgggtagaggtggtctaccatcggcccttcgtggtgggcccaggggtgtttccccgggcaggggagctgactgcaggccaggggcgccaaggccgcggtgcggtgggagcagagggcagcgcagcggggctggacttcatcttcccacgccagaggccgaggcctccgggaatcgcagggccacctcttcaaagcccttggcgatcccagttctgttccccgagggggctggcgaggtgggcggggcgggcaggcgagactaggtctttccctgtttggcctccgtagccggcgccggcgggtcgttctgtttgaatgaatgatcccagcagccgcgcccaatgggcgtccacgcctgcttaatatgcatgaggcccgcagccaatggccaggcgaggaggctgttttaaacggcagagcccgctggccaatcaggcggctctcgtggaggcagctagcgcgaggctggggagcgctgagccgcgcgtcgtgccctgcgctgcccagactagcgaacaatacaggtacgtctcgcaccgcccgctcccgccgccgccgccgccgccgccgccgccgccgccgccgccgccgccgccgccgcagcgcccgcacaactttccggcccgcgccgccgtgagcgcgccctgccgccgcctccccctgcctctactccccattcccttcccgccccctccgccttccctcctgctaggcggccgggaaggaagaagcaattcaggtgtttcaacttttccaacgcgttccccgagctccccgctttcgggggtcggccccctcggcggacgcccgcccgtggcggccccaggggccgcagccgggaacccagggcccccgaggccagatgtttgggcagctgcggctgcggcggctgggcgagcagaggggcggctgcgggctgtgggcgctgggcggcggcagcgggaagggggccgggagttccccggcccgcgacggactccgctggggaacgggcggccggtgcccgccgggggctgcgcggctggtgcccgccgggggccgccgcacgggcaaacttcgctcccgggcttggcccggcgccgcgcgggcccgcaggctacgccgctggctctgcgttaacatggccgtcgcggagcgcccggtggcccgggggggcgcgggccggccgcccccctctcgcctcccgcccgcccggcgccgccgccgccgctaacatggctggcgcggcgctggcctccggcgagggcaggggaggcgggcggagcggtcggcggggcgcccggcgggctccggcctcggccccggcgcccgcggcccggggcgggcggctcggagggccgggggcgccgctgcgggccctggagcggccgagcgtcatggctgcacgggcgcctttgttatcccgaggagtgcgccccgcgccggggggcggggaggtccggcccgggcccccgagcccccgggcggcccgggcggggcggggcggggcggggtgggggccgacgggcgggcggcggcggcggggcccgggccgctttgttcgccgctgtcgccgccgcccgcgccggccgcgcgcggatcagccattttagcgagtgggactccgaggcgcggcggacgccgccaccagtgccgcggctgccgccggcccggccgcacaccccccgcgcaccgccaccgccgccgcccccggccccgcgcgtcccccggggatgacagcggcggatttcaggggcactttctttcatcaggaggcttttgacaaaatggaaggtgaattacgggtgtcccggtgacccggcacgggggccgaggcgggctgcctgctgccggccgggactcccccgctcccggtcccgccccgcccgggccgccgctgcgggtctctgttgggcagcctcctgggcggctgctgccaaggggagctctttagttttacatgatgaccttgggtgtgggaaaaggaaaagatggcgggaagctggggggtgggacagggacgatgacatgccgcagctgcatttttatttggaaactttggagaaagtgttctcggctggacctgcattctgggttacagatgagcacgactagccctttttatacaccctccccctttagatagtgacgaagtgatgaattgaactaatagtacgggggtacctgctcactttccagatctcccgtgttgtaaagccgtttttttagtaagccaaaacacatcaacaatagtgacaatttcagatgtcccctacgtatagttctcctgctttggtcttgtg

SEQ ID NO: 173 - DNA, 95 bp, Homo sapiens
ccagctcgggcagccgtggccatcttactgggcagcattggatggagtcaggtctctaatactgcctggtaatgatgacggcggagccctgcacg

SEQ ID NO: 174 - DNA, 90 bp, Homo sapiens
ccgggcccctgtgagcatcttaccggacagtgctggatttcccagcttgactctaacactgtctggtaacgatgttcaaaggtgacccgc

SEQ ID NO: 175 - DNA, 83 bp, Homo sapiens
cgccggccgatgggcgtcttaccagacatggttagacctggccctctgtctaatactgtctggtaaaaccgtccatccgctgc

SEQ ID NO: 176 - DNA, 24028 bp, Homo sapiens
aggaccttgtgggctgggcaggtaagaagcgccggcggccaccagctggggtccagtgggctcggccccgccctcctacgccctgcctgcgggtcccctcgggaggctgctcaggagaggaggaggctggggaggggactggacagggatcgggtagggtggggccaggctgagcctgctctgcgggtcccggaccccagcgccaccgtgcgagaggctcgggtccaggccaggccggggaacggtgtgtgtacccggtggggtgggagggctgggcagccctgggacgagctccgtggcctgggaccaggtctgcctccgcagagcaagtcctggacggacggctgcttgagcccacaggtcgtgcgtcctttgacagcggcctccggccgggaggcaccagctcttcgaacaatgtcagtaccttcctagggccccacgtggccaagcttggattctggggggagaactcgcagcaggacactaacatgtggtcgctttttggatgatttcttcaggtttaaaagtctcttctgttcatcctaccggggtgccgtctcctgccggtcttttcatctcaccaggtaaaacgcttattttacaatttattgtaaggtcgtgcaccaagtttccacgccgcctttacaccgtgtccccaccgaggggcgtcacaaccgtcctccacaccgggcgtcaccggcttcccaagtcccaccgctataaaggacacgtcagtcagcatctcggagtgagacgctttccttctggattcagaatcgcgtccgtcagagactccaaagcacatttgctagatcgacaggcgtgaggagccagcggctcccggcgcttgggaggctgcgtcccacctgcattcaggccccgggttcaccacacacacagcgggcagctgcttaagaaacctttgatttcagtccggggcggtggctcacgcctgtaatcccagcactttgggaggccgaggtgggcggatcacgaggtcaggagtttgagaccagcctggtcaacatggagaaaccctgtctctactaaaaatacaaaaattagccgggcatggcagcaggcgcctgtaatcccagctactcaggaggctgaggcgggagaattgtttgaacctgggaggcggaggttacagtgagccgcgattgcgccattgcactccagcctgggcgacagagtgagacttcgtctaaaaaaattaaaaaaaaaaacacctttaatttcaatgacaagaaataacagctcacaacttatttagttatttgtgaacatcataaggacataaagttagaaaagcccaaaggaggcctcaggcttacgatgaaatcagcacctggctgcctcttccagctgctgcttcttctgcagcagaagagacggaggcagtttcctgggtgggggggtgggtgctgtgcttccgctttctaactgcctgtttccaaaaagcacctgatgctgctgcttctggagcttccagtgcagaaattccccgtggacggtgaaaggggcttgtcttccacacgctgccctgtccatatcatcccggcacgaatgatgtttggggcagagctgcccggcctccccgggtggtgcccatttgttttcctcagagttggcgatcgccttgcttttcacatgtgcttgtgttcccgcctatcctgagctgtccctgagctctctgcctcccgtcacccccacagtcaccatcaccacagccctgcagactgcgcagtgtgtggcgggtgctgtcctgacattacatgtggaaactccatctttgcagcaaccctgcgaggctgctgctcccagctgctgtgcaggtggagagaggctgctgttgtgcaggtggagaggctgctgctcccagccgctgtgcaggtggagagaggctgccaccgtgcaggtggagagaggctgccgctgtgccggtggagaggctgctgccgtgcaggtggagagaggctgccgctgtgccggtggagaggctgctgctcccagccgctgtgcaggtggagagaggctgacgctgtgcaggtggaaagaggctgacgctgtgcaggtggagaggctgctgctcccagccactgtgcaggtggagagaggctgacgctgtgcaggtggagaggctgacgctgtgcaggtggagagaggctgccgctgtgcaggtggagagactgctgctcccagccgctgtgcaggtggagagaggctgacgctgtgcaggtggagagaggctgacgctgtgcaggtggagagaggctgccgctgtgccggtggagaggctgctgctcccagccgctgtgcaggtggagagaggctgacgctgtgcaggtggagagaggctgacgctgtgcaggtggagaggctgctgctcccagccgctgtgcaggtggagagaggctgacactgtgcaggtggagagaggctgacgctgtgcagctggagagaggctgacgctgtacagctggagaggctggggcacacagtcatcaggtcagctgcaagctcacagctgctgcatcttttccctgacagctcactcctgtgagagtcttccaggcttcccggagggacggatgtctcctcaccttttcccacctccacaccttttcccacctccacacctggtaggccaggtatggaattcctggaattcccggctgggagcctcctgggccggttccagccctgtgtgtccccaggaaggctggagggctgctagtggcctcggtgggcacccagggctggccaggaccacacctccttcctccggctctgtgcctgtatctccccgggcctcccctctcgcctggggctccacggtgaccctgctgtgcggcacctcggatttacacccacagtcccatccccagggttcccttctgggcagtttccttgacttaaatcccaaccccggtgttgcatttttaattcccaccggctcttttgtattctctgtgcctttgctttaaaagcacgcggctctctgaggggtcctgtctccatcaccccagccttttccaggctggtttgtttccctgtttctccccttttctcttcctctgtgtgcgtctgtgtgtctgtgtgtctacatgtctgcgtgtctgtgtgtgtcagcgtctgtgtgtgtgggtgtctgtgtgtgtgtgtgggtgtctgtgtgtgtgtctgtgtgtacgtgtgtgtgtagacgtgtctgtgtgtaggtgtctgtaggtgtgtctgtgcatgtttataggtgtgtgtgtgcatgtctgtaggtgtgtctgtgcatccatgtgtctgtgtgtgtaggtgtgtctgtgcatctgtgcaagtgtcgacatgtctgtgtgtgtctgtgtgtagctgtgtgtctgtgcgtgtgtgtgtgtaaatgtgtctgtgtgtcattctttttttttttgagacggagtctcgctctgtcgcccaggctggagtgcagtggcacgatctcagctcactgcaagctccacctcccaggttcaagctattctcctgcctcagcccctcaaggagctgggactacaggcgcccaacaccatgcccggctaattttttgcatttttagtagagacaaggtttcatcatattagccaggatggtctcaatctcctgacctcatgatctgcccgcctcagcctcccacagtgctgggattacaggcgtgagcctccgcgcccggctgtccttgtgtcactcttcttcacacttgggagtccctctgatgatgcctgttgggcctgggcagcccctttggctgagagtcagtactttagaggatccccttccccagcaggaatcctgggtgctgagggcccatgagaaggagctgaggtctcccatttaatgcagagtcttgcacgcacacacctgctccgtgcctgcgcagggtccagcctcttccaaaagtcctcctgttctgggtggggaggggtctcagggctcctgacttcttccattcttgcccagcccaccctaggaagagggcgtgaggctctcccagacacaggtggggggcccagcctgtgttccgctcctccctgaggacgggtcccagtggccccacccgactgggtcatcgtgcagacggctgcctcagtttccccaccttcccctgcccgtgggcttcctcgttgtctccttccctcctgtcactcaggcggggcagggaggggcagacacaaaggcttcctgcgggtgagattggtgccgagctctgtgcccagcctggagcctcaggcctaccccagccttctccagcctcagagcccccacagcctctgcccaacactgccgtgtgctcccctgtctcctgggcgagttccttcaaacccttgaaagccctcacctaagccgggcacagtggctcacacctgttatcccagcactttcagaggccgaggcaggcggatcacctgaggtcgggagtttgagaccagcctgaccaacatggagaaaacccatctctactaaaaatacaaaaagttagctgggcatggtggtgggtgcctgtagtcccagctacctgggaggctgaggcaggagaatcgcttgaacctgggaggcagaggttgcagtgagcctagatcgccccattgcactccagcctgggccacaagaatgaagctccgtctcaaaaaaaaaaaaaaagttctcacctcccaagcagccccaagatgggtttgtttgctggagacagaggtagaaagatctgtcgaggaactggctgaaaattcctaagttgcaacatgggaaggtgttgctggagacagtgtcctgggggtcgggcctggcacccaggggcggccgcagaggaaccctgatggcaggtaccaggcggctgcacacagcccacagctgggctccggggtcagcagcggagacagagaagacccctgctcaggccaaggagccctcccaccctccattcttcaggcaggcgccccacccagcaggcctgacgctgcccctccttccagccggcacccaggccgagctcagccacacctgaagagccgctccggccagggaggacatgcccggcagagacagggtgcagagacagcctcgcccccacacggcgccaggccccacagctgccacagagacgggagccagccgcacgcagaggctcaagcccacggccctgggaggcgccctttcctgggcagggtgggcctgactgcctgctccatccaagcactggggcctcgggccgcgcggaggtcccacaggagggtcagagcggcatcttcccttcagggccctcgcccgggcaccccccggccaatggaccacagctgcacccggttcatccaccgccggggaccacccactcggacccgagccggcttcaagaggggcaagaggccaaggatccagcagaggcctcgggctcgagtctcaggtgaatagagcagccctgggtggcctcctacctctccaaggccaaggcctccctgggacgggtgccccatacccaaggaagtcagtcggcctcatggggcaggggcaggatccacacatggccatgccccgctgctccgagagaggggccagctgtgggcgccgggctctgcaggcacagaggggagctgtcgcgctccgcggcccagggttccgcctggctggcaccacccctggaagggcagcccctcgtctcccggcctgacaatggccccttgggtcacccatgacatcatcatggacattgtgacccctgccctccagggaccatccctgcgtcacgtctgcacccagcaccggcctcacagcccggcccctgccctgcaccaggccactgccctgttggtgaggagggtcggaggggcgacctccctgccccctgctccaagctccccacccccacctggaacctgccggcaggaagcctggccctggagggtggtcacggcccctccccagatgtaagcagtccccaggccgcctggtggggccagagctcgggctgaacttgagccccagacgggccagggggattgtccagggtattggagaaatgggctgggagcaaactggctgagccatgtccgggctgagtgggcagctcccgtagccaccccggtgggaccccaccccgttcacaggcccggcccacgagaggccaatggggagcagccaggaggagggactccggtgtcagccaagccagccagaccacgacgcagatggacactgtgggccggacctggagggggcagaaagagcctctgccacacccggaccccctgggctcctgaacagccaccggcctgcagactcggatgacactaacgccgccgggccctcagctgccctcctggaggggctcctgctggggggtgggaagccatcgccccacagcacccggccggggcccttcttctacattggaggcagcaacggggccacaatgtgagtagcggccctgggcgcccgtggtcccactgaatacccaccgcctgctcccggggcccagcccggcctccgctggccgcccgccatccccaaccccttgcctcggcccccaggtcacccccgcccccacccctcgcagcatcagctcctactgcaaaagcaagggctggcagcgcatccatgacagccgccgggacgactacacgctgaagtggtgtgaggtcaagagccgagacagctacggcagcttccgggaaggtagcgggagccggcaccagaggcgggcagcctgcaggggcctcctgggccggagcacagggcaggttggaggggtggggaccgaggtcctgcgctccctccacacgagccctggcctctgacctccaggagagcagctgctgtaccagcttcccaacaacaagctcctcaccaccaagatcgggctgctcagcacccttcggggacgggcacgggccatgagcaaggccagcaaggtgccggggggggtccaggccaggtgagtctgcccctgcccctgcccccgtccctgcgcccgcccctacgcctgcccctgcccctgcccctgcacccgccccacccctgcccctgcgcccgcccctgcccttgcccctgcccctggccacccaggctcccaggctggctccagcccctgcccctgcccttgcccctgcccctggccacctgggctcccaggctggccccagcccccacccgtcagcacctgcctccaccttccacctgtcctttaaagggccaaacccctgtcccataaacccaccctcttcctcgtggctgaacggggaagatcccacacgtccccaacccactgggcctgacacccacccacctgtccatctcacagacccacccaggtacaacccacctgtcaatctgccttcaccccaaacatccatccaatccatccacaatcccacaccgtgcccaccgtcacctgtgggtgccctgagtgaggccgtccatcgctcacccaagtctgggccatccatcctagcgacttcgtcctcctgctcccagccctgcccactgcccttctatggacccacctatccctcctcacttcatttggcccagacatttttgcaccaagcacccgcccagccaaccgcagctgcctccatctgcaccccccgcccctggttgcctgtgacaccagctttacaccatgtccagcgtccacttccagcctagagcaacacagctgtttcccccaggcaccgccgtccacccagccacctccttccaccacaactcacagtccgcccactcaccacccatgccccatcccccagtccccacccgctccaagcaccatgagctggcccctcagtccaggccctctgtcccctgggctgcaggctggaaaaggacgcagcagcgcccgccctggaggacctcccgtggacaagcccaggatacctcaggccacagaggtagactcagcccagctgtgaggggcccttcagaccgaagttcagacctaaacctggtgtcgtctgaaaaggagaaagcggggcgggggtcccacacaaaggaaaaccacgagctagagtcagaggttcagccaggccaggccgagatccacgctgaccccccagtgcacacagagctggggcagggccaggggctcaggccacgctctccgcccatcccagccgtgaggacactgccatgaggtggtggctcacaaatggctgagacggtgccagccgggagagcaaccatgagggaaaaagcagccagcgggaggggcccgggtgggggtcagcggccagaaggatgcagccagcagcacagcccgttgggggggtgctgcaaaggggcaggaaacgcaaagtccccacaaggagaacggccgcgggcgccaggtgccactgcccacactccctcccgccgggccacaggctgggcctcaaaccgcccacccagccaggggcgaagggacagcagctcatcctcctgcctccctgccctgcagggtcctgagaatggaagagtttttcccagagacctaccgcctggacctcaaacacgagagagaggcctttttcaccttgtttgatggtgagacgctgctggccggacaccaggctggccctggggagacagggtgagggctggaccaaggcgggggctgatgagggcagggctgggtctggaggggctgcgtggggctgggacgagacgaggtggtcaggaaggggccagggctgggcctggtctgggtggggactgaggagttggaaaggggagggtctggccttcgtggaggttggggtatgagggcactggggccagggctggagcttggtccgggtgagcgtggtcgaggcacgggcaggagctggggccaggcgtgtggttagcgcagggccaaggttggaatggccgggccgagggtcgcagcctggaggggagggtcctggtcgggccctaggaggggcgtggctgggttgggggcgaggccaggggctcaggccgcgctctctgcagaaacccagatatggatctgcaagcccacagcctccaaccagggcaaaggcatcttcctgctccggaaccaggaggaagttgccgccctgcaggccaagacccggagcatggaggacgaccccatccaccacaagacgccgttccgggggcctcaggcgcgggtggtgcagaggtgcggcggcgggtgcccggaggggtgagggtctgggctggctgacccgggccccactggtgcagtcagcagggccgccgaggagcccttggtcgtggaaagcagccgcaccaccagcccctgtgcagaccacagccgggcccccgtgtagccagcagaggggaggggtcacaccaggccggggtcacagacacaggatccagggttgaggggttagtcagtttgtccttcagctggggccccctctgtcctgcaggtggcctggcctgggtggcctcccggctgccagcccccctactccccggcccagccagccagctgcagccttcaggcctatggccaagctgaccactccttccctgagtgggaaggcttcctccagaaagccccgtggctgcacgaggctgaaggtttagacctgtcgacctcacccccggccctcgtagagcctcactctgaccacagctgccgtctgccgtccccagcttccatcggctcctccctcgcgtccctccacctggcgagctctccgcctggcgcaccccctctgcctgctgtgctccctctgcctagcgcccgcctggcgcgctccttcccttcctctccaaagccaccttcatgccctcctcctccaggcagccctccaggctcctactgcggttatgccctggagcacccatcagggtgccaggcctttcctcccaattcccctgacatattcaggcccagaaatgccccctttccctggaggtcacacctgggacagaggcggggcgctgaggaaatggaacaggcccggggtggggtgtgaggggatgcaggccaggctggccccgtggctcagcccagcagccccgacatggtgcccccaggtacatccagaacccgctgctggtggacgggagaaagtttgacgtgcgctcctacctgctcattgcctgcaccacaccctacatgatcttctttggccacggctatgctcgcctcacccttagcctttacgacccccattccagcgacctcggcggccacttgaccaaccaggtgagtctgccatgggtgagggccctccctgcagccttgggatgagattagaaggaggttctcactgctagggggtgcagagggggtgcagctacagaaggaggtggcccaggccgggaggtgtctcaggcctggaagtagcctgggctgcccccgctggcagtgagcactgcctctcacctcccgcttttggccacgtcagaagaagggcgtggcagggaccccgttagctggtgaaagggctcagagccctgtagccctcagcgtgcagcctggctcccaagccgcagctgagttttctgaggatggggtgcgggtgggcgtcggaaccgaggggattctgaggctgtcagaggaggggccctgtgggcagagatttctggggacgggtcttcatgggagagtccagggtagggaccttctgagaagatctgtggggtcctcacggctgaaggggggtctcagcggatgaaggtttttgtgggagggtctttgcaggcaggtcagggtggggccgggggagcaaggttaggggcggctgtctcagggacccccagagaacaggccttctaggttagggggatgttctcttggggacccccgtgaggacaggccctccggacagtctgggagccagtctccaggcaccgtgtgcccccagttcatgcagaagccttctaggttagggggatgttctcttggggacccccgtgaggacaggccctccggacagtctgggagccagtctccaggcaccgtgtgcccccagttcatgcagaagccttctaggttagggggatgttctcttggggacccccgtgaggacaggccctccggacagtctgggagccagtctccaggcaccgtgtgcccccagttcatgcagaagaagagccctctgtacatgctgctgaaggagcacacggtgtggagcatggaacacctcaaccgctacatcagtgacacgttctggaaggcccggggcctcgccaaggactgggtcttcaccaccctcaaggtgcgtccactgtgccctccagtctgggagtgagatccctcggggcgggggtgtgtggtcaggctgggcaccaggcacacagatgtccgtggcgtgcgtgggcggctgcgctgaagtgtgacctgaccgtgtggaaccaaacccttccagcgtctctgctcacttagctggcagtgcctgtccccagcagccagcaaaggcccggacggaaagcccagtcgggggtctgtcggcacgagtcccgcgggcagcctcgccgtagggtcaggggacagctcggcttcagtgacagccaccatgtgaagagtctttgttcctttcagatcctccacttggcaggcagggccaacagcagcccccgggccaggtgtcctggagcagcagcagctgcccgtgcaggcccggactctccctagctaagggccatgtgcggtggagtgtcctaattttgcagggttcctttctgtgggggtacctgtggggtacttcaaacagccctagcagcaaaggcccttgagcagcgcggtgtgaaactgggataaaaacggggcttggccgaaggacttttatctgtcttggtcaccccggccaggccccggaagcagcagccagggatggtccttcctcacccacaggcgtgtgtcactgtggctgggacggcagcgctcagaggagcctccagttactttcctcacatctcccaaactctctcttaattgcgataattcacagaacataaaattcacgatcttaaagtgtgcagttcagtggcttttagtatttcaaaagttgtgcaattatcaccaccaattccagaacatttcatcacctcaaaaaagaaacactactaacgagccatcacagctacattgccggccattcctggtcaccgctgatggaccttctctctctctcctgtctcctttctcttaccgtggtgttttcagggttcatccacgtagttcacgtatccttttcttttcttttttttttttttgagacagagtctcactctgttgcccaggctggagtacagtggcacaatctcagctcactgcaacctccacctcctgggttcaagcaattctcctgcctcagcctcccaagtagctgcaactacaagtgcccgccaccacgcgcggctaatttttgtatttttagtagagatggggttttgccgtgttggccaggctggtctcaaactcctgacctcaggtgacccgcccgcctcagcctcccaaagtgctgggattacaggcgtgagccactgcacccagccatgtatccctttcatacaacgttccgtcatatggatggaccatattttgccatcagctggtggacacagttttattattgagctgttatgaataatgttgctataaatattcacacaaaaatgtttgtatgaatatatattttcagtgctcctgggaaaatacccaggaatggagtcgtgggtcacagggtgacacacttaactttctgaggaaccaggaatcacttttccagtttctccagatctcgccaacacttgttattttcctttctttattaaagaatcaccatctggtcggtgtgcagggatatctcattgtgggtttgatttccattttgctaatgacaaataacttcatgtgttcactggccagctatgtatattctttagagaaatgtctattcaaacgctgtggctgttctttaccatccagttgtgaaagttttttttgtttgttttttgtttttttttttttgagacagaggctcgctctgtcgtccaggctggagtgcagtgatgtgattctcggctcactgcaagctccgcctcccgggttcacgccattctcctgcctcagcctcccgagtagctgggactacaggcgcccgccaccacgcccggctaattctttgtatttttagtagagacagggtttcaccgtgttagccaggatggtctcgatctcctgacctcgtgatctgcccgcctcggcctcccaaagtgctgggattataggtgtgagccaccgcgcccggccaaaagttctttacatattctaaacactaggcctttatcagacatatgatttgccaatatttttctggaatattgtggctgtcttttcactttcttgataatgtcctttgaccacaaaagcttttagttttgatgaaatccagtttatccatttttttcctttggttactcatgcttttagtatcatatctaaaaatccattgtgccaggtgcggtgactcacgcctgtaatcccagcactttgggaggccatggttgttagatcacctgaggtcaggagttcaagaccagcctgaccaatatggtgaaaccccatctctactaaaaatatgaaaattagccaggcgtggtggtgggtgcttgtagtcccagctacttgggaggctgagaaagaagaattgcttgaacccgggaggtggaggtagctgtgagccaagatcgtgccactgcactctagcctgggcaacagagcaagactccatctcaaaaaacaaaaaaataaaaatccattgcactttgggaggctgaggaaggtggatcacctgaggtcaggagtttgagaccagcctggccaatgtggagaaaccccatctctactaaaaatacaaaaattagctgggtgtggtggcgtgcacctgtagtcccagctactcaagatgctgaggcaagcgaatcacttgaacccgggaggcagaggttgcagtgagtggagatcgcactgctgcactccaacctgggtgatggagcaagactccatctcaaaaaaaaaaaaaaattgccaaatccagcagagtgaaaattacacttatgtttctttctaaaatggtatagttttagctcttatatttaggtcttggatccattttcagttaatttttgtgtatggtgtgagttagggatccaacagcattctcttgcatgtggctatccagttatcccagcaccatttgttgaagagactattctttcccccatggaatggtcctggcatagtatcaaaaaccaattgaccagagctgcaagtgtttatttttggactctcagttccattccattagtgtatatgtctgtctttatgccagtaccacatggttttgattgctgtagctttgtagtaagtcctgaaattgggatatgtgagtctttcaatattgttctttttcaagattattttggctattcaggggccccttacaattccacaattccatatgaattttaagattggcttttccatttctggggaaaaagtccaatgaaattttttttttttttttttgagacagagtctcattctgttgcccaggctggagtgcagtggggcaatctcagctcactgcagcctcgcctcccaggttcaagcgattctcctgcctcagcctccctagtagctgggattacaggcacccaccaccacgctcggctaatttttgtatttttagcagagaccaggtttcactgtgttggccaggctgatctcgaactcctgacctcaggcgatctgcccacctcagcatctcaaagtgctgggattacaggtgtgagccaccacacccagcctcatcgaaattttaataggcattgcattgaatctgtaagtcacgtagcagtggcatcttaacaatatttagtcttccgatccatgaatataggatgtctttccatttttctaggtcttcttccatttctttcagcaatgttttctagttttcagcatacaagtctgtcacctacggtaaatattattctaggtattttattattttgacacttgtgaatagaattattttttaaatttcctttttggattgtccattgctagtgtataaaaataaaactgatttttgtgtgttgatcttgtatccttcaactttcctgaattcacttattagctccgtgtgtgtgtgcactcttcaagatttttatataaggatcatgtcatctggaatagaaacagctttacctcttcctttcaaatttatatgcattttatttcttttcttacatattgccggctacttccagaacaatgttgaatagaagtagcaaaagcagtcatccttgtttgttcctgatctgaggaggaaggccgtgggtttctcataaatgccctcgtcaggttgaggaagttcccttctgttcctaattggttaagtgttttttgttaatatcctagaaggatgttgaaatctgtcaaatgctttttctgtctccactgagatgagtgtgtcttatttccccttcattctattaatgtgttgtatcgcactgattaactttcatatgacaaaccccgcttgatgatggtatagaaccatttaaatttaaatatgctgttggatttggtttgctaatattttaatgaggatttttgtgtctgtgcttataagcaatactggtctgtagtgttcttttctcgaatgtctttgcctgggtggtattaaggtaaccctggcctcatagcatgttaggatgcattctttcctcttttatttttggagtctttgtgaaggattgctgttaattctttgtttgaaataattcaccagtaaagccacctgggttttcctctgtgggaaagtttattattattattactaatactgctgcaatctttacttgttataggtccatccagattttctaatctttagtctgctttattttgctaagaatttgtccatttcaccaggcacggtggctcatgcctataatcccagcactttgggaggccgaggaaggtggatcatgaggtcaggagatcgagaccatcccgggtaacacggtgaaaccccgtctctactaaaaatacaaaaaattagctgggcgtggtggcgggcacctgtagtcccagctactcgggaggctgaggcaggagaatcgcgtgaacccgggaggcggagcttgcagtgagccgagatcgcaccactgcactccagcctgggggacagagcgagaccccgtctcaaaaaaaaaaaaaaaagaatttgtccatttcttctaggttatctaatttgtttagtgtacaaagtattcccttgtcatccttttaatcaatataaagtctttctcccctgattttagtaatttgattcttctctcctttttttttttttctttttggtcagtttctctaagtccttatcaattttgttgatcttttcaatgaaccaactcctggtttcactgattttctctactgttttctattccatttatttccactctatctttattatttccttcttactacttgccttgggtttagtttgctcttcttttactaattttttttttttttgagatggagtcttgctctgtcgcccaagctggagtgcagtggcacgatttcagctcactgcaacctctgcctcccgggttcaaatgattctcctgcctcagcttcccgagtagctgggactaagggcacgtgccaccactcccagctaatttttttgtatttctaatggagatggggtttcaccatgctggcaaggctggtctcaaactctctttttctaatttcttaaggtcaaaagttaggttatgatttcagttttttcttcttgcttaaggtaggtgcttagtgctatacattttcctctgaccaccacttttgctgcatccataagattttgcgtgttgtcttcattttcatttgtctcaaagtatttttatttttattttttattttatttgagatggagtttcgctcttgtcacctaggctggagtgtaatggcgcaatctcagctcactgcagcctctgcctcccgggttcaagcgattctcctgcctcagcctcccgagtagctgggattacaggcacctgccaccacgcctggctaattttgtttgtattattagtagagatgggggtttcaccatgttggccaggctggtcttgaactcctgacctcaggtgatccgcctgccaaagtgctgggattataggcgtgagccatgatgctcagctgcaaagtattttaaatttcctttgtaagcttttctttgacccattggttgcttaagggcctgttatttaatttccacatatttgtgatttttccaattttccttctgttattgacttctaatttcattccattgtgtcagagaacatactttataatttcaaccctttaaaaattattgaaaaattattggagctggtgtgttggcacatacctgtaattccagctactcaggaggctgagatggaaacattgcttaagcccaggagtttgagtccagcctgggcaacacagcaaaaccccatctttaaaaaaacaacaaacttactattcattaagtggatcattaaaaaacaaaaacaaaaaacacttgaaacttgtttatgtcccagcatatggtctatcctggagaatatccatgtgcactggagaaggaggtgtatcctgtttttgggtgtagtgttctgtagatgtctgtgccgagaccagctcggtcggggagaccctaacccggcggcgctagaggaattaaagacacacacagagaaatacagaggtgtgaagtgggaaatcaggggcctcacaaccttcagagctgacagccctgaacagagatttacccacatatttagtaacagcaaaccagtcatagcattgtttctatagatattcagttaactaaaagtatcccttacgggaaacgaagggatgggccaaattaaaggaataggttgggctagttaactgcatcaggaacacgcccttaagacacagatcgctcctgctattgtttgtggcttaagaacgcctttcagcggttttccgccctgggcgggccaggtgttccttgccctcattcccgtcaacccacaacctcccagcgtgggcgttagggccattgtgaacatgtcacagtgctgcagagatttgtttatggccagtcttggggccagtttatggccagattttgggggggggcctgctcccaacatgtctgttaggtctgtttggtttataatgttgttcgagtcttctatttactcgttaatcttctgtctctgtattgaaagcgggatattcagttgtctacttctcccttcagatctgtcagttttttgtatatttcgaggctctgttgttgggtgtgtgtatgtttatgattattagatcttcttggtttatcgttataaaaattttcctttaatctgcagtaataatttttgtgtaaagtctattttctgtgatatgagtgtagacactccagttggtataagtgtagacactccagttgatatgaatgtagacactccagttggtatgagtgtagacactccagttggtatgagtgtagacactccagttcgtatcagtgtagacactccagttgatatcagtgtagacactccagttggtatgagtgtagacactccagttggtatgagtgtagacaatccagttgatatcagtgtagacactccaattgatatcagtgtagacactccagttggtatgagtgtagacactccagttggtatgagtgtagacactccagttcgtatcagtgtaaacactccagttggtatgagtgtagacactccagttgatatcagtgtagacactccagttggtatgagtgtagacactccagttgttcatatcagtgtagacactccagttggtatgagtgtagacactccagttggtatgagtgtagacactccagttggtatgagtgtagacactccagttctactttggttaccgtgtgtggtacatctttttccatccctttactttccacctatttttgtctctgaaactaaagtatcttttgtagatggtatatcatgtttttttaagaaactccgtcaatgtctattaattggaaagtttaattcacttacatttaatataattactgataaagggccgggcacggtggctcacgcctgtaatgccagccctttgggaggccaaggcaggtggatcacaaggtcagggattgagaccatcctggctaacacggtgaaaccccgtctctactaaaaatacaaaacattagccaggcgtggtggtgagcaactgtagtcccagctgctcgggaggctgaggcaggagaatggcgtgaacccaggaggcggagcttgcagtgagccaagattgcgccattgcactccagcctgggtgacagagcgagactccgtctcaaaaaataataataataataattactgataaggtaggatttacatatgctattttgttatttgttttctatgtctgtctttttttgttcctcagtttctccattactgcctcctattgttttagagagatattttctagtgtagctttttttttttgaaacggagtttcgctcttgttgcccaggctggagtgcagtggcgtgatctcggctcactgcagcccccgcctcccggattcaagcgattctcctgcctcagcctccctagtagctgggattacaggcgcatgccaccacacccggctaattttttgtatttttagtagagacggggtttcactatgttggccaggctgatctcaaactgctgacctcaggtgatctacccgcctcagcttcccagggtgctgggattacaggcgtgagccaccacgcctggcttagtgtagcattttaattaccttgtcatttattttactatatgtttttgagttattttagtggttgtcctgaggattaccattaatattgtatcttaatttactacaattagggtgagtgtggtggcttatgcctgtaatcccagtgctttgggaggctgaggcaagaagatcatatgaggccaggcatttgaaagcagcctgggcaacatagtgagaccccatctctaaaaaacaaaattagctcagcatgggagtgtgcacctgtagtcctcctagctatttagggggctgagatgggaggatcacttgagcccaggaggtcaaggctgcagtgagccacaatcaaaccacattaccccagcctaggtgacagaacaagaccctgtttctaaaataaaaaatgttttaaaataaacaattcagttttttattaataccaagttaatttcaaaagcatacaaaaacacactgctcctaaaagtatacaaaaacactcctcctacacagccccacccctctcatgctgttgtcacaaattacagctcagtatatttgtgtccatcaacatggattcataattattgttgtatacagttgtcttttaggacaaaacaatcacatacaaaaaaatacatgtatgctgtctcttatatttaattacacaatgaccttttctggggctctttatttcctcctgtgagttccagttactgtctagtgtcttttcatttcagcctgaaggacggtagggcgggtctacctttgtttatctgggaatgtcttaatctccccttcatttttgaagcagcttttgctagatgtagaatttttggtcaacagtatttttacttttgggaatttgtgccatcccactgcctgcccacctcacgacctctaatgagaaactggctgttcatctttctgtggatgcctcatacataacgagcggcttctctcctgctgatttcgacgttctctgtcttttggaagtttgctgatgaggtggtggatctctgagtttatcctactttgagttcattgagcttcttgaatgtgtaggttgtttttcattaaactgggaagttttctgccattattttttcaaatattgtttctgctcctttctcttctctccttctgggactcccattatgcatatgttggtccatttgacagtgtcccacccacaagtctctgaggctttatttttcttccctctctctctctctttcattttttgttttgagacagggtttctgtcacccaagatggagtgcagtggtgcaatctcagctcactgcagcctcctccttctgggctcaagcaatcctccggcctaccagcctcccaagtagctgggactacaggcacgcaccatcacatctggctaatttttgtatatttagtagagacgaggtttcacaatgttggccaggctggtctcaaactcctgacctcaagcgatccccctgccttggcctcccaaagtgctgggattacaggtgtgaagccactgcacccggcctcctttttctttctgttcctcagactaaataatctcaattggcctatctgcaaacaattcaaatctgctgttgagcacttctagtgcatgttttatttgttctacttttgttctacttttcaacttcagaatttctatttgattctcttttataatttttctctcttcaccagtattctctattatttgataagacatcatcgtcatacttttttttttttttttttagttttagtagaggcagggtttcaccatgttggcaaggcttgtctcgaactcctgacctcaggtgatccacccacctcagcttcccaaagtgctgggattacagacgtgagccactgtgcccggcccatacttcttttttttagacagtctcactgtgtcacccaggctagagtgcagtggcacaatctcagcttaccacagcctctgcctcttgggctcaagcagtcctcccacctcagcctcccaagtaggtgggactacaggcatacaccaccacgcttagctaattttgctaattttttggtagagacaaggtctccctatattgcccaggctgatctcagactcctgagctcaagcgatcctcctgcctcagcctcccaaagtgctgggactacaggtgtgagccacgcgcccgaccaacttgtgtatttctagtagagatggggtctcaccatgttggccaggctggtctcaaactcctgagctcaagcaatcctcctgcctcagcctcccaaactgctgggactacaggtgtgagccacgtgcctggccctcacactttctgttagtcctttcaaatgggatcttccaaggaactactagacataagaaaacaaataatgacaatttttttttataaatgaggtctattttgctatctccagttctggggatgcatgctgttggttttttgaggcaaccattgagctggggagcagaggatgaaaccagagcacgttaaaatacaacataattcacagttcttaccaagattcgagattttacgtatcccatttgctatccgtctcttctgctcaagggcagagatttcctgtgagttttcctcactctcgtatctccagtgcctgacacaggacaggagctgcacgagtttgttgagtgagtttctggctgtgaacctgtgaggctgagtgcacgaacgtgtgggcaggtgtggctgtacaggtgcgggttcagatgggagtgcaggtgagggatgtggctgtggctgttcagacctggggtgtgatcagggcctacgggccgcagccaggatgcctccctgcctccctgcagaagcggatgcagcagatcatggcccactgctttctggccgccaagcccaagctggactgcaagctgggttactttgacctcattggctgtgacttcctgattgatgacaacttcaaggtgctgtcctgggcggcggggggcacagtagacagatgcaaggaggcaggggccatctgtacaccctgaccacactggcaggccccaggcagaatctgcagtcagcccccaccctgcctgcatgcagccctggggatgggtgtatccatgaggctcaccccctgtgcagctaggatggaactgcaccccctcctcagagcagccccctcaggccagagcttcagaccctcagagcttcagtggacaaacaggggagcaaggctataggaaggaagcaatctcccagagccatctgtctgaatgaggaccagggcctctgcctcctgctggcccagtgggctcggggtgaggagggactgactggcgtctggggcaggtatggctgctggagatgaattctaacccagccctgcacaccaactgcgaggtcctgaaggaggtcatcccaggtgtggtcatcgagaccctgggtgagcctccaagcccccaccccacacccccacaacctgcccagtcttgaatgcctacctgccctcttcccaagttcagacccccacagatggggctcttccacctcccgagggcctgtgtggcagcgccgccccctgccccaaccttccccacacctcagctcacctgggtcccacccctcacaccctccccaccccctccagccccagcctctgccccccactcaccctctctcccccacccgcaccagacctggtgctcgagaccttccggaagagcctgcgcggccagaagatgttgcctctgctgtcccagcgccgcttcgtgctcctgcacaacggtgaggccgacccgcggccgcacctggggggctcgtgcagcctccgccgctggccgcccctgcccacccgccaggccaagtcctccgggccacccatgccgcatgccccagaccagccgggcgcccgcaggcctgcgccacctcccttggtgccgcagcgtccccggccacccggccccgacctggacagcgcccacgatggggagccccaggccccgggcacggagcagtcgggcacaggcaacaggcacccggcgcaagagccttccccggggacagccaaggaggaacgcgaggagcctgagaacgcgaggccctaggggcagccacccgcgcccagcgccccgcgccccgcgccccagccgtgctgcctgccctcagggacctataaagcccactttgctac

SEQ ID NO: 177 - DNA, 6167 bp, Homo sapiens
acagcccggcccctgccctgcaccaggccactgccctgttggtgaggagggtcggaggggcgacctccctgccccctgctccaagctccccacccccacctggaacctgccggcaggaagcctggccctggagggtggtcacggcccctccccagatgtaagcagtccccaggccgcctggtggggccagagctcgggctgaacttgagccccagacgggccagggggattgtccagggtattggagaaatgggctgggagcaaactggctgagccatgtccgggctgagtgggcagctcccgtagccaccccggtgggaccccaccccgttcacaggcccggcccacgagaggccaatggggagcagccaggaggagggactccggtgtcagccaagccagccagaccacgacgcagatggacactgtgggccggacctggagggggcagaaagagcctctgccacacccggaccccctgggctcctgaacagccaccggcctgcagactcggatgacactaacgccgccgggccctcagctgccctcctggaggggctcctgctggggggtgggaagccatcgccccacagcacccggccggggcccttcttctacattggaggcagcaacggggccacaatgtgagtagcggccctgggcgcccgtggtcccactgaatacccaccgcctgctcccggggcccagcccggcctccgctggccgcccgccatccccaaccccttgcctcggcccccaggtcacccccgcccccacccctcgcagcatcagctcctactgcaaaagcaagggctggcagcgcatccatgacagccgccgggacgactacacgctgaagtggtgtgaggtcaagagccgagacagctacggcagcttccgggaaggtagcgggagccggcaccagaggcgggcagcctgcaggggcctcctgggccggagcacagggcaggttggaggggtggggaccgaggtcctgcgctccctccacacgagccctggcctctgacctccaggagagcagctgctgtaccagcttcccaacaacaagctcctcaccaccaagatcgggctgctcagcacccttcggggacgggcacgggccatgagcaaggccagcaaggtgccggggggggtccaggccaggtgagtctgcccctgcccctgcccccgtccctgcgcccgcccctacgcctgcccctgcccctgcccctgcacccgccccacccctgcccctgcgcccgcccctgcccttgcccctgcccctggccacccaggctcccaggctggctccagcccctgcccctgcccttgcccctgcccctggccacctgggctcccaggctggccccagcccccacccgtcagcacctgcctccaccttccacctgtcctttaaagggccaaacccctgtcccataaacccaccctcttcctcgtggctgaacggggaagatcccacacgtccccaacccactgggcctgacacccacccacctgtccatctcacagacccacccaggtacaacccacctgtcaatctgccttcaccccaaacatccatccaatccatccacaatcccacaccgtgcccaccgtcacctgtgggtgccctgagtgaggccgtccatcgctcacccaagtctgggccatccatcctagcgacttcgtcctcctgctcccagccctgcccactgcccttctatggacccacctatccctcctcacttcatttggcccagacatttttgcaccaagcacccgcccagccaaccgcagctgcctccatctgcaccccccgcccctggttgcctgtgacaccagctttacaccatgtccagcgtccacttccagcctagagcaacacagctgtttcccccaggcaccgccgtccacccagccacctccttccaccacaactcacagtccgcccactcaccacccatgccccatcccccagtccccacccgctccaagcaccatgagctggcccctcagtccaggccctctgtcccctgggctgcaggctggaaaaggacgcagcagcgcccgccctggaggacctcccgtggacaagcccaggatacctcaggccacagaggtagactcagcccagctgtgaggggcccttcagaccgaagttcagacctaaacctggtgtcgtctgaaaaggagaaagcggggcgggggtcccacacaaaggaaaaccacgagctagagtcagaggttcagccaggccaggccgagatccacgctgaccccccagtgcacacagagctggggcagggccaggggctcaggccacgctctccgcccatcccagccgtgaggacactgccatgaggtggtggctcacaaatggctgagacggtgccagccgggagagcaaccatgagggaaaaagcagccagcgggaggggcccgggtgggggtcagcggccagaaggatgcagccagcagcacagcccgttgggggggtgctgcaaaggggcaggaaacgcaaagtccccacaaggagaacggccgcgggcgccaggtgccactgcccacactccctcccgccgggccacaggctgggcctcaaaccgcccacccagccaggggcgaagggacagcagctcatcctcctgcctccctgccctgcagggtcctgagaatggaagagtttttcccagagacctaccgcctggacctcaaacacgagagagaggcctttttcaccttgtttgatggtgagacgctgctggccggacaccaggctggccctggggagacagggtgagggctggaccaaggcgggggctgatgagggcagggctgggtctggaggggctgcgtggggctgggacgagacgaggtggtcaggaaggggccagggctgggcctggtctgggtggggactgaggagttggaaaggggagggtctggccttcgtggaggttggggtatgagggcactggggccagggctggagcttggtccgggtgagcgtggtcgaggcacgggcaggagctggggccaggcgtgtggttagcgcagggccaaggttggaatggccgggccgagggtcgcagcctggaggggagggtcctggtcgggccctaggaggggcgtggctgggttgggggcgaggccaggggctcaggccgcgctctctgcagaaacccagatatggatctgcaagcccacagcctccaaccagggcaaaggcatcttcctgctccggaaccaggaggaagttgccgccctgcaggccaagacccggagcatggaggacgaccccatccaccacaagacgccgttccgggggcctcaggcgcgggtggtgcagaggtgcggcggcgggtgcccggaggggtgagggtctgggctggctgacccgggccccactggtgcagtcagcagggccgccgaggagcccttggtcgtggaaagcagccgcaccaccagcccctgtgcagaccacagccgggcccccgtgtagccagcagaggggaggggtcacaccaggccggggtcacagacacaggatccagggttgaggggttagtcagtttgtccttcagctggggccccctctgtcctgcaggtggcctggcctgggtggcctcccggctgccagcccccctactccccggcccagccagccagctgcagccttcaggcctatggccaagctgaccactccttccctgagtgggaaggcttcctccagaaagccccgtggctgcacgaggctgaaggtttagacctgtcgacctcacccccggccctcgtagagcctcactctgaccacagctgccgtctgccgtccccagcttccatcggctcctccctcgcgtccctccacctggcgagctctccgcctggcgcaccccctctgcctgctgtgctccctctgcctagcgcccgcctggcgcgctccttcccttcctctccaaagccaccttcatgccctcctcctccaggcagccctccaggctcctactgcggttatgccctggagcacccatcagggtgccaggcctttcctcccaattcccctgacatattcaggcccagaaatgccccctttccctggaggtcacacctgggacagaggcggggcgctgaggaaatggaacaggcccggggtggggtgtgaggggatgcaggccaggctggccccgtggctcagcccagcagccccgacatggtgcccccaggtacatccagaacccgctgctggtggacgggagaaagtttgacgtgcgctcctacctgctcattgcctgcaccacaccctacatgatcttctttggccacggctatgctcgcctcacccttagcctttacgacccccattccagcgacctcggcggccacttgaccaaccaggtgagtctgccatgggtgagggccctccctgcagccttgggatgagattagaaggaggttctcactgctagggggtgcagagggggtgcagctacagaaggaggtggcccaggccgggaggtgtctcaggcctggaagtagcctgggctgcccccgctggcagtgagcactgcctctcacctcccgcttttggccacgtcagaagaagggcgtggcagggaccccgttagctggtgaaagggctcagagccctgtagccctcagcgtgcagcctggctcccaagccgcagctgagttttctgaggatggggtgcgggtgggcgtcggaaccgaggggattctgaggctgtcagaggaggggccctgtgggcagagatttctggggacgggtcttcatgggagagtccagggtagggaccttctgagaagatctgtggggtcctcacggctgaaggggggtctcagcggatgaaggtttttgtgggagggtctttgcaggcaggtcagggtggggccgggggagcaaggttaggggcggctgtctcagggacccccagagaacaggccttctaggttagggggatgttctcttggggacccccgtgaggacaggccctccggacagtctgggagccagtctccaggcaccgtgtgcccccagttcatgcagaagccttctaggttagggggatgttctcttggggacccccgtgaggacaggccctccggacagtctgggagccagtctccaggcaccgtgtgcccccagttcatgcagaagccttctaggttagggggatgttctcttggggacccccgtgaggacaggccctccggacagtctgggagccagtctccaggcaccgtgtgcccccagttcatgcagaagaagagccctctgtacatgctgctgaaggagcacacggtgtggagcatggaacacctcaaccgctacatcagtgacacgttctggaaggcccggggcctcgccaaggactgggtcttcaccaccctcaaggtgcgtccactgtgccctccagtctgggagtgagatccctcggggcgggggtgtgtggtcaggctgggcaccaggcacacagatgtccgtggcgtgcgtgggcggctgcgctgaagtgtgacctgaccgtgtggaaccaaacccttccagcgtctctgctcacttagctggcagtgcctgtccccagcagccagcaaaggcccggacggaaagcccagtcgggggtctgtcggcacgagtcccgcgggcagcctcgccgtagggtcaggggacagctcggcttcagtgacagccaccatgtgaagagtctttgttcctttcagatcctccacttggcaggcagggccaacagcagcccccgggccaggtgtcctggagcagcagcagctgcccgtgcaggcccggactctccctagctaagggccatgtgcggtggagtgtcctaattttgcagggttcctttctgtgggggtacctgtggggtacttcaaacagccctagcagcaaaggcccttgagcagcgcggtgtgaaactgggataaaaacggggcttggccgaaggacttttatctgtcttggtcaccccggccaggccccggaagcagcagccagggatggtccttcctcacccacaggcgtgtgtcactgtggctgggacggcagcgctcagaggagcctccagttactttcctcacatctcccaaactctctcttaattgcgataattcacagaacataaaattcacgatcttaa

SEQ ID NO: 178 - DNA, 3202 bp, Homo sapiens
tcactggacaagtgtttattgaaggtcccctgcagccgggtcccgtgctgggcactgcacacccacggacacagcctcccgtcctaagaccccaccccatcagggccagcaagggaggaagggggccatgactgtgtctctctctccctcctgcagggcccagccgcggccgccgaactgcatggtccagggcgctggtcactgccaccttcctgcacccacttctgctgccaggggagcagggcccggcccagagcagaacgcagagcccctgcggcctggggagctcctggggaggggctggctgcggtcggtggccccggaggacggccaggctcacacccacaggtctcccagccgccccttctcctctgccgatcgctcgccccgctcttcctcggggaactggcagcttctggcgtcttcggtcgacggcggcacctccagcagcagctgggtctctgcaggggggccacggtcagcaggcagccatgctcccacctccccgcaccaggctgtgacagacctcggggccacatgcactgactcctcagctgccagatgtgcagtccaagctgggccgaggtcaggaggaggacgcaggcggccacggccaggaggacgacggtcagccacccaagcggctctgccggcggggaccctgggacgcacacagcgttgtgggtcttgttcccagggaacacagtgagaaacccgaactgggtgcagctggaatacatggacgcggcctcctatcagcccccggacacggcctccgatcagcccccggctgctgccctccgtgctgtctggggcaagggacaggagaggacccttcctcagagtgggcctggaccacccggccaccggcagggcccacccaggactcactctgtccaaggtttgcagtggccttcgtggcccccggagaaggtccccgaggcacagtcgatacactggaagccaaaactgaatttccctggtgtggggtgtggggggagggagggagggaggctggtggagttgctgggatggatgaggagggcgtcaggccagtgcaggggtccatctggggtctgggtgctgagtagaatgccccccccatcatccattcaacagagttcttcatggcccaggactggggcccatgtctgcccgtcccaggtggggcgtctggggtggggcccagtgagggcacctgggggaggtgcgcagagtgcagtgggcctgccagggaggggaaaggcctgcccattgggggctgagggtgggcagaagccaggcaggacccagtagaacagagggtggagaacagtgagggtcccagagagagtgaggctgggtcccagttgaccccagaccctgccccgtccaacctgacacaacctccccagttgtaccttctcccagctctcatgtgcccagcctgacctctcctgtcaggtaaacaagccgctaagaggacttgagctgctccttccagaacagggtgcagccccaggccccagacaggactccggggggcacagggcaggctctttcagtatgtggtgaggacagacaggatgggtgtcccgggcctgagagccagacagctcctggaacccgcccccacctccccgcagggttctcacagccctcgtgctggatggagaagcccaggctgagaaagcagggacaggacacccccagagcttcatggcctgtggtgcctgagcatggcctggcctgcccggcctcacaggactccggaccccacacaccacatgtcctcgccggacacctgtgcccacgagctctgcctcgggccctagtggaacccctggcctgtgtggactcccagaggcacctccaggacttaccctgggactgtaccccctggcctgggggacaagggtggtgccggcaggtcgtgcagcaagggtctccgcagtggaattcaggctggacacacatgcagtcccactcggaacagcactcctcgcctgggcaggagacaggccagccccccagcagctgggctgaggccccctcctccccaggcctcccctcggccctccaggggagtgaggttgtccgttctccacccacagttggctccagggagcagagggctcctggctgggagtctggaccctgggtttatccagctgtctctttctcctggggccatgtggcctggctactccccctttgcgccccacagctgcccctgcccaggtgctaactccatatgcaaccaggagctgcccctgcaggacccaggggtggcccccaacagtgcacagtcccctggaggcccgtcgacacctcagaggccgcctgcctggtgtctgggcgctgctgtccccaccaccagccacactgggcctccggacagagcctcccttcccaacccacaggccctggaggaagaagctctggggtgacttccctgccagcttcctctccagaccagccgtgtcagctgaaccctcatccccaggtgcaggtcagaggcaggcagcaggccagacggtggtgcaggggggccctcaactgggcaggagggggctgggcgatggccaagggctcacgacccgcccagcaggacctggaacagccgtcctccacctccagaccccagacccctcttgagggcgctcccacctggctcacccctgctcccggccggggccactggctggagctggcacacctccgcctccctctgggatcctgcctccctccggaaggctcccgctgctggcggctctgtgcccaccctccttagacctcagcaacgccggtctgagcacgggaaggggggcgcccacccatcccggcttccgcgggacgccttggccggtccgcgttaagtaaacgcggtttacttacccgggtaatcgcggcagcagcgcgtcgtgtgaacccggcagcagcgcgcgtccgttcccgtcccaagcaggaggcgcccagggccgcacccgggacccccggtggggcgctgacccaggctgagcgcgcacagcagcgccaggccgcacagggcccgaaacgcgcccatcgccccgtgctgtgccatgctcgggtttcaagagcccacagccagttggacacgccccgtccccgtcctcacccgccctgcccggaggtggctgggaccgttcatgacctgagaatcccgacccaggtgaagtgcgtgtgaggagggggtgtagac

SEQ ID NO: 179 - DNA, 3202 bp, Homo sapiens; identical to SEQ ID NO: 178

SEQ ID NO: 180 - DNA, 3202 bp, Homo sapiens; identical to SEQ ID NO: 178

SEQ ID NO: 181 - DNA, 77383 bp, Homo sapiens
ctcgcgcccagcgcagtcgctccgagcggccgcgagcagagccgcccagccctgccagctgcgccgggacggtaagcgatcgccgctggctgcgtcaggggaggtgggaagaggaccgcggccaggggctttgggagctgcggctgcgctcgggggcgcggggctggctggcgggcgtctctccggcacacacagcccgtgcgccctggccctgggcgcctccccgagtctagcgagccgggtcctgggagccccgggggccgggctgctgggacctgggcgggggctgccctagaggcccggggccgtcccccgtgggcccgccgagaggggcgtgcgcagctccccggcgcctgcactgcgcgccttgcccgcctggcccggcagcggggtttcagctgcgctcacagcggcggtgcggcctccggtgcgccggctgaggcgcgaggatactggaagcgctcagcgcgtgcgcccgctccgagcgctgactagaggaccaggggcctcctctgtacggcagcggggtccacagagagcgcgctggtgatgtcgcccgagtgccctggcgcggagagagggctgcgcacagttcgccggcgcccgggtcctgtgcgcccttcccagcctgggcaagtggggagcggggctgcagaggggccggggtggaagttttcggggcttcctcccggctcgtggacccgcgccccgcctcccagtcccgggcctcccgcgttgctcgccgcgtttgctgcagcggcgcaggcgagatcagctccggatctgcggccgagccggggttacgccggcaaaaccgcccccagctttgcatttccggactttttaaaaaaatactcttacccgtaattcagcctgaatgaggctttttaaaaaaatcgagtttcctgtttttatttaggcttcctcatttgcacctcctcctttgaggtagagaagaggggaactgggacgacctttcgtgggcaccaggatgggggcgttgcagggcggggagacgggggtccagagaaccggggaagggccgctgggaggtcccgaaaagtgcgctgtgggtggggcgagggtgaagcaggtaggggcgagatttccggggtcgcgggtggggggcgccctggagcggccaaggtgcagggtcctcgcgtggcacccttgggatctgcccagtttgcggatggagcgcggggctgatcgggcaggtctcacttgtgcaggtgttccctggaaggtgggacctgcagatcttgaaccccaccagactccatcaagggggcttcttcccgccgattcctgagaagtcctacctctgagatgctgggcacagccgcacgtggatgtgggcgggtgtgccgtgggttggagtgggaaggggcaattattcctctctcagggctctcggaggggaaggtttactgctccctagggactttgaaaccaagggctaaccccctgctctcttccaggagagtgggataccgcccgggtgcctgacggtgccttggtgttcttgacaattgaatggtaccatcgggacattactccccaaagaactggtcgttcttacctaggtgatttcagctggacaactgtaggagctgagtggtgttgtcttcattttacagttaaggaaacgaaggctcagaaaagttaaataactcaccaacccacacagtttacaagtagtttctccaggatcccagctctttccgacgccagcgcgtttaatcatctgggggtgccgttgcttgcgggggaaggagaatgtcctagtaattctcttgggggggatttggaggggacgactgttcagagaggcaccctctaagatacccttgagactcctctgtaacacccgctgctgctgttcacaccccctccccaatttgattgatgtgttgagtggggcggaaggttcttttggttgatgaggctgcgaccaaacgcaaggagatataaatagagctttctctttggctctctctagagcagaaatgccaaccccttagcatttccatggcctgctggagtttcatttcttgatattaggattccagccatcttggctggtgagaggcctgctggcggcttcctgggcttggtcctcttttggtgctttcacagaatgatggaagacactggagtgggctggaggagtgctcttaaaacccagttgtggctgagagcggtagctcatacctgtcatcccagtgctttgggaggcccagacgggaggatcacttgaagccaggagttcaaggttgcagtaagctattacagtgccactgcgctccagcctgggtgacagagcaagagcccatctctgagaaacataatacaacaacccagttgcctgctccagagacaactaagctagcctccttctgagccccacttcccccgcccttcagcccctgttcagaaacagactacattggccacactactcacttagatgtttctggaattagggcacgtgccccagaggtactcccgaccacgcagatgtccccttctggcaggaaaagcgcgtttctgcgtttctgcagcctcagtccacgccgccaggtctttgcactaagctgtgggctccgtttctcctccgataccatgtttagcaagtgtttcctgagatcacacggggtgccaggggctgtgctaagaacagggcaggcagactgggagggcatcagcccctggggggcttacaggacagacagtccaccaatggttgtgcgaaagccagcccgctttcgcacaactgtccgatggaattcatggaggtgggagtggggatggtgagagtcggttcctgcttcatcttgttttacttaaattgcacagtgaaagggagaagtgaatgtgcaacggatgaagcaattcccctttggctgggttattttcaaaaccatttttgtgtagagagcagttcccgccctccctgaggccagctgccggtgtgggcctgatggtggggtttggggccccagcaaatgtttccttaacgtgggaccttcagaaggctctttcaggctgggcgcggtggctcacgcctgtaattccagcactttgggaggccgaggtgggcggatcacttgaggtcaggagttcaagaccatcttggccaacatggtgaatatctgtctctacgaaaaatgcaaaaaaaaaaaattagctgggcgtggtgatgagcacctgtaatcccagctacttgggaggtggaggcaggagaatcgcttcaatccgggaggtggaggttgcagtgtgctgagattgtgccactgcactccagcctgggcaacagagtgagactacatttcaaaaaaaaaaaaaagaaaaaaaagctctttcagccaggagggtggcttcagctactccccaggggacaagtgtgtttttcagcaaagctgttagagaagatggtctagaagcagtaccccgggatggaggagacaaggaagggccctatccactggaggatggcagagcctggcttgtttgaaagggaggaaaatattgtcatcttggtaccggtgacagtgtttcataaatagcgaaggtggcaaaacgccacctctctccctacagttaacgctaagactgagttgtctttagtttggttggtggaaatccccggcaatcatagcagaaatgctgccagtttcaagatggaaaaaataaaaaacccaggaaccccccgccccccccccttttttattgcagctaaacactgtgacttgctgtgggtcctaccaaaataacggccattctcccctccctgagggccagcacagtccctagggcctgtgaaagttccccttccagctgcactggctggatatgcgtgaaactcccctccctccccagaagtcacaaccttaccacctcggataagggtcagggctcctggaaatgggtcccttttcctattactttctttcttttttcttcttttttttttttttttttgagacggagtctcgctttgtcgcccaggctggagtgcaatggtgtgatctcggcccactgcaacctctgcctccaggttcaagcgattctcccacctcagcctcctgagtagctggaattacagatgtgcgccactatggccagctatttttagtatttttagcagtgacggtgttttgccatgttggccaggctggtctcgaactcctgaccttaggtgatctgcccaccttggcctcccagagcgctaggattaaaggcgtgagccaccatgcgcggccttcctattacattctgagcacagggggagtgatcagagtgaagggtgtggcatttccaaagtggtatttcggttggcttctgtttcactcatattgggggaaattgcttccacttagagaaaatgccggaagagtgggcggtgccaggagtagggtgggggaggaggagatgcagaaagggatagacctatttgggatttttggtcctggagggatgctgtacgggttaagtatcccttatccaaaatgcttgggaccagaaatggggtggagtttggattttggaatatttgcattatatgcttaccaactgaccattccaaatccaaatatctgacatctgaaatgctccaaggagctttgtatttgatcatgatggcactcaaaaattttggattttggaacgttgtagatttcagatttgggatgctcaaccagtgttaacctcctgtggttgctgtaacaaatgacctcaaactttgtggcttaaaacagaaacgtgcatgcttatagtttcagctacttgggaggctgaggtgggaggatcacttgtgcccaggagtttgaggctgcagtgagccatgattgagcctgtgagtagccatggcactacaacttgggcaacattgcgagatcctgtcactaaaagaaaacaacagcaatgggccgggtgtgatagctcacgcctgtaatcccagcactttgggaggctgaggcgggtggatcacctgaggtcaggagttcaagaccagcctggccaacatggtgaagccccgtctctactaaaaattcaaaaattagccaggcgtggtggcacgtgcctgtagtcccagctattcgggaggctgagacaggagaattacttgaacccaggaggcagaggttgtagtgagctgagattgtgccactgcactccagcctgggtgacagagcgagactccatctcaaaaaaaaaaaaaaaaaaaaatgtattctctcacagttctggaggccagaagttaaaaattaaggcatcagcaaggcctcgctccctctgggggctgtagggggagaatcctgctttgctcttccttctgggggctccagcgtatcttggcctgtggctgcatcactccagtctctgcctccgtcttcacaagggcatctcctccgtgtgtctgggtctccgtctgtctcttttaaggacacttcttgttggatttagggctccctcagataattcagatagaaatcatttcaagatccttaacttacttacatctgcaaagacccattttccacattattatttttccagataatgtccaggtcctgggggttaagacctatctttgtgggggccaccaatcagcccgcttacagataaacaggaatgtctttctgtattttctggggacggtgggaagtgcggttatctttgcagggaagccgccctgttctgccactttcccctgggtgactttaggcaaagatgtcagagtccctggtggtctctgctggaccattgaccccagcctccttcctgctttccgttccccaacttttatgaactggcagtccccacctcacccccaacctcctggggtcccaggagcagaaaacttctggagctcaggaggagaaatgcttctcttactttccctccccaacaaactcctccctctttatcttcaacaacagtccctgccctccgcagcccattcccagcccagggctactctctctctctctgaggtcacacagcccctcacattttgaaatttcatctgttgggcagaggtggggggagggctcagatggtgacacagacactgctctgttcccacctcttaccccaggacatggtatggggctggtggcactgggaggggtttggggagccccattaatcattgaagtttgtaggaggggtggataaggacatgggagaatgattgggtgaggtgctccagggctctctggaagggctgggccccccccttgcatcagccacagtgggggcattgctcttttctatgttggtcatgaaatctggaagaagtgctttcttatcaatagagaagcataatcagccttgtttttgaaactttggaaaaccatttatggctgggcatggtggttcatgcttgtattcctaatgctttgggaagctaaggaaggaggatcacttgagcccaggagtttgagaccagcctgggcaacatagtaagacccccatctctgcaaaaaataaaaataaattagctgggccttgtgatgcacgcctgtagccccagctatgtggaagactgaggtgggaggattacttgagtccaggagtttaaggctgcagtgagctatggttgcaacactgcactctagcctgcgtgacagagcgagaccctgtctcaaaaaaaaaaaaaaaaaagtcatttatgtccaggtgagggtggggctgggtgaggtggtggttttagggggattgccacgtgggagaaaatgtactgtctttggagtcagctgaactgggttttttcccagccacatttttttttttttttttttttttggtgaggcagagtctccctgtgtcacccaggctggagtgcagtggtgggatcttggctcactgcaacctctgcctccaaggttcaggagattctcctgcctcagcctcccgagtagctgagattacaggcacatgccactatacctggctaatttttgtatttttagtagagacagggtttcgccatattggccaggctggtctcaaactcctgacctcaggtgatctacctgcctcggcctcccaaagtgctgggcctggccaccaagccactttttatctgctgggtgaccttgggcaagtcacttaacccatcagaacctcagagtccagttgtaacactgagacagcaatacctacctgttagtcttgaggattttgtatattatcctgtgtaaagtgccaggcacatagcaatccatgcagtgtctgcaaaggagctggtgtggagtggattagaaacagaagtcatgtatcatcatccctctagcccaacacagcggttgcccatttgggtatcctttccattaacttcttttggatgtgcattttaacttagttgtaattatgagaacacatggacacagggaggggaacaacacacactggggcttgtgagggtggggtagggggtgggagagcatcaggataaatagctaatgcacgcggggcttaatacctaggtgatgggttgataggtacagcaaaccaccgtagcacacgtttacctatgcaacaaacctgcacgtcctgcacatgtaccccagcacttaaaataaaaaataatttagtcgtaattagtaggcatatgctttttatcttaattttcatgttttaattgtaaaatatacataacataaaatttaccatcttaagcatttctaagagcgcagttctgtgggatttacactattgtgcaaccgtcaccaccgcccaccctcaggcatttttttcatgttgcaaaattgaaattcttttccccttaaacactaactcccctctcctcccagccctggcagccattctgctgtctctgtgcttttgacaactctaggtactgcacatgagtggaatcctacagtatttgtctttttattactggcttcattaatttagcatgtttcttgaagcttaatccgtgtgggggtatgtatcagaatttctttcattttttaaggctggacattccactgtgtgtaggtactacattcttttctttttttgagacagtgtcttgctctgtcacccaggctagagtgcagtggcatgatctcagcctcactgcaacctccacctccctgattcaagcaattctcctgtctcggcctcctgagtagctggaattacaggtacgcaccaccacacctggctaatttttgtatttttttgagacggatttttgctcttgttgcccaggctggagtgcaatggcgcgatcttggctcaccacaacctccgcctcccaggtttaagtgattctcctgcctcagcctcccaagtagctgggattacaggcatgtgccaccacgcccagctagttttgtactttcagcagacgggctttcaccatgttggtcaggctggtctcaaactcctgacctaaagcgatctgctcgctcggcctcccaaagtgctgggattataggcgtgagccaccgcgcctggccaggaccatgttctttcgttccattcacccgatggacacttctgttgctcccactctatggcttttgtgaataatgctgcgttgtgaacatgggtggacagagacctgttgaagtccctgccttcagttctctcaggtatatacccaaattgctggatcatatggtaatccaatttttaatttttttgagcagctaggcatgtgcttttgtagtttgctttttttcacttaacattggctcattaacagttttccacattgcttcataacctacgcatcctttttagtggcagtgtaagtgccattgagctgctattgggaagcaagaaaaaattacagtcattataccagtcttagcaagaattatagtcataccatcgtccttcccacccttcttgcccagatccaccgggaaaacagaggaatagcacatggggatactccttggtgcctcccaggctgagcgtgggcacacactcgggaaggcagctgagccaccccttcatgcctttgtctccccacttcagacagccagcctttcagtcgccagttctacttttttgggtttttttttccactttagcagttttaaggaacatttgtatataaaatgactttattcttgcatcttgttaattatttcttccttgtattttcccctttcatttcctacatggtgagatttggctttccattcaaggatttgttcttgctttcttttttctttcttttttttttttttgagacagagtcttgctctgtcgcccaggctggagtgcaacggtgtgatctcggctcactgcaacctccgcctcccgggttcaagcgattctcctgcctcagcctccagagtagctgggattacaggcatgcgccaccacgcccagataatttgtgtatttttagtagagatggggtttcatcgtgttggacaggctggtctcgaactcttgacctcaagtgatccacctgcctcagtctcccaaagtgctgggattacagacctgagccaccgtgcccggccacgcccagctaatttttgtatttttagtagagatggggtttcatcatgttggccaggctggtctctaattactgacctcaggtgatctactcgcctcggcctcccaaagtgctgggattacaggcctgagccactgtacccagccaaggatttttcttttcttttctttttccttatagggtctcattctgttgcccaggctagagtgcagtggtgcaatcacagctcactgcagcctcgactatatgggctcaagtgatcctcctgccttagcctctggagtagccgggactgtaggtgcatgctaccacccctggctcatttaaaacattttttttagtagaggccgggtgtggtggctcacacctgtaatcccagcacttttggaggccaaggcgggtggatcacttaggatcaggagtttgagaccagcatggccaacatggcgaaaccccgtctctacaaaaaaatacaaaaattggccgggcgcggtggctcacgcctgtaatcccagcactttgggaggccgaggcggacggatcacgaggttaagagatcgagaccatcctggctaacacggtgaaaccctgtctctattaaaaatacaaaaaattagccgagcttggtggtgggcacctgtagtcccagctacttgggaggctgaggcaggacaatggtgtggacccaggcggcggagcttgcagtgagccgagattgcaccactgcactccagcctgggtgacagagtgagactctgtctcaaaaaaaaaaaagttagccggacatggtggtgcatgcctgtagtcctagttactcaggaggctgaggcaggaaaatcacttgaacccttaaccagggaggcggaggttgcagtgagccgagatcatgccactgcactccaacctgggcgacagagcgagactcgatctcaaattttttttttttgagagacaaggtcttgctatgttgcccaggctggtctcgaactcctgagctcaagagatcctcttgtcttggccttccaaagtgctgggattacaggcgtgagctaccacgcctggcccattcacggatctttttgtggtcattgtccagtgttagcctaatgataacagcctggctgggatgaatgccagcgtggacagtcgtgccattagacttttccccctgcactcgttcagtgtagatgacgtatttcttcctttaaacctggacccgctttgctggtttgctggcctctgtggtgtcctcacacaacctgaacttaggcttctgcctcagctctttggaaagagggaaagacaatctctcttcctgcgaatatgggaaggtgcatagaaatgccttttgtggttcttgctgtggttctaagtcacgaaggtattgaacttcattttggccactccggcttcggtgatggccacaaaagtgaagagcggttccattacttttttctttcttcttttttttttgagacagcatctcgctctttttcccaggctggagtgaagtggcaagatctcggctcactgccatctctacctcccgcgtcctagcaattctcctgtctcagccatctaagcagctgggattacaggtgcatgccaccacgcctggctaatttttgtatttttagtagagacggggtttcaccatgttggccaggctgatctcgaactcctgacctcaggtgatccacctgccttggcctcccgaagtgctgggatgacaggcgtgagccactgcacctggcagcggttccatttctttatcaaactattgctctgcggaggctgtctctctgtccagcccatagctggacattatgggctgtacagcgtgttctgtggtctgaagaaatgacagccatccaaacccacacggtgtcttctgttctggtttggctctggcgctctgagcatttgcactttccactgggtaagcaaagcccactccaagtcagcgtctattcaagacccagtcgtagtccccagggctaccagcctcagtttcacttgccagccatgttcagggcctcccaccagggaagctaccccacagccctgtgcagtgtctgtctctctcactggcacacaggacagttcttcctggcattatgtgcccgagagggtgcggaggaacatgctagatccagcccatctctgcaccgctgtggggcccgtatcccctcatttcacggacccagatggccatctcaagggagcatgtgggatatctacctgttgatatctacctgttgattcctgtcaccttccaaacctagaaggctcttctggtgggcattaagaggtctgactttatttactttatttttttatttttatttttttaatatttttttattatactttaagttctagggtacatgtgcacaacgtgcaggtttgttacatatgtatacatgtgccatgttggtgtgctgcacccattaactcgttatttacattaggtatatctcctaatggtctccctcccccctccccccatcccaaaacaggccctggtgtgtgatgttccccttcctgtgtccaagtgttctcattgttcaattcccacctatgagtgagaacctgcagtgtttggttttttgtccttgcgatagtttgctgagaatgatggtttccagcttcatccatgtccctacaaagcacatgaactcatccttttttatggctgcatagtattccatggtgtatatgtgccacattttcttaatccagtctatcattgatgaagaggtccgacttcaatgcacccctcgttttctttctttctttttctttttctttctttcttttttttttttttttttgagacggagtctcactctgtcgcccaggctggagcgcagtggcatatctcagctcactgcaacctccacctcccgggttcaagtgattctcctgcctcagcctcccaagtagctgggactacaggcagacatcaccatgctcggctaatttgtgtatttttagtagagacagggtttcaccatgttgcccaggctggtctcaaactcctggcctcaggtgatccacctgccttggcctcccaaagtactgggattacaggcgtgaaccactgcacccagcctaccctcattttctatagggctgtgtcccaaagaaatatccgtttaataggtcaggtttgcattgccctcctgtctaaatgtatggccaggctgttgaccaccacccacaaggggagggtgaactggcacccaaagccctgcacagatacagggggttttaccactgttcaagtctcccatcactgctgggaaaacagcatgcaattcgacccttagagctgatttgtttttaccatctttgatcagattggcatctttgcaaacgaggcattgttcaccttggaactgctagccaccaccccagcagctctcgtttggtcagggagagttgtttgttgggcgctacagaatccagctgctcatcatagtgccagagtcagtcctaggggaaaagaggatccctgctcatgtgagtatctcctccttgccttccccaggtaatgccatcgtgtataaatgatttctgttttattagggaactcttctgggcattgtcatccctgttagagtgtttccttgacatcacctgagatgtcctgggtatttcagtcttaagattattttatgtcctagctgggtgcagtggctcacacctgtgatcctagcacactgggaggccaagatgggaagattgctagagcccaggagtttgagaccagcctaggcaacgtaagggagaccctgtcctacaaaaaataaaaacagttagctgggtgtggtggtgtgcacctgtgattccagctacttgggaggctgaggcaggaggattgcctgagccctggaggtcaaggctgcagtgagccgtgatcgcactaatgcattttagcctgggtaacagagtgacagcctgtcaaaaaaaaaaaaaaaaaaaaaacctgaaaaagtaatttcatgttcttcagtcatatccatcataggggtagctttggtgaatgtcccatggcaaggtagtaaatgcctctcaagaggaaatgctctactccaaagccccagtagttacctcatctctgggagatttgggtgccagttcaccctcccctactacaggcgcacgccgccatgcccggctaattttttgtattttggtagagatggggagcgctcacaagctcttgccgtagctctggtttacattccgcacagggctgtggaacagaattcgctcatgccagtacatgccggcactgcagcttctattctacactgtgtgggcttggtgtggacattgacatgtccaattaatactgcttgaggaggggatttacacgcttcctggtttccaatagtaggcaggggaaatattccgcagccagatattatatccattctcataaaatatttaggtaaaggagacttctttctgtttaaacatttcagctttcgtcatcctataaaccctttcattctttttttttgtcccccaagacggagtctcactctgtcacccaggctggagtgcagtggtgcgatctccactcactgcgacctccgcctcctgggttcaagctattcttctgcctcagcctcccaagtagctgggactacagctgcccaccaccatgcccagctaatttttgtttttgtttttgttttttgacgcagagttttgctcttttgcccaggctggagtgcaatggcacaatcttggctcactgcaacctccttctcctggcttcaagcgattctcctgcctcagcctccagagtagctgggattacaggcgcccgccatcataccctgctaattttttgtatttttagcagagatggggtttcaccatgttggccaggctggtctcgaactcctgacctcagttgatccacccacctcagcctcccaaagtgctaggattacaggcatgagccaccgcgcccggtctttttttttttttttttttttttttttttttgaggtggagtctcactctgtcaccgaggctggagtacagtggtgcaatctcggctcactgcaacctctgcccccccaggttcaagtgattctcctgcctcagcctcttgagtggcagggattacaggcacccaccaggctaatttttgtatttttgtagagacagggttttactatgttggccaggctggtcttgaactcctgagctcaagtgaaccacctgccctggcctcccaagtgctgggattacaggtatgagccaccatgcctggccgtattcaaagattttctgattggcaactcgttgaaagagttaagctttgtcttgaaatcagtagaaataaatgcttgaggtcaggtgtagtggctcacacctgaattcgagaccaacctgggcaacatagtgagaccctcccccatctctacaaaattcttttttaatttttatttacttatttattttttgaggcagagtctcgctctgtcgcccaagctggagtgcagtggtgcgatcttggcttactgcaacctctgcctcccgggttcaggcaattctgcctcagcctccccagtagctgggattacaggcttgcgccaccatgcctgctatttttttttttttttcagagatggagtctcgctctgttgccctggctggagtgcagtggcatgatctcggctcactgcaacctctgcctcctgggttctagtgattctcctgcctcagcctcctgtagctgggactacaggcgtacaccgccatgcctggctaattttttgtattttagtagatacggggtttcaccatgttttccaagctggtctcgaactcctgagctcaggtaatctgctcgcctctgcctcccaaagtgctagcattacaggcatgagccactgcgcccagccaaaaattgtttttaaaaattagctgggcacagtggcatgcacctgtaatcccagctacttgggaggctgaggcgagaggattgcttgagcccaggaattcaaggttgccaagggtgatgatcacaccattgaactccagcctgggtgaccaatttatcccagtgacatataatagtttcataacatccttgccagcattgaataatattgaaagaatttttttttttttttgagatggaggctcactctgtggtccaggctggagtgcagtggcgcaatctcgactcactgcaagctccgcctcccgggttcaagtgattctcctgcctcagcctcccaagtagctgggaccacaggctcacgccaccacgcccggctaattttttgtatttttagtagagattgggtttcaccgtgttagccaggatagtctccatctcctgaactcgtgatctgcccgcctcggcctccgaaagtgctaggattacaggcgtgagccaccgtgcccggccgaaataatgttttgctaataggctcagaggtaattatttaaaacatatctttcttttctttttctttttttttttttttgagatagggtctcactctgtcgcccacactggagtgcactggagcaatcacagcttattgcagccccgacctcctgggctcaagtgatcctcccaccttagcctcccaagtagctgggactacaggtgctgccaccatgcctggctaatttttgttttttttttttttttttttttttagtaaagacagggtttcgccatgttgcccatgatggtctggaactcctgggctcaagtgatcttcccgccttcgcctcccaaagtgctgggattacaggagtgagccaccacgcctggtgtaaaacctagttcttttattgccaatgagtttaaatagctttctttctctttactggctggatgtatagcatgaggtctgcacttccttagttgtccagtgaaccaactccccgggagttggattcatcttgaaattcagtaatgcagtagttaaacccatgaactctagtggtgggcagattcagattcaaaccgtagctcttccacttcccagctgtgtgactctgaggtgcctacttaacttctctgatcctctatttccttgtctgtaaaatgaaccttaatgggcccattcctaggtttgtctgaaggattaaataaggtaaatagataatgaacatcaccttccacatagttgatgctctgtaaatattagctgttcttattcttttttttttttttggtttggcaaatactttatttttatttttatttcagtagtttttggggtacaggtggtttttagttatacgagtaagttctttagtggtgatttctgagattctgatgcacccgtcacccaagcagtgtacactgtaccaaatgtgtagtcttttatccctcaccctctcccatgcttcccctcattcttattatatattaatataaattaacaagtctctgttctccctcaagattgattttgttttaatctatagcagattgatttttctgccttagaggtagatggtcccagaaggggagctgacaacctctttctgtccaaatagactgtgtcctcggctggctgactggatctgggtgtgagcctccctgagcaagccggtgaacctctcccatgtggtcttagctccctgagcagatgagtaggggctgacggggctgtgtctccaggactctgagtctgctgtggtcctgcagcctctggagcatggaaatgggggctaaggactcactaatggtttcattcaagtccagaatttgtcttggtgactgttcgctgctcacatccagatgaccctatatgctgtttgggaaactgaggcagccaggtggattcctcaggtatttcaggggacagaatctggggctttgactccagcttgggttgctgcccataatgcctgctcttgaaaccttttaattatttttatttctaattaactttttttgagacaaggtcttgctctgtcacccagggtgcagtgcagtggagctatcatagctcattgcagcctcagtctcctgggttcaagtgatccgcccacctagtagttgggacaacaggcatatgccaccacacccgggtaatttttgtagctttttgtagagatggaggtctccttttgttgcccaggcttattctgagtcaacatgagtgaccatggcccaagaaacagtctcaagaggtcctgagaaagtgtgcccaagacgattgggttacagtttggttttatgcattttaggaagacaggaattgtaggtaaaatcataaatcagtacatgaaaagtatacattggttcaggtctcaaactcctgggctcaagcgatcttcctgcctcggcctcgcaaagtactgggattacgggcatgagcctgcgccagacctcttaaacccttcagagtggccttggcattcgttttgagggggcttcagggagccttaagggaggagaggaaagtcacgcaaacagggtgtgcttgatgcctgcattttcctctttactgctgacctgctgttgaggaggaagttaagaacatcaggatattggtctcaaatgaactacttcatgagaattttcttctaggaggaaaaacaaaaacctcaactttctcgttacacatccttctaaaaaagtccattaaaaatgtttcttgccaggcgcggtggctcacgcctgtaatcccaacactttgggaggccaaagcaggtggattacctgagatcaggagttcgagaccagcctggccaacatggtgaaaccctgtctctactaaaaatacaaaaattagctgggcgtggtggtgggtgcctataatcccagctaattaggaggctgagacaggagaatcacttgaacctgggaggcagaggttgcactccagcctgggtgacaagagagaaattccacctcaaaaaaaaaaaaaaaaaaaaaagttcctcatattcagagccaaggaaaggagatgtactcccagaccacaacttctgtttctgatggtttcaagcatccaggagccatgaccaggtcatgaatctttttttccctattgtgtggtgtgatgagtatttgaataatacagcccatctgctgtcatttggaaaccggtgatgatgtgtggtctatttgtaaattgagtgcagcacatctaatatgtgatagtttcctaagatgtgaatggctccatttctccagcaggaccgtgttttgaaaatgaataaaaggttagcttcagattagcattaaaagcaagagttttagaattacaggcttcatatcttggctttgacacttaacatgtaggggaccttgacaagttatttaagtttctgggttctcatctgagaattaggatgatagtacctctttgactggattgtcgtagagatgtcgtaaagattggaaataatgaaacacctggaccaagttatgggtacccaaaaagttgcagtttttaccattggatgaatgaatctttgaggcccacactgtggtagggagtggatttttaaaaaacaatttgtttttggtttttttttagatggagtctcgctctgtcaccgaggctggagtgcagtggtgcgatcttggctcactgtagcctccaccttcctggttcaagcgattctcatgcctcagcctcccgagtagctgggaccacaggcgcccaccaccacacccagctaatttttgtatttttggtagagatggggtttcaccttgttggccaggctggtctcaaacttcttacctcaagtgatctgcccgtctcaacctcccaaagtgctgggattacagatgtgagccaccgcgtctggcctaaaaatttatttatttagaaacgagtctcactctactgtccaggggctggtctttttttgagataaagtctcactccgtcgcccaggctggagtgcagtggtgcaatcatatctcactacatccttgatctcctgggctcaagcgatcttcccaccgcagcctcccaagtagccaagagtacaggttcatgccatcacaccccgctcattttgtatttcaatggaagacagggtttcaccgtgttgcccagactggtctccaactcctgggcccaagagatccacccaccttggccttccaaagtgctgggattataggtgtgagccaccaggcctggcctgtccgggctgctcttgaactcctgagcacaaatgatcctcccacctcagcctctcaagtagctgggactatgggtgagccctgctcagcctagctgagtggattttaatgacaggtgttcctgtcatgagttcttgaggtttgcagggtgtagtaagctttattcatccattaccttatttgatcttcccatgaatgactcagatggaatgcacagagcatgtgtcaataaataccccattttgctatgttgcccaggctgctcttgaattcctggactcaagagatcctcccgcctcggccccccaaagtgctggaattacagacatgagccactacatctggccttgtcagcgttttctagcctttcaaggtaggaaggagcttgggtatctgaggcaaatactgctggaagtgagatcttgagcaggccattttcttcctctcccagggtggtggcaagagccgcccctggccccactcaaggggcctggactggaaggtatggcagctcacagtgcggtctgccctcaggtgaccttggccacagcagtggattctggtgtcacctgtgaggctcacaaggcagcaccccaggagcccttgtgctgcgggttcccagggggagtgggtaggagatggccgggcagctggcagtaaccttgaccctgatgggctgtgtttctccaactttcccaccatccctccagcctgaagagatgggatgtgcagctcttgacctgcagccgcccaccccaactgcgacctcgctttgaagcttcaacttctatttttaaagctaatgttaattttacattcgattccatgatatatccatgtttattttactataaagcatattttcccctaactttagagtcaaatgggtgctctgggaagatgtttatgttttttctgtggcttccgctactcccagcacagcgactccaaccagttttaaaaatgtggattagtaccaaagaggatgatgaaccattagacacaattaggatgagaaatgccgagattatttatttatttatttttagagacagggtctagctctgtctcctaggctggactgcagtggtgccatcatagctcaatgcagccttgaactcctgagctcaagtgatcctcccgcttcagcctcctgagtagctcccaagtgcacactgccatgcccagctaatttttttcattttcggtagagacaggggtcttgctgtgttgcccaggctggtctccaacttctgggctcaagcaatcttcccacttcggcctcccaaagtggtgagattataggtgtgagccaccgtgcctggtggagaaacgaatagtttaatagcacttttatccaatgtgctttgttggttgagtaactgactttggttcaggtagagaattattaagatgcattacctcaaatgtaaacattttattttatttttttccgtggctagccgcacagagtcctatatacctctccagcagcactcacctggagaagctgctatggatgccagctactgttatttctcccttcccaataaatatttcattttcacttaaaatatgtcagtgtacattggttccctgatctgctctcagatggccaagggcttatgtttgagtaggtcacaggttcatctttctgtatgaggcgtacatgcaacgtataatccacttttttaatcctactttttttttttttttttgagacagggtctcgctctgtcacctaggctggagggcagtggttcactcacggttttctgcagccttgacctcctgggcttaacccatcttcctgcctcagcctcctaagtaagcagggatcacacacacctggctaatttttttatttttttaattttttgaaacagagtctccctctgtcgccccggctggcgtgtaatggtgcgatctcagctcactgcaacctctgcctctctggttcaagcaaacctcttgcctcagcctcccgtgtagctaggattacagtcgtgcacaacgccacatctggctaatttttgtattttagcagagattggttttcactatgttgttcgggctgatctcgaactcctgacttcaagtgatccacccaccttggcgtcctaaagtgctgggattacaggcatgagccaccatgcctggccttggctaatttttttgatttttagtagagacgaagtctggctatgttgcctaggctggtctcgaactcctgggctcaagcattcctcccagctcagcctcccgaagtgccggaattgcagatgtgagccacagcgcccggccttccttctacattttaataattcctgctgagattttacagttgtcttgcctggtctaattccataattctacaggaagtttgttttattgggtgacttgtcttttactaggtttctgaagcactcagctttgttttcttcatggaatcagctcctttcacacccagggtgcaccctcttatgtaataattacattatatgattacacaggtaaacaactgccatccgattggagcaggcatggcgacctctgtgggcatgcagagacaggaaggaaggctcgactccatggcaccccgggggtggtcagcacgtagaggccattggccagggtgtttggtaagggcatggagagcgccattcacccctgattctgctaggtaggagtcagggtaagtcgtagggatcacagagcctgggccagaggcaggttcaacttagaaatccctccgggactaggggaagccctcactctgagaatgagcacatgctccagaaagggggcatcaggtaaagtttcttttcccgtgggtcctgtcagtagcatttgtacttaggagctttgccgtttgccagctgaaagttgccattttcattaacgtagcttgccgtttctgtatctaataacaacaaacacttttgtaatatgtaccctgtgccaggcagtgtactgggcactttgaaaatacgaaggttggccgggcgcggtggctcatgcctgtaaccccagcactttgggaggccaaggcgggtagatcacctgaggtcaggagttctagactggtcaagaccagtctgaccaatatggtgaaaccttgtctctactaaaaatacaaaaattagccgggtgtggtggtgggtgtctgtaatcccagctactcgggaggctgagacaggagaattgcttgaaccggagaggtggaggctgcagtgagctaagatcatgccactgcaccactccagcctgggcgacagagcgagactccgtctcaaaaaaaaaaaaaaaaaagaaacaaaaagaaaagagagaaaaggaaaatactaagctagccggacactgtggttcatgcttgtaatcccagcactttggaaggctgaggtgggcagattgcttgaactcaggagtttgagactagcctgggcaacatggcaaaaccccatctctacaaaaaaatacaaaaattagccaggtatgatgatgcacacctgtagtcccagctactccagaggctgaggtgggaggatcgctgcttgagcctgggaggcagaggttgcagcgagccgagattgcaccactgcactctagcctgggcaatgtaaaaaaaaaaaaaaaaaagagagagagagaaagaaagaaagaaagaaatgctaagctaattagccttatgacaaccctgtttgaggccgggcgcggtggctcacacttgtaatcccagcactttgggaggccgaggcgggcggatcacgaggtcaggagatcgagaccatcctggctaacacggtgaaaccccgtctctactaaaaatacaaaaaaattagccgggcgtggtagcgggcgcctgtagtcccagctactcgggaggctgaggcaggagaatggcgtgaacctgggaggcggagcttgcagtgagccgagattgcgccactgcactcccacctgggccacagagcgagactccgtctcaaaaaaaaaaaaaaaaaaaaaaagacaaccctgtttggtaagtactactgtgattcccactttacagatggggaaactgaggcacagaaaggggaagtaacttacctaagtcttacccagccagaaagtggcagaggctgctcctaaccctgcaccatgctgcctccaaacacgggcttgttcccaggaagaagtgctgggttgggggaggggagtccagatcccagggaggaggactcaggaggcctctgggagtcaggcggctatgcaggaggggcttcctggctctttttcacttgtcccctcacccccaccccccgtccccaccttcccaggacttagttggacttccaggcagagttccttgtttgtttttgttttgttttttcctttttttagaaacagggtctcgctgtgtcacccagtctggagtgcagtgctgcgatcatagtttactgcaacctcaacctcttgggctcaagcaatcctcctgcctcagcctcctgagcagttaggactactgtgtgcaccgccacaccaagctaatttttttttttttttttgagacgaagtcttgctcttgtcccccaggctggagtgcaatggcacagtctcggcccactgcaacctctacctcccgggttcaagcgattctcctgcctcagcctcccgaatagctgggattgcaggtgcccaccaccatgcccagctaatttttgtatttttactatacatggggtttcaccatgttggccaggctggtcctgaactcctgacctcgtgatccacctgccttggcatcccaaagtgctgggattagaggtgtgagccaccgcacccagccacaccaagctaatttttagattttttgtagatatggggtcttgctaagttgcccaggctggtctcaaactcctgggctcaagtgatcctcccgcctcagccccccatagtgcgtaagccaccgtgcccagcctagttccttgctcttgaaggtccttgtgtctgatggagttggcgtcttggactctgatcctctacagcaagagtgggcagaaggacgcagctctggtgcctggcccttccccagttggcctggggtggtgcccattctccccaatgccaggggcaagcaaggcctggcctctacaatctcaatggcctccttgcccaacccctaggcctcttttgggaagttgacctaggtgtccttgagctggcagttgataccatctggctccagtgcactggcctgggagaggcagtggtacggtggtaaagagcaggctccagaataaacctaaacccacttccttccccgtcacctccttgagtcccactttcctcattcataaaactgaatggctgccttcggggcttgtcacaatgtttaatgagaaaatggacatcaggtgcctagtcatgggggctggccgctgtagccttgaagatgagcctgttgaaagatgaagaggctgtgctatgggacagagtctgaaccgatcccagaggctccaggggcaggagtggcccagagacctgctctgagaatggaagcattgtcacgggccccctgccaaggagagagtgtgaccaggacaatgactggtgggatgaggtgtccagagccctctatgtcatccccaggatttcttcctctttggttcagagcttacagggttgtctgcagatctcacgaggataggtggaggaggacccctaagctgacagccgggtagggaaggagggcctgagtgccgagtgcctgggcagagagccagctgcagatctcaccccaggagaatggggcgaactaccacatagctgacacttgacggggggactgccatgagtgtgtgtgtgtgttttgggagggaggttgtttgtttgtgattaagttgaggtcaggacagaagaaggaaagtggaatttgtagttttaagagatattatatggccatcttaagattgcagcagcagaccaggtgcggtggctcacgcctgtaatcccagcactttgggaggcggaggcaggcagatcacttgaggtcaggagttcaagaccagcctggccaacatggtgaaaccccgtctctactaaaatacaaaaattagccaggtgtggtggcgtatgtctgcagacctagctacttgaggagatgaggcaggaggatcgcttgaaccagggtggtcaaggctgcactgagccaagatggtgccactgcattccagcctgagtgaaaaagtgagaccctgtctaaaaaaaaaaaaaaaaaaaaaattacagcagaggctgcatctgggaattataggccgtgatcttccagatcgtgcatgcggatgttttaaatatatatgccatatgttttataaatgtgtttattcatgcatactgtacgtttttaattacatggaatcaacacaagttagttattaaaagtttataaaatatagatttggcagagtaagaaaaaaaagaatctgggccgggcgtggtggctcatgcctgtaatcccagcactttgagagatccaaggcaggcagatcacctgaggtcaggagttcgagaccagcccatggtgaaaccccgtctgtactaaaaatactaaattagctgggtgtggtggcgcctgcctgtaatcccagctgcttgggaggctgaggcaggagaatcacttgagcccgggaggcggaggttgcagtgagccaagatcgcgccattgcagtctagcctgtgcaacaagagcgaaactccatctcaaaaaaaaaaaaaacaaaaacaaaaaaacaaaaatccggccgggcactgtggctctcacctgtagtcctagtactttgggaggccaaggcaagaggatcaattgagaccaacctgggccatatagggaaaccctgtgtctacaaaaaacagcaacacaaaaactatccaggcatggtggcacacacctctagtcccagctgctcgagaggctgaggcgggaggatcgcttgagtccgggaggttgaggctgccatgagcctattatggcattggactccagtctgggtgacagagccagaccctgtctccaaaaaagaaaaagaaaaaaactccatcttccacctaccccagaaccacgtcacccagtggttcctaacctgtctcagattttaaatccctttgaaaacctgcagaaaagcatggactctctccagaaaaaggctctttcatccacagactctgttggtgtgcagggaaggactgtttaggtccaacctctagcttctctgtcgtatgagattctgactctgaaaccaacctcaaaggggcaaatcattctgaccctgtgacacctctgtaagacacacttgccagcaacctattcaaagtctgtcttgaacctgtttctattttctttcttgaccacctcttaaagaagacattgcacaagtttgcccctgccatttaaatcctttgtcctaaatttacagcccctttctggggctttcagcaaggatcgactttcctgcgtctttgggtgactctccactgtatcatcggctcatttctggaagaggaccatcctttggggcatgtgtaaggccccttttgtgggaagggccttggcttaggcacatggggaagcatgcctgcgagagctgggtgtgtgaaccttctttccgggtagtcaggagaaacttttttttttttttttttttttgagatggagtcttgctctgtcgcccaggctggagtgcaatggcacgatcttggctcactgcaacctccgcctcccaggttcaagtgattctcctgcctcagcctcctgagtagctgggattacaggcacgtgccaccatgcctggctaatttttgtatttttagtagagacggggtttcacggtgttggccaggctggtcttgaactcctgacttcaggtgatccgcccaccttggcctgccaaagtgctgggattacaggcgtgagccaccgcgcctggtctgggggaaatttctatagaggatgagaagtcagggatgttgacttctcatgctgggcctcaggtgcttgagaccagtcaggctctccctgtgaaattagcaagaactcaccctttggccaagtaggctgagcgccccacacccacatcgcctgtttacctctcaatattctcccaggccttggttagccgcccttagcccatgtcctgtttctcaggcatgaagaaggcccctgatgtcagcatcacagagctctcccagccctacaggtggccagccttcctggagaccactcctggtgccattccttgggcaccagtgactttgcctcttctcctcctcctcttcttcctcgtcatgttttagcataagaagctttattgagctagaattcacataccatacaattcatttaatgtgcacaatgcaatggttttttgttgctgttgttgttattgttttcgtttttatttttgagatggagtttcactcctgtcacacaggctgaagtgcagtggcgtgatctcggctcattgcaacctctgcctcccgggttcaagtgatccttctgtttcagcctcccgagtagctgggattacaggcgcccaccaccacaccgggctactttatgtatttttagtagagatggggtttcaccatgttggccagcctggtctcgaactcttaacctcaggtgatccacccgcattggcatcccaaagtgctaggattacaggcatgagccatcatgcctggcctaatggtttttatttttatttttaaattttttgtagagatggagtcttgctatgttgcctaggctggtttcaaactcttggtgtcaagtgatcctcccacctcggcctcccaaagtgctaggattacaggtgtcagtcaccaaaccccgcctcagtggtttttagtatattcacagttatgcaaccatcagcatcataaattttaagctgtgcatggtggctcatgtctgtaatccaagcactttgggaggctgaggctgaactcacttgagcctagaagttcaagaccagcctgggcaatatagtgagaccctgtctctattaaaaaaaaaaaattaaaacattttcatcactccaaaaagagatttcacaccattagcagttactctctacttttcttccatctctcagcctctggcaaccactaatctgctttctgtctctatggatttgcctgttctggacatttcatataaatgggatgatacactatgtggtcttttggggttgagtttgcaccttagcatattgcctttagaaacctgtctgcctcataccattacagaggagctgttgtttgtactgaccatttagtccatcacaggtattgatggagcctctaagcatggaatagtgctggccccacagcaggaacgcggcagccatgggtggcgtattagttactggttgctgtttaacaaatcacgccaacacttggcagactgaacagcaagcatttatgatcccgtagtttctgtcaatcaggaatacaggagccgcttcgttgggtggttccggtccagggtctcatgaggctgccattgagctttcagtggaggctgcaggtgtctggggctggaggtacctgccacagcgtggttggcaggctcagtgactggctggctgttggccagatatctcagttcctcttcatgtgggcttcttcatagggtggcttgagtgtccttatagcatggccactggcttaccccagagcaagagatgagagcactggagagagacagagagagagagagaagaggggaggggaggggagggggtgtataagcccaagactgaagccccagtgatgtttcataacctaattttttcattaattaattaattaattttagagatagggtctctgctgcccaggctgaggtgcagtggcacaatcagagctcactgcagcctccagctcctgggctcaagcaaccctccagcctcaccctctcaagcagctgggactacaggtatgcatcaccatgcctggctgctgctgctgctttttttgtttgtttgtttgagacggagtctcactctgtcacccaggctggagtgcagtggcgcaatctcggctcactgcaacctccccttcccgggttaaagcgattctcctgcctcagcctcccgagtagctgggactacaggcgtgcgccactagtttctgtatttttagtagagatggtttcaccatgttagccaggctggcttgaactcctgacctcaggcaatctgctcgcctccccgcctcgggctccaaaagtgctgggattacaggtgtgagctaccaaacctggcccggattcttttataatctaatgttaaaggtgctatcccatcactgtgccatattctttaggtcacattgactgtgaatgtgggtgggggctacacaacggtgagaatctcaggacggaagtaactgaatgtagtttcatatggagagtgatccagcttgttctggaagggactgcagtctccccgggacttagctttggagaatgagccagcttgttctggaagggatttcagtctgcccaggacttagctttggaccagctatgagttctctgtgatgaaatctcagcttttcccaactgcagcttcaacctcctgagttcaagtgatcttgttgcctcagcctcctgagtagctgggactaccaccacgcctggctaatttttgtattttttgtagaaatagggttttgccacgttggccaggctggtctccaactcctgagctcaagcgatctgcctgccttggcctaccaaagtgctaggattacagacatgagccaccacacctagccaaggctgcgtttttattttttattttattattagtattatttgagacagagtttcactcttgttgcccaggctggagtgcagtggcgccatctcagctcactacaacctccgcctccagggttctcctgtctcagcctcctgagtagctgggattacaggcatgccactacacttggctaatttttggtatttttaggagagacgaagtttaaccatgttggccaggctggtctcgaacttctgacctcaggtgatctgcccacctcggcctcccaaagcgccgggattataggcgtcagccaccacgtctggcctgggtatttatttatttatttcgagacggagtctcgctgtctcactctgttgtccaggctggagtgcagtggcacgatttcagctcactgccatctccgcctcctgggttcaagcgattttcctgcctcagcttcccgagtagctgggattacaggtgcacaccaccacaggtggctaatttttgtgtttttagtagagacagggtttcaccatgttggccaggctggtctcaaactcctgacctcaggtgatccaccctccttggcctctcaaagtgctgtgattacagtcatgagccaccactggggttttaaatgtgtaacaatggatgtccattttagtgggaactgaccctgtccctcagggacactcatgggccaaccaggaaaggagatgtctctgctgacttctgttagatggtgtaacccatcataggggtgacccagtgccatggtgggacgtgtcaaacgctttccccactgggattgggccctggaccttttttttttttttttttggggggctgggtctcgctaagatggcaccactgcatgccagcctgggtgacaaagggagacattgtctcaaaaaaaaaaaaaaaaccaaaaaaccaaaacaggctgggcatggtggctcatgcctgtaatcccagcactttgggaggcagaggcgggcggatcaccaggtcaggagattgagaccatcctggctcacacggtgaaaacccatctctactaaaaatacaaaaaattagccgggtgtggtggcgggaacctgtagtcccagctactcgggaggctgaggcaggagaatggcgtgaacccgggaggcagagcttggagtgagccgagatcgcgccactgcactccagcctgggcgacagagtgagactctgtctcaaaaaaaaaaaataaaaacaacaacaacaacaacaaaaaaaacgagccttgtgccttatagcagtgggacaacttggtgttagaagcagttttaggtggtggttccaggtgggttctgattcctgctctgtcacttcctgcacggcttcggcgtcagtttcctcatgaagatgactattgtaactatttagtggggttgttttgaggattttatgagatcttcagagttctagggatctcttgctacataacagcctgtcccaagctcagcggtataaagcaacactgtgatgctcacggtcccaggggccaggaattccgacagagctcagcaggacggcctggctctgctcccatgatatctggagtcagctgggaagactctcaaggggttggtaacaacttgaacaggtggggtctggaatcatctggaagtttcatcactcatgtctggtacctgggtgggatgacgaaggttgggctcaggtgggactgtcaacttgagtgccttcacatggtttctccttctggcttgcttgggttgtgtcactgcatggcagcgtcagggtagtcagacctctaacttaatgctcagaattccaagagccagcattctaaccaaggaggaagcggcatggcttctcatggcctcacctctcaagtcacttagcatctctgctgccatactctcttggcagtcacaagcccactagatttaagaggaggggacacagaggccatctctcaatgggaggagtccctgcaaccacgagccacacgtgctttttggctgatacttgaaagaatgagcaatgcaggctgggcgcagtggctcacgcctgtaatcccagcactttgggaggccaaggagggtggatcacctggggtcaggagttcgagaccagcctggccaacatgatgaaaccccatctgtactgaaaatacaaaaattagctgggcatggtggcaggcccctgtaatcccagctacttgggaggctgagacaggagaatcgcttgaacccaagaggccgaggttgcagtgagctgagatggtgccactgtactccagcctgggcgacagagagagactccgtctcaaaaaaaaaaaaaaaagaaaaaagaaagagcaatgcagttgggtgtgatggctcacatctgtaatcccaacactttgtgaggctgaggcaggcagatcccttgagcctaggagtttgagaccagcctggacaacatagcaagacctcaagacctcatcgctacaaaaattaaaaattagttgggcatggtggcacacacctcagctactcgggaggctgaggtgggaggatcacctgagtccacaaggtcaagcacctgtgatagcgccactgcactccagcctgggtcacagtgtgagaccctgtctcaaaaaaaaaaaaaaaagaaagaaaaaagaaaaaagaatgagcaatgcaaacccaagctttttttttttctctctctgcttatatccccaacccctcaactcctgccccaggtcacaaactcaggaagcctcaattaagacagacttttagtctaagcttggagaattgaggaaggaaagaaggaagtgccagatgctaattaactttgctttttaactacagatgagccactttttgagttacccaggggtgagagtctcaaagataaatgaaaatatgtaaggatggcaggagagcatgggcctcttataattaggtccctcattcttgtgctttgagaataaaaatatcaagggtggaatatgtgagtaaatatggaaactcctttgaggatttttttggagccctcctgtttattctaatagaattaaaagcaaacatgtaactggtttttttgtttgtttgtttgtttttggttgttgtctttagttgcttttttttggttatacttaatttatttttttattttttgagatggagtctcgctctgttgcccaggctggagtgcagtggctcgatctgggctcactgaaacctccgcctcccaggttcaagcgaatctcgtgcctcagccttctgagtagctgggatcacaggcatgcaccaccacacctggctaattcttgtatttttagtagagatggggtttcaccatgttggccaggccagtctcgaactcctgacctcaggtgatccgccctcctcagcctcccaaagtgctgggattacaggcgtgagccactgcgcccagcagttataattaaaaattttttaaagagatgagtatctcactgtgttgtccaggctcgagtgcagtgactattgacaggtgctatcaatagcgcactgcagcctcaaactcaagcgatcctcctgcctcaaactcaagcgatcctcctgcctcagcctgtgagtagctgcaactacaggcgccctcagtcgtgcctggctttgcctctgatttttttctgactttagccttcctggtcttgtccccactcagcagtggtgtcttacctgaccacacctagaaatgctgaatgccaatttgagttagaaagagaatagcagaattccagccaggttggaggctaggatattggtgagcatttgggagaagctgagatttcatcacagcaaaagtgtgatgaaatcacacatcacaaagtgtcaggagagggagaagtgactgatgcagcaaatactcttccatcttctagggctccttgaagggaacaagggctccaatgagtgggagcagaggctcatttggtttcctgccttatgttttgggatttaacaagaggattggcccttttagtagcaagtagaggagcaggaatctaatttcttggctccatcatagctcaccgcagacttctgggccaagcaatccttctcccttggcctcctaagtagctaggactacaggcaaatgccaccatgccaggctaattttcttttttttttttttttagtagagacgaggtctcactgttttgcccaggttgttcttaaactcctggccttaaatgatcctcccacctcggcctcgcaaagtgctgagattacaggcgtgagccaccgtgcccgccttaatttactctgatttttcttttctttttaaaatagagacgggggtctcactgtgtggcccaggctggtcttgaactcctgggctcaagtgatcctcctgccctggcctcccaaagtgctgggactacaggcgtgagccactgtgccaggtctactctgatatttaacagtggtaaaattcatttatccactaaatgactttatttatactctcacttaatttcagaaaggactgaaggtacctgagctgtgaacaaagaatcagagactggtttttcctccatctctgccactaactagttgtgccacctggggcaagtcacttggtctccttgtgtctgttatccatgtgtgagagccaatacttaatatgagtgccaggcactgttctagagattttccatgcatctgtattcactcttttaattcttctctacacaatttattaaggtctctatctttttagagtttgtcagggcagttccagttcatcgtggcaatacaagaaagtcacttttgggggcttttgccatttcaaagaatcttggatttttctctgggctccagagacacccgtgcctgacacccccaatttgaacccccagcggatcattgggttccattgctgatggggaccttgtgtttgagcttgactttccctccatccatgctggagataaacggaagtcttcgcgcagggggacgattgcaggacggggccgctagggaggagggctcccacacgtggggaatgggggtggaggaaccgctgaagctcgtctgccctttggaaaatctcgttggtgtcctagccctgggatcattgtacttaccaggttggggggctctgcacccagaactcctcccagcctctgtctgcccgtccaaggtccggcgtgacttccggtggctgatttctcatcttggggaaatccccgccctgggggggtccggtgtggcctgcagggagcctgactcacccgtcggctgagtcagggggtcccagctgccctcggatgtctgctgcaccgctcccctccctcaggcgggggacggcaggaaggagggagagatgggagggcgtgggggcggggccgggggcggtctccagcccccggcccgggctccgccctctcccgggatctgtgaaagcacagccagggtgcgggcgggtgagtgcccacctggtgcagggtgtgaagagcgagagcgcgtgtatgagcacgagcgtctgtggtctctgtgtgtccgtttacatgattgcgcctgtgtctgtgtgtgcgcatctgcatgcgtgtctttttgagtgaatgtctgtgtgtgacttctagggacggccagggaagaggagtgtcccctcccaccctggccccccgtcttctcatcctggactccctctcttctctctcctccttggggggtgctctgggcatccgggacccctggcaaggctgccgggtgctgggaggacgcagaggccgccgagggcggagggaagcgtcaggcctggctgcgcgcgccctggctagggagctccgagtcccggccgcctggtcctttcattctgggcttcttcgagattctcgagggcttccagccggcagtgttttctccttgccgtcttctcaggcacgaggaaggctcctggagctcatctgcctgggatgggcggccctgccttgacctcacgtgcagcaattaggaccaccaaggagtgttcttcaaaccaccttctaccaccccgcgggacacgccagggctgattctggtgctcgcaccccgcttcctcctctgcgttcccctgtggcaaaggtttgtcttgggctgtggacccgaaagaatattctaaggggagatgggctcttgcagagcaagaggggtatggtttcagcaccaaactaaactggtgccagcgctagctctgcccaagaggctgtgcagacagtgtttgtgtgagtacgtgagggtgagagtccctgcccgcctagcttcggcttccccacttacaaccaagggagaacaacatctatcttacagtgtagatgcctggataaaaactggagcgcctggccgagcactttgggaggctgacgcggtaggatggcttgagcccaggagttcgagaccagcgtaggcaacatagttagacccccgcctctacaaaaaattttaaaaaattagctgagtgaggtggtgcgcacttgaggtctcagctacacgggaggctggggtgagaggatcgattgagccagagaggtagaggctacagtgagctatgatcgcaccactgcaccccagccagggcaacagagcaagaccctgtctcaaaaacaaaaacactggagcgcccagagttttttttaagtgcgggacaaggattgtctcggtgttgttactgcacgcacaccgcccgttgtaatggatagatgcattagtgaaagtgctaggtacactcatttattttctaaatctcacatataagggaacccccgatggaaaggcccatcagctagggaacagccagcaggctggatttgagcccagagcccgggctggccaattactcgagtgagtctggctccggctctgtgacctgggtccagtaccccgccctttctgcggatgccttgcaaagcggggagcggaaagcagtttggtggacgaccagccctcccttgctttgcaggtggcgctttctatttattgattgtaaggtgaaacctaggccagagccagcgtgcgcgcgccgtcggggtcccgcggctgctctggggctcagggtgcgaaccccaagggccccgcctggcagcgtcctgggcctccgggcgagaacagcgggggtcggggaggatttgcagcgtccactcctctctccgccgcccgtgtgagctcgggcgcttctcccggctgggggtgtgagaatttgccgacggtgcccgcgccgccgccggccccggccccgccccagccccgaggacgccccgcccccagccggcgccccgccccgcctgccagtagtcccagccccgccccgggccgcgcccctccgccgagccccgcttgcctgcacctcgcgcggcgggcctgccctccggcccccgccggccccgcgccgctgcccggaggctggcgtcttcccgtcactccgggacccgcccgctgtgtcccctgggcaactgtctccagggagatcgggccccgcccccggcagcgacacccggtacggagcccacctgtgcgggcgtctgcggggtccccgtgccccgcccccagccccgccgggcgtcccaccccgcccagccccgggctttgtccgcctggggcggggtgggcagggtcggtggaggcgatcaggggtccggggccgtgggggcttggggggccgaggcagggggttgcgttcgcggtgggattctcagctatgggccgcgcgacgctctcctctcctaatctggttgcttccttttgtgccccccgggggtcaggaatcccaggtttctccgctgccgcccttgatgggatccgtgaggcctccagcgggcttcgcacgaggacgcgcctgttcggggcaggctgtttacttgtcggggacccagcagtggctgtgcgcgtcctcccctccccctgccccctattcgggacggagcctcctgcgctctgtccctcccgagctgtgcccttgagcccaagggggctagagggtggcagacccagatcctgaggtcctgcggcttcctccccgggggagcgccttctccctggccgccctcttgtggattttgtcctggctccttatttcctgacccgaattcctgaggatgaattctctccttctcttccttctcggctccctctgcttttggctttgtttttcctgttttgaaagggctttccttatgatcctgtctcatttccctgtgccagagctactataatttgtcgtggtaacgggtattggccagtcacttaattggtcagcaatggaagggatttcttccttagcctttggtgctgacctcctgtttctctggtggcagtgccttgcgaagtgcttgccactgtcccctggattttgagggaagggagcatccgagcccgcatgcctgggctcccgcagcagggtccccggagcatctttgcagggatagaggccgcagggaggactccagcttggtccttgggagatgtgttcctgcaacccatgccttttccagcgggttcctagggctctgctgtttgactcatggagaagccggtggttttggtgttgtgctaaatcgaagcccacctagtgggctctgggccgaaggctcccagctgtggaggtagctatgcccagggcctggggttgggagaaggggttgggtctttagactgggctggagctctagtgtcttttttccctctttggggttctgttatttcctggagcggctgaggtgggggaagaagcaccacagatgcaaggagtgggcggcccctcccctcacactcttcctttttatctccagcccaatagggcatgaattttcctttagacctgggccttgaaaacagatccacatggggaataaagatttcaagttcaccaacctgctttttgcatccatcgaatggaactcgaacccaggcttggctcagatcaattactttgctttcaaaaaaccaaacaaaaccaacaaacagctctaaaaacgatctgagtcatctgagtgcacattcctgctccaggcactggaaatgctcctgtggttggtttcagtaccaccaaagggagctgggggtggcattgacgcagatggcaagaaaggccgatcaagtggaatgtgattggtttgcaaaaaggagagacctagatgaagcagttgattttgagctaacgtcctgtaagagaatgcacaggtttctgaaattctctcttgttaaaatagttttctttctttctttctttcttttccccaacagataaggagtcaggccagggcgggatgacactcattgattctaaagcatctttaatctgccaggcggagggggctttgctggtctttcttggactattccagagaggtaggttgggggaacgggccaagtgtgtgggggaagggaaaggagatgttattttgtagataggttaagaatgtgaacaaacccatcctccccgactctccagccaaaggaagacttctctgtaggactagcacacccagaggaagagagtgacccaaattggtgctaggagcgaatgaatggggaagtgaactagacctcagccattcccaggagagagatgctgctgcctgggaaaagaaggaatggctttgctttgaggagtcctggagcccattactaagctgcagcatttggtatttgactcacactggccacggtagcgttggactcgcctgactggggagagaaatattaaaagttttctggaggaaatggattgaatttttataattcagtgttgcttctcaaggagtccctaggtggggccgttctgtgtcttcagagagctggcagtcactgtctcagtaagaggatgctcttcagagtttctaggacattagcttagaagatgaatgcagtcctttcatggtgcaaatgaggacactgaggccagagaccgacactggctggacgttggctaccacacccatctgggggcctggaatagctgggtctggcttgggagctccatgactgcgagacctgccggtccccttgcaagctctctgggtgcataacatattctgtgtgtacccagaattccactggagacgctactgtcatttcaggatggaaaggggcaggggttagagcgcggtggcgtccttaaaggctttttccccaacctcagcctcattttctctagatcttcattggtactttccaaacttgtttgatgattgcggatctctttttaaaaatcaaaatataggccgggtgccgtggctcatgcctgtaatcctagcactttgggaggccaaggtgggcgaatcacgaggtcaggagttcgagaccagcctggccaaccaacatggtgaaaccctgtctctactaaaaatacaaaaaattagctgggcgtagtggtgggcacctgtaatcccagctactcgagaggctgaggcaggagaatcacttgaacccaggaggcggaggttgcagtgagccgagatcacaccactgcactccagcctgggtgacagagtgagactccgtctcaaaaaaataaataaataaaataaatcaaaatataaagcagaattttaacctataaaccagatcaaaacagccactgtaagagaaactagcccagaactccttctgctcagcaccctgtcccactcccacctacctctgaaggcctggggtgcttctttggaaccccagcgctcccctgcacataagcaaaagccatagatcatgtagacccctgttggaggattagaatttcttccacacatctatttatactgacttgatctttgtctcagaaaatgccttttaataatatttttaatcctcatgcttttttatttataaaaataggaaattagtgtcaagtttggaaaataccaaaaacatacaagcatactcgtctatcatcttaccgccaccccaccccgcaccagagaaaaccactgtttcctcgttggagtatcctcccccaaacccctcagagagaattctgtctgtagcttttatttattatttatttatttacttaatttttttgagatggagtcttgctctgtcacccaggctggagtgcagtgatgcaatctcagctcactgccacctccgcctcccgggttcaagcgattcttctgcctcagcctcccaagtagctgggactacaggtgtgcgccaccatgcccagctaatttttgtggtttttttttttcagtagagacatggttttgccatgttggccaggctggtctcgaactcctgacctcaagggatccacctgcctcagcctcccaaagagctgggattacaggcgtcagcctccacgccctgacctgtgtctgcaccttttaaaacttgacttttatttattagtaagtattattatagactttgacataaacataacaatcgaacatatatgtatttctctgctctgtttcaaaatcccactaaaatgaaagtaaaggaataagaaaaaatgtaaattcttaaaaaaaaaaaactagaaaagtaaatggttgaggagggtggtatgaacaaaacctttgcaggacaggaaaccgataggcgagagggaagctgagtggagaatgtccaatgtcttgggccatgggggaggcaggtggaaaaggcaaaggaatgggggctctggggatggagtgcttcgaaaggtggtgtgtgcagggtgggctggaagcaggaagattacttgaaagagcatggtagggtgacagaccacccccccaggccacatagccagatggttcccttccccaccccagcaggtggcaggtttccggcaggcagtgttttcagagaggttggcccagcccagggcagcagaggcactgcatggagaacgaaagggtcaagcgagttagtttgccaagcagtgagaccatatcctgggtagctccccgaacaccgcagcttccatacagcctctgggcagacccttggaggacttctgtctgaccagactgatctcacgagaaaaataactgtcacatattgacattgagggggaccttgttgaaaagccagcttgttgctaggcacggtggctcccacctgtaatcccagtcctttgggaggccgaggcgggaggatcatcacttaaggccggagtttgagaccagcctggccaacatggcgaaaccccatctctactaaaaatacaaaaattatctgggtgtggtggcgcgtgcctgtaatcccagctacttaggaggctgaggtaggagaatcgcttgaacctgggaggtggaggttgcggtgagccaagatcacgccactgcacttcagcgtgagcgacagagtgagactccgtctcaaaaaataaaagtcagcttattgctttgtcatttcacactgaagcctaccgagcagctagccctacctgtgtacaagcagggttagtgcctttcccttagatttgaatgggcagccaagggccatcccacatggaatgagatttacaggctaaatgtggtggctcatgcctgtaatcccagcactttgggaggctgaggcaggaggatcgcttaagcccaggagttcgagaccatcctgggcaacgtagggaaatcctctctctacataaaataaaaaacaagccaggtattgtggcacatgcttgtgatcccagctacttgggaggctgaggtgggaggattgcttgagcctgagaggttgaggctgcagtgagccatgatcataccagtgcactccagcctgggtgacagagtgagaccctgtctcaaaaacaaaaaagagagagagagagagagacagagagagacttctagtgtgaaagacagagacccaaatgaacagaaaaaaaaatttgagaagtcacaaacagggtcgtatggggaaaaaaaggcacattcataaaataataagctgttaggtattaagatagcagaagtaaaaatagaagaagtaaaaatttcaacagaagagttggaagagtgaaaaacaaatttccagaaagtagaacacaaagacttaagagatggaaaataggaaagaaaatatagaaaaatttgacttcagtccaggagacccagcatgcaccacataggagctcaagaaaaaaaggcaagagaaacggaggaaggaaaagtatgtaggaaacaattctagaactgaaggcatttctacttttaaacagtctcgaagtagtacccaataccatgaataataaaaggcccacgctataggacatcatcatgaactttcaaactccagagatagagagaagttactaaatgtcatcagagaaaaaaaggccacatacagatcagagaatgagatggctttagacttttcaaaagcaacagtagaaactacaagacaggccaggcgcaatggctcacacctgtaatcccggcactttgggaggccgaggcgggcagatcactaggtcaggagttcaagaccagcctggccaacatggtgaaaccctgtctctactaaaaatacaaaaattagctgggcgtggtggcatgtgcctgtaatcccagctacttgggaggctgaggcaggagaatcgcttgaacccgggaggcggaggctgcagtgagccgagattgtgccactgcactctccagcctgggtgacagagcgagactcagtctcaaaaaaaaaaaaaagaaaagaaagaaagatactacaagaaaatggtcagtgcttttaaatttctgagaattaattaattctgagggaaattaattctgtaattgtcattcaaataaaaagtacattaaagacttttttttttttttgagataaggtgtttctctgttacccagattggagtgcagcagtgtgatcatggctcactgcagcctcgacctcctaggctcaagcaatcctcctgcctcagccccccgagtagctgggactacaggtgtacgccaccatgcccagctaatttttatcctttttgtagagatagggttttgccatgttgcccaggctggtctcaaatttctgggctcaagcaatccacccaccgtggcctcccaaagtgctaggattacaggtgtgagccatggcacttggcccacaaactcattttctaaggtaagaagttaaaatttgacagtggggtggctcgtgcctgtaatcccaacactttggagcccaaggcaggaggatcacttgagcccaggagttcaggaacagcctgggcaacatagtgagaccccatctctacaagaaataataataataaaatttaaaaatattaaaagaataaaattggctaggtatggtggcccacacctgtaatcctagcactttgggaagctgaagcaggagaattgcttgagcccaggagtttgaaagcagtctgggcaacatagtgagaccccatctctacaagaaataaaaagttagctggcgtggtagcatgtgcctgtagtcacagctactcgggaggctgaggcaggaggattgcctgagctagggaggttgaggatttcaccactgtactcagcctggatgagaccctgtcccaaaaaaaaaaaaagagagaagaaaaaaataagttgaaagttgaaaaccaagaaatattaccataaaactgttatttagaaatatcaaggtcaggcatggtggctcatgccttgtaatcacagcactttgggaagccaaggcaggaggatcgcctgagcccaggagtttgcatccagcctgggcaatgtactaagaccttgtctctacaaaaaatttgaaaattagccaagtgtggtggtgcatgcctgtagtcccagttactgaggaggcggagattgcagtgagctgtacttgtgacactgcactccagcctaggggacagagtaagatcctgtctcaaaaaaaaaaaaaaaaaaaaattgtaggctgagcacagtggctcatccctgtaatcctagcactttgggaggctaatgtggggggatcacttgagcccaggagttcaagactagcctgggcaacatagcaagaccctgtctctattttcataaaagattttttaaaaattttgcctgaggtataaaaacacacaaaaattttaaataaaaaatggaaatatagagataaatacttaagcaactgaaatttattgggtgtggtatatatgtggaagtggaggtcggaggactgctactttgtactgtaagagttttagttttaattaattttaaaaatcatggacttgtggccaggcacggtggctcatgcctgtaatcccaggactttgggaggccaacatggaaagattgcttgagccctggagtttgagaccagcctgggcaacatagtgagaacctatttcaagacaacaaaattgtatttcattattatttaaaaaaaaaaaaaagtttttttttaattagctgggtatgtggtgtgcacctgtagtcccagctactggggaggctgaggtgagaggatcacttgagctcaggagttcaaggctgcagtgagtcatgatcacgccattgcactgtagcacgggcaacaaagtgagaccctgtctctaaaacaaaaaaaaagtgctgagcgcggtggctcacacctgtaatcctggcactttgggagactgaggcgggtggagcacttgaagtcaggagttcaagatcagcctgagcaacatggcaaaactctgtctctattaaaaatgcaaaggagtatctgggtgtggtggcgtgcacctgtagtcccagctatttgggagctgtgatgagaggatggcttgagcctgggacgtggaggttgcagtgagccgagattgcaccactgcactccagcctgggaaacacagccagaccttgtctcaaaaaagaagaagaagaaaaaagaaagaaaaccacgtacttgtataactttcctagaaattaaaataataaagttattatgacatccatattcattcataacatttcattttttctatgctttttttttgagacggagtttcgctcttgttgcccaggctggtgtgcaatggcacgatctcggctcactgtaacctccgcctcccaggttcaagcaattctcctgcctcaccttcccaagtagctgggattataggcatgcgccaccacgcccaactaattttgtgtttttaatagagacggggtttcaccacgttggtcaggctggtctcgaactcccaacttcaggtgatccacctgcctcagcctcccaaagtgctgggattacaggcgtgagccaccatggctggcctttctatgctttctaaaatgctttatcaacaagcatatgtcacagtgataaatgtctgtgcacttaatgtgtggaatatttgcagtgttgtgtagtgtgcccaggtgtcattttgatgactgcattcagtttcattgagttaatgcatcatttagccatttccttatcactttcacaaacaataccacattgaatatctttgtgtatatagcttttttgacttttgaattgcttctttaggataattcccaaattcccaaagttaccaggtctgagaccatggatgtttctttctcttgattttgatgtgtagtatctgaggcctccacctgggtgcaggcctgtggcctccctggtgggccgtgacctaggatgatgatgagatggtggggatagcattttttttcagggtagttagcttttttctgatggcagcagtagaggtcagaaatctttgttgcggaggccaggtatggtggctcatgcttgtgatcccaacactttcagaggccgatgcaggaggattacttgagcccaggagtttgagaccagcctgggcaacatagggaggtcccgccccctacaaaataaataaataaataaacaaagctctgcacagtgatgcacagtgcagtgatttgtgtcatattcccagctacttgggaggctgaggcaggaggatctcttgagcttacgaggtcaaggctacagtgagctatgatgatgacactgtactccagccagggcgatagaatgagaccctctctgcgaaccgtgccaaaaaaagagtaggctgctgggatgagttcgggcatttcggggcatgtgagcccagcacttcccctcatcaacccagccctgccagctcttgctgtacatgtcctgcacacgtctcctcattgctttcctacttccattctggcctcgccccttccattttcccacagcagccaaagccatctttataaagcataaaatcaggccgcctcagtcctctgcttaaaaccctccagtgatttctccttgtaatgatactggactcctcaccatggctacggggccctgcagggtcagactcaccgtctctcccagtcaccctctcccagtcacgcccttgacttcaggcacctgcctcctgcctcagggcctttgtactttctttttttttttttgagatggagtttcactcttattgtccaggccgaagtgcaatggtgcaatcttggctcactgcaacctctgcctcccaggctcaaggattctcctgcctcagcctacttgggattataggtgtgtgccaccacgcctggctaatttttttgtattttttaaatagagacagggtttcaccgtgtgggccaggctggtcttgaactcttggcctcaagtgatttgcccgcctcggcctcccaaagtgctgggattacaggcgtgagccaccgcccccggcccaggcctttgcactttctgtccccactgcccggaaccctattttgtggatttttgctggatccttctctcacttgagcctcaacttcagaatgatctcacccgaggacccttccctgacccaccatccaaaggaaacgctgcctgcaagcccctttttattatattccagtgcttttactacctgaagcatcttgtttatctatttgttttctttttaactttgtatttaatttttaaatatttatttattgatttttgagacagagtctcactcttgcccaggctggaatgcagtggtgtgatctcggctcattgcagcctccccctcgcaggttcaagtgattctcgtggctcagcctcccaatagctgaggtcagatccctcagacgttcacagctgggacgccgttcttccaccttgggctccagaaagagcaccaaggagaacatttcaggacagactgtaagggtggcgtggtgtcctggccagaaccccatgtgcgggagggctccgctttgcacagctgtttctgtggatcatgctggccaggaggtgggaaggtgaaaggaattgtgttcttatcctgtttccttggatattttatgagtgacttagatgtggacacaactcatgcctcaggattctggatgagtaagtgaggagggattggtcaccgtccatcactgggtgacgcgaccccagctccccgctctgtgtctaggccgtctcacctgcccctccccggctccacatctgtctgtagcctgctgactccacagatctgtcccccgccctcccacctggggagtttgcccctggcggtctttacgtggctattcattaagcagctgagattcatttggtctaaaatggggctccggctgtcttatcccaccagaaatctcttcctttcctgtctcagtaaattcccaccaccactcccatctcccaagcccaaacctggctgtcatcctcacttcctcctgcaccgtcccccaagggtccctctgatttaagtatgtctggattccgttgctctccagtgctgtctccttctgggtcaagccactgtcattagtggcaccggcctccttcccctgccccctactccccttcctccctgcttctccgcagtccttccacaccgcagccagcagcatagttgtggatgaaaatcgcatccctcactccctcacctaaaatcctccagggctgtccatccgctcagcacaagccccaggtgccagcccttgttctgaaggctctgcaagacccagcccagttgaagtcttcaacttgctcatgccacaccctcccctccgtgcccaccaccccctgctccagctgtagtggcccgttctagaagacttgagtccctttcccacgagatcccctgcacctcgtgtaatttctggcacttaatcaggctccatagatactggtgggataaatgaatctacctcggactgaatgatggagacaaaacataaaatcaaagccgggcgcggtggctcacgcctgtaatcccagcactttgggaggccgaggcaggcagatcacctgaggtcaggggttcaggaccagcctggccaacatggcaaaaccctgtctctactaaaaatacaaaaaatcagccaggcacagtggcagacacctgtaattccacttacgaggctgaggcaggagaattgtttgaacctgggaggcggggattgcagtgagcggagattgtgccagtgcactccagcctgggcgacagagcaagactctgtctcaaaaaaaaaaaaaaaaaaaaatccaataagatatgagagccaattatgttcacaagatgaaactaccaaggataattgtgaattccttcatttagatcaggaaattcatgttcctgtacaggcagggagaacctggcttactgtgaaaaatccctggagggctggcagccaatgagttcatgatgtggccaccaaaaatctgccttggggtgagagtaggggagcatgaaatactctcaggctaagcaaataggagctcggtgcccagaacattcttctacagctcgacctgccaggccctgtctgtagcatcttgtttttgtttttttggtttttttttttttgagatggagtctcactctgttgcccaggctgaagtgcagtggtgcgatctcggctcactgcaacctctgccacctgggttcaagcgagtctcctgcctcagcctcccgagtagctgggattacaggcaagaaccaccacgcctggctaatttttgtatttttagtagagacggggtttcaccatgttggccaggctggactcgaactcctgacctcaggtgatctacctgccttggcctcccaaggtgctgccctggagcatcttgttagcttggagtaccaaactgtggcaaaagggtctaaaaactgtatcacagggagaacattgagtggttttgggaatgcctaggctgaagagagacgccttagggcctgatggggccgccatccagtggtcctgtggactcctctgtgtgcctctagatggcagcacagagatcggagtttgactcttagaggcaggtccacttccaaggaaagaactttcctttttttttttttttttttttttttttttttttttttgaggcagagttttgctcttgctgcccaggctggagtgcagtggcgccatctcggcccactgcaaactccgcctcctgggttcaagcgattctcctgcctcagcctcccgagtagctgggattataggcatgtgccaccatgcccggctaacttttgtatttttagtagagacggggtttcaccatgttggtcaggctggtttcgaactcctgacttcaagtgatccacctgcctcagcctcccaaagtgctgggattacaggcatgagccaccgtgcccggtcagggaaagaactttctaaacactagaagcttctaaaaatggaagtgcagctgcagtaatgaaaatagatgtttttagctgtaagcggccaaaaactcagctcaaactgctgtaagttaaaaaagaaaaaaggctgatgagactgaagagtccagggatagactgtagcttcaggcatggctggatccagggaatcaaagttcgtcctcaggacccaggcttgtactgtctgctttagccccactttcctctgtgttggtctcttctcaagttctgcccctaaagacagcaaacagttgctagcagctctaggtagacagtctgtcgtttctgctaccccaagaagaagtcccagagaagcctagatgtcaaaacccactggactgacttgatagtcatatggccatcctggaatcctatagtcagggagataacgtgtagtgataggctgcgcctaagtctcattcccacctccaagccaatccccatggcctgggcaaactcaggcccctgattggctgtgtctgagtctcaggctatccagggagctaggggtgaagtcagcttatccgaaccacttggactgagtgtgttgagtttttgaaaagtccccagctcccagattaaaaaaaaaaccaacaaaaacgtaaagttactagcacccagaagcctcccatgcgcccttctagtcactcccccaaacctggggtaacccctatttcttttgccaccatagatttattaattctgcctgtgtttgtttctttgtacagttggaatcatgaacacatattttttttgtgggcagctgcttttgcccagctttatgtgtgtgagagtcatcgatactgttgtgtggacttgtagactgctcattctcattgctatataacattctgctcagaaagagtatcacacattattttgccattccccattctgttgatgtgcatttgggaagtttccactttggagccatcatgaatagtgatgccatagacactcttgcccgtgtcttttgataaatatacatgtatttgcatttctctggggtgtgtactttggagcggaattgctgggtcctagggcataggcatgttcaactttagtagatattgtcaaacagttttccaaagcagttgtactggtttgcgttcttggggcatttctgaagtccctgtactcactggcatctctgtcctgtacatatcagagagctatggttctgggcttcattcagggaagagttagggctggttggccactgtgctagagagaggttcttagcccagagagacggaaggcacttccactttctcctgtcctgtctcactggtgacaggacctggcatttgatgtcctgtgcagaccagtctgatactttctgtattaggaatgaggttttctgtgaaagtatttccctacatcccatttaggtaaggtgtagttgaagacttcatttccagagtgctaaggggcaggagagtgaggggtgtattttcctggaacccaggctgtgggttggagtccctgggagctcatgcctcatgtgctcatcttgggcctcaccagactgagtggccaaagatacccctgactttcaaagcccatggtcaaagcccatttcatgtcataagtggattctccaggattcctgactctctcccaagttgtttttttgttttgctttgttttgttttgttttgtttttgagacagggtctcactctattgcccaggctggagtgcagtggcacaatctcagctaactgcaacctccacttccctggctcaagcaatcctccagcctcagcctcccaagtagccgggactacaggcgtgagccaccatgaccggctaatttttgtattttgtgtagagacagggttttaccatgtttcgcaggctggtcaccaatgcctgagctcaaagtgatccactggcctcagcctcccaaagtgctgggattacaggcgtgagccaccacgcccagccggtcccccaagttttgaaacaaaaggaagactttggcttggccattctcagcaagaggaacccaaagtaggatgtggttttgcaattggaggaagtggcgaccagcagtggcagtgcctagagatgtgcagctctcgctcctcagggcagctggggtccagctgacggtgaggcctgggcccagccggcgctgccacccaatcaacacctgccttcaaccaaatatttcttttcaactgtttttacaagtctttaaaatccaagagaatgtgatctttaagtagagaagtctttgcttaaagaataaaaatcataaatcataaaggcaaagattgataatttgaccgcatcaacattaaaaacttctactcaccaggctgggcatgatggctcatgcttgtaatcccagcactttgggatactgaggccagtggatcacttgagcccaggagtttgggaccagtctctactaaaaacatatatttttttaaagtctctattaaaaataccaaaaaaaaaaaaaaaaaaggaaaaaaaaaagggtgtagtggcatacgcctgtagtcccagctacctgggagcctgaggttgggaggatcacctgagcctgggaggttgaggctgcagtgagctgtgattgcgccactgcactccagcctggatgacagagtgagaccctgtctcctaaaacaaaacaaaacagcaacaacaaaaaaccttctactcaccaaaaagacaccataagcaaagcaaaaagatgactcagattagaaaatatttcccgctcattcaaccaacaaaggaatggaatctagaatatataaagaaatcctacaaagcattaaaaaagattaagtaaccccacaggaaaatgggcaaagtttatagtaagtaggctatttgtagaaaataaaggttttatggaaaatcagggaaatgcaaattaaaacgagataatttcattcacatcaaattggcaaaaatgagtaaatttgacaataccaagtgttgaccaatatctggagattgatctccataccacagttctgagattgctgacgggcaccaccgtcttgaggacagtgtggtgatatttagtaaagttaatggtgtggttataccgatcgtaggttatgccacatgtgtctcttgagcacttgaaatgtggacagtgtgaggaatggaattttaaaacatttaatttaatttaaaattgctgttgattcatttattggaattttttttttttttttttttttttggtagagacagagttttgccatgttgctcaggctggtctcaaactcaagcaatccacctgctttggcctcccaaagtgctgggattacaggcatgagccactgcgaccagccttaagtgtgtttagaacaaactgggtctggctaggagctcacacctgtaatgccagcacttagagaggccgaggtgggaggatcacttgagcccaggagttcgagaccaacctgggcaacatagcaagaccctgtacctcaaaaaaaaaaaaaaaagttagcagggcatggtggcacaagcctgtagtctcagccactcaggaggctgaggctggaggatcgcttgagcccaggagttggagggtgcagtgagctatgattgtgccactgtactccagcctgggcaacagagtaagaccctatctcaacagaaaaaaacaacaaaaacctgggtctgtgaacctacttttcacctgtagattggataaaatctacattcagatcaagtatttctgatgataatctagaaatgaaattgcagtacacactaaatgtaaaacacacaccagatttcaaagattcgataccaaaataaatgtcaaaatatctcattagtaattttctctattgattatgtgttaaaatgactatcttgtggctatattgggttaaataaaatacataatgaaacttcattttatctgtgccttttcactgtttttggctttttttgatttcttttttttttacttttttcttttttttttgagacatgattttgctgtattgccaagctggtgtgtagtgatccatcatagcatctcaaactcccaggctcaagtgatccttccacctcagcttccaagtagctgcgactacaggcacgctccaccatgcttggctaatttttaatttttttttttttttgtagagatgggctctcactatgttgcccaggctggtctctaactcctggcctcaagtgatcctcctaccttggcctcctaaagcactgggattacaggcatgagccaccatgagcccagccttttcacactttttaaagtggcttctggtaacctggacgttacctatgtggttcccgttgcctttctcttgggcaacactcagcactctccgatgagcacaaggggatggattcaagaacatacattgtagcatcattaaaagtaactaagaaaagtagaaaccagccttcatcttcatcaacaagagagagggtaaattgtggtttctttttttttttttttccttgagtgttacatttttcttttttttaatttaacttttattttaagttcaggggtacgttgcaggtttgttatataggtaaacttgtgtcgtgggggtttgtcatacagattatgtcgtcacccaggtattaagcctagtacccatgagttattcttcctcatcctctcccgactcccaccctccaccctcaggcccccgtgtgtgctgttcccctctgtgtgtccatgtgttcttatttagctcccacttataggtgagaacatatggtgtttggttttcttttcctacattagtttgctgaggataatggcctccagctccatccatgttcttgcaaaggacatgatctcttctaattgtggcttctttacacaatgaaatattgtgcaagagataaaacgaatgaactaaagccatgtgtgtattcgcctgggtaaattttttttttttataattttgtttttttttttgagatggagtctcagtctgtcgcccaggctagagtacagtggcgcgatctcggctcactgcaagctctgcctcctgggttcatgccattctcctgcctcagcctcccaagtagctgggactatgggtgcccgccaccacgcccagctaatttttttgtatttttagtagagaaggggtttcactgtgttagccaggatggtctcgatctcctgacctcgtgatccactcgcctcggcctcccaaagtgctgagattacaggcgtgagccaccgcgcctggtcccgcctgggtaaatctaaagaacagcacaatgagtgaccaaagcaggtcgcagaagactccgtgtgtacatacaggctttttgtttgtttgtttgtttgtttgtttgtttgagacagtctcactctgtcatccaggctggagtgcagtggcgcaatctgctcactgcaacctctgcctcctgggttcaagcgattctcatgcctcagcctcccgagtagctggaattacaggcatgaatcaccacacccagctaatttttgtatttttagtggagacaggattttgccatgttggccaggctggtctcgaactcctggcctcaagtcatctgcctgtgtcgcctcccaaagtgctgggactgcaggtgtaagccaccatgcctgaccatgcgcagatttaaagcacgcactagtaccaggaattggatgtggatacatgttggtataataaaaatataaaaacatgcatggacgtcgggcccagtggctcattcctgtcatcccagcactttgggagcccaaggcaggtggatcacttgaggtcaggagttcgagaccaacctggccaacatggtgaaacccccatctctactaaaaatacaaaaattagttggacgtggtggcaggcgcctgtaatcccagctactcgggaggctgaggcaggagaatcgcttgagcccaagagctgagattgcaccactgcactccagcctgggctacagagtaagactctgtttcaaaaaaataaaacaaaacaaaaaacatgtatggaaatgataaacaaccagactccaggtactgctaacctgtagtggagtaggctagaggcggggaagggagaaggggacctggaagagggggaacaccaggtcctttgtgtttgtaacattttgttactaggggtgggtatgactggagggtttggtatgattcaaattttttcttttttttttgagacggagtttcgctcttgttacccaggctggagtgcagtggtgcgatctcggctcactgcaacctccaactcctgggttcaagcgattctcctgtgtcagcctcctgggtagctgggattacaggcatgtgccaccatgcccggctaatttttatatttttagtagagacagggtttcatctagctcagttcatcatattggtcaggctggtcttgaactcctaacctcaggtgatctgcctgcctgggcctcccaaagtgctgggattacagatgtgagccactgcacccggcctgactggaatattttaacaaattattggatgaccaaagccatttttaagccttttggtttctagtcagaaagtttcagagaggctggatatggtggctcatgtctgtaatcccagcactttgggaggccagagtgagaagatcccttgaacccaggaggtcaagaccagcctgggcaatatagtgagactgtctctacaaaaaattaaaaaattagccaggtgtagtggtgtgcacctgtaggcccagctacttgggagggtgagatgggaacatcgcttgaacctaggaatttgtgttacagtgagctatgatggcaccactgtactccagctggggcaacagagtgagaccctgtttcaaaaaaaaaaatctatttcacagctgggtatggtggctcatgcctgtgatcccagaactttgggaggccgaggtgggcggatcacttgaagttaggagttcaagaccagtctggccaacatggtgaaaccctctctctacaaaagtacaaaaattagccagatgtggtaacgcatgcctgtaattccagctatttgggaggctgaggcaggagaatctcttgaacccaagaggcggagattgcagtgagccgaggtggtgccactgcactccagcctgggtgacagagcaagactccggctcaaaaaaaaaaaaagaatgtatttcaaagaactgcagccttcggcctctcaggtctcagggcacctgaccagctgtcctgccatctcccttctgtgccagctggtggccatgactggctttcgtggatgtgtatgttcctgaggaaagatgatttgctgtgcgtgctcctgtggggaggacatgcagtgtctgcctgggagaagaggcagctgaggccgtggcccggagtagtaggagccacaagccaccctgggcaggacgaggccctgagggaggtgagctttttgtacccgcaggtcgggaactcactcctgagcttcctgctgtccaaggaccccactgttttccagggagtcccttccaaaggtctcacccagctcagctgaggtaactcattttgccatttcttcatttttaggacaactgtcatctgggaagtaacaacgcaggatgccccctggggtggactgccccatggaattctggaccaaggaggagaatcagagcgttgtggttgacttcctgctgcccacaggggtctacctgaacttccctgtgtcccgcaatgccaacctcagcaccatcaagcaggtatggcctccatccggtcctcagaccttggtgctcagagagagagagagagagagagacacagatagacagacagacagacagacagatggacaggtggacagacggacagacagatggacagatgcactgcttttcagacttgggatcctcagatgagaattttaaaagataaataatggtttgtttgtttgtttgtttgttttgagacggagtttcgctcttattgcccaggctggtgtgcaatggcgcaatctcggctcactgcaacctccaactcccgggttcaagagattcttccgcctcagcctcctgagtagctgggattacaggcatgcaccatcacgcccaactaattttgtatttttagtagagacggggtttctccatgttggtcaggctggtctcaaactcccgacctcaggtgatccacctgcctcggcctcccaaagtgctgagattccaggcgtgagccactgcatccagccgataatggtttttttggtttttgttttttgagacaatctcgctctgtcacctaggctggagtgcagtggcatgatctcaggtgactacaacctctgcctcccaggctcaagcagttctcgtgcctcagcctcctgagtagctgggactataggcgtgcaccaccacacctggctaatttttgtgttttttagtagagatggggttatgccatgttggcctggctggtcttgaactcctgagctcaagtgatccacccgcttcggcctcttaaagtgttggaattacaggtgtgagtcaccgcgcccgacccaaaagataaatcacgtccatgagttgttgaaagacttgtggttgcgtccaattattccaatttcagctttccccatttcacagtgtatgtttccctctactcagttatccaattattcatgactagatgagattaggggctgcctcccacggtgggctttcatcctattcatgactgtgtcatcatttttttttttgagatggggtctcactctgttgcccagcctggagtgcagtagtgcgatcacagctcactgcagcctcaatctccccaggcttaggtgagcctcttacctcagcctcctgagtagctgggactacaggcacgtgccatcaagcccaactaatttttcgtgtctgtattttttgtggagatggggtttcaccatgttgcccaggctagaatgtgcctttcatttttgaaaccacactccatccatggctgcctaagtggtttacaggtcttttgtctttaaagctgttgccatagtaaacaacatctctttttctttttttttttgagatggagtcccgctctgtcgcccaggctggagtgcagtggcgccatctcggctcgctgcaagctccacctcccaggttcacaccattctcctgcctcagcctcccgagtagctgggactacaggcgcccaccaccacgcccggctaattttttgtaaacagcatctttggaaagagattttggtttgttgaataatattcaggatggactactgagtcaaaggattaaatatgtagacaatatttggtggatattgtcttgtgaccttctaaagggcttgtgccccttactaagcatgggacttgagggatcatgccttgggctgtgggagggcaggaccttatcccagaattttattttatttttatttatttttattttttgagacagggttcactctgttgcccaagctggagtgcagtggtgtgatcttggctcactgcaacctccgcctcccaggttcaagcaattctcctgcctcatcttcccaagtagctgggactacaggcacgtgccaccacgcccggctaatttttgtatttttagtagagacggggtttcaccatgttggccaggctggtctcgaactcctgacctcaagtgatctgcccaccttggcctcccttagtgctgggattacagccgtgagccatggcacccggcccttatcccagaattttaaaagctataattgggagcagggaaaaaatacgaaagaagtaatggatcatctttgagagttttttcttcttctcttcctggaagatgtctttaaaaattaagtttctttttccttccattggaagagtaatatggacacattacaatttaggaaaaggcctggcatggtggctcatgcctataatcccagaactttgggaggctgaggcaggagaattgcttgagcccaggagttcgagaccagcctgggtaacatgacaaaaccctgtctctacagaaaatgaaaaataaaaaaattagccagggccaagcatggtggctcacgtctcttatcagcactttgggaggcggaagcgggtaggtcacctgaggtcaggagtttgagaccagcctggccaacaaggtgaatccccatctctactgaaaatacaaaaaattagccaggtgtggtggtagatgcctgtaatcccagctactcgggaggctgaggccgaagaattgcttgaacctgggaggtggaggttgcagtgaactgagatgtgggccattgcattccagcctgggcgacaagagcgaaactctgtctcaaaaaaaaatcagcctgtgtggtggcatgtgcctgtgatcctagctactcaggaagctgaggcaggaggatcacttgagcctgggagtttgaggctgcagtgagccatgatttgccactgcactccagcctgggtgacagagtgaaaccccgtctgtaaaataaacaagcaaacaaacagacaaaaacaaacacaaaaaataaatgtaggaaaagtagaaaaaggaaaaaaattacctctgatccagccatatgagaaaaccacagtgaatactttggctattgcctgttttctcctctatgtacagtgttttttttgtaataattctgattatgacctttcatatctttttttctgagttaacggtataacattttattcatgttattaactttatatagataccattgtattttattttgcttgagaatggtctcactttgttgcacaggctggaatgcagtggcataatcctagctctctgcagccttgacatcctgggcccaagcgatcttcccatcttagcctactgagtagctgggactacaggcatgcaccaccatgcctggctaattttattttttattattattattattatttttgtaacggtggaccttgccatgttgcccaagctatagatagcattttagttttttatttttatactttttttttttttttttgagacagggtcttgctctgtcatccaggctgtagtgcagtggcatgatcacagctcatggcagcctcaacctcctgggctcaaatgattcccccatctcagcctcctgagtagctgggactacaggtgcatgccaccataaccaactaattttttattttttgtagagatggagtcttattatgttgcccaggctggccgtgaactcctgtgctcaagtgatcctcccacctcagcctcccaaagtattgggattacaggagtaagccaccgcacctgacctagatgtcattttaaatcagtcttatttttccatttacagagctgtgcatgtgggttattaaaattcaaacagtgcagaggcaaagcatacacatctcgatttggtcccaattcttcatatttgtatttatcccaggggccagatagtaaatattttagcagttgctggctggctctgttatctgttgcgatgattcagtcccgccaccataggacaggagcagccctgagtgatatgtaaatgaagaggcgtggctttttggggttaaccaggtggcaggtggatttagccaggaaaagggtggtttgctcacccctggtctatgttaattgatatgtttattaggggtttttttgtttgttttttaatggaaatgggcttgacccacacctgctgctctgtatcttggggttttcccctcacttaatgacacaccttggacccctccaggccgggcacatagagctgcttgacagtccctagactgtcacagcttggcgccatcccactgcttgacagaccatagttagccgttgccctttgtagcaacactgggaactttcctcctttcccgtcttctttgtgactcagtggtgaacacctttcaactgcttgttgctgtgggagggctggaggcccgtcaccccagggcacacactccatggagaattctctttgggcccccttgctgtgttaaatatttctgagttcgttgccaacatttaaaaatcagggttgccaggcgcagtggctcacacctgtaatcccagcactttgggaggccgaggtgggtggatcacctgaggtcaggagtttgagaccagcttggccaatgtagcgaaaccccatctctactaaaaaaaaatacaaaaaatttagccaggcatggtggtgcatgcctataatcccagctactcgggaggctgaggcaagagaatcacttgaacctgggaagcagaggttgcagtgagccaggattgcgccactgcactccaacctgggcgacagagtgggactccatctcaaaaataaaataaataggtgaagaactccaggacagttagctgggctgcatgaaggtcatggccccccgtctctggagtgacctagggtggtcctgcactctgggaggggagcctgtaggacgtggtgccagccccagatcccagcacctcccaggtgcccccacagaagggcatcagtggagaagcctgtccacccatggtcagcacccagggggctgcagagagtgcagatcttggggtctgcctctgccctctgggaggtttggacccccaggctggaggccagctctccaccctccctcagcctcccacctcccagtggctgccttgggtggaggggctgaccggtgactgtccctccagctgctgtggcaccgcgcccagtatgagccgctcttccacatgctcagtggccccgaggcctatgtgttcacctgcatcaaccagacagcggagcagcaagagctggaggacgagcaacggcgtctgtgtgacgtgcagcccttcctgcccgtcctgcgcctggtggcccgtgagggcgaccgcgtgaagaagctcatcaactcacagatcagcctcctcatcggcaaaggtagctctgccgagtgggccgtgtggccgggctggccctgcctgccccacccgctgacccagccctccccaccccgcaggcctccacgagtttgactccttgtgcgacccagaagtgaacgactttcgcgccaagatgtgccaattctgcgaggaggcggccgcccgccggcagcagctgggctgggaggcctggctgcagtacagtttccccctgcagctggagccctcggctcaaacctgggggcctggtaccctgcggctcccgaaccgggcccttctggtcaacgttaagtttgagggcagcgaggtgagcccatgcgtggcctgcggcatccaggctgctctgtccatggggagcacttcctctgtgaaactcctcagtcatccgcaagcccccctcccccagtggcatcagatggtgtttgccaggtgtctgtgcatgtgtggggctcaactgaacgtccccccaggcaagctcaacgtggcaggataaccaagtggcgtggggcattgggcatcagtttgttcattctttgaacaaatatttcccagtgtcatttgtgaactccccagaccctacccttgggggcaaataggcaaccctgccctgtgccccagaaccccggggggcctcgagggcagaggactgacctccctcctccccacaggagagcttcaccttccaggtgtccaccaaggacgtgccgctggcgctgatggcctgtgccctgcggaagaaggccacagtgttccggcagccgctggtggagcagccggaagactacacgctgcaggtgaacggcaggcatgagtacctgtatggcagctacccgctctgccagttccaggtgaggccgctgaggccctctgcactctgggctcccaacgccctggatagggcctgggtgggagtcggggagctgacatttgggcgcaccttgagcctgccgagccaggcctttgggtcaccgccagagcatcccctggtagggctggccctctctgagagcacaaggaggggctccgtcttgggaggtggaggtggggcaggaaaaaccagcaggaagccctcccctctcccaaggcctaggacaggcagtgggcagcttggggggtcctgggaatcctggtgtccagggagtggttggggccgccccaccagccgctcaccctgcaccccgtctcagtacatctgcagctgcctgcacagtgggttgacccctcacctgaccatggtccattcctcctccatcctcgccatgcgggatgagcagagcaaccctgccccccaggtccagaaaccgcgtgccaaaccacctcccattcctgcgaagaaggtgagatggcgccttccgcctcccctctgagccaccccttctttccacctggcgtccaactccatgtgctactggccatgggtccaggggcccttggtatggagagctggggctttgagctggggaagccaacacagctgaccagcgtcctgggctgggggcctgtgggactgccgtgggtggggggcagccccatgcctggctcaccggctgcccttcccctctgcagagctcaggggtgttggggccccctggggagcccgcatggcaggttttctgggaaaggatagcattgtggacaggcccaaacctggccgcaaacctgtgaccctctcacccgcccccaagtggtcacgggcctcaccataggccagggagacaagctgcactttgagccgtgttaacagccctgcttccccggcccccagccttcctctgtgtccctgtggtccctggagcagccgttccgcatcgagctcatccagggcagcaaagtgaacgccgacgagcggatgaaggtggggctcctgggataggtgggagagacactgtttttttgcacaaacaaggtggctgtatcctggaggggtagcagaggaaggagggggatcacatgaaagccacctgaccacattacccagcatccctgcctggggcgctgtgagcggcttgaaaacaggaagtggggagggggtgggccagccggccctggaggctgattcgtagaaacttgggccaagcagcgttctgggtatttgactttggtggaggttatggggccaggttcagcccagggatccgggaccgcagagctgggggaagggccgggcatggaagaggggctgggtccagctgggctgggggctgtggtgctccctggaggcaccagggcggtgcctgcagcctgtgagggctgcacctgcctcaacctctaggggctgagcccacctccctgttgtctcttaacactttcacacgctccatcgcaacagcctgcagtcatgggctttattgtcctgtttgctggacatgatacctgagtcctcagaggttggccctcctgcctggagtgtgtttcactggggaaatcgtataagcagggcaggtctgggttccactggcaggaatcgagggggactggatcagagggacttccagggtggtggtgtcaggtggaattggaaggggccggacatcaggtggcaggaaaagtccttccccacccacatgggctcataggaatctgagaagtccagggagccctaggatgttagagcaagggtccctgaagttcttgatccctgatggggaaactgaggcctggagtggggaatggacatgccccgaggtccccagagttggggtagctgagacagggcacccatgcacagcccgtggtaccctccctcaccccagggccgctcatgcccctcaggccttccctgtgctgcaccaccttccttcgtgtgggaagtagagttcagacccacctgaggacattcaagggggagactgacaccttaagggggaggggagaggggctgggcctctgcctcctcacccatcatcccggcaccttctacagctggtggtgcaggccgggcttttccacggcaacgagatgctgtgcaagacggtgtccagctcggaggtgagcgtgtgctcggagcccgtgtggaagcagcggctggagttcgacatcaacatctgcgacctgccccgcatggcccgtctctgctttgcgctgtacgccgtgatcgagaaagccaagaaggctcgctccaccaagaagaagtccaagaaggcggtgggtcccagggccggctgggaggggtgcagaccccggagagccagtacagccccttgctgggccactcaccactctcctcccggcaagcacgcagcctggggatgggggtcctgggattgcttgtggaccccagcctcctcacccaccctagtctggccaccagccctgctcgagggacactctgggctcctgggctcctgtgcatgcggcctcagaatatctggcctgggctgtggtcctgcaggaacctgcaggtagtgccctgggatggaaggacaagcacagtgtcatccctggagcagaaaagcctgagtcagcggctggccgggaggcgtagtggctgggtgctgagtcacggtcccaggatatggctcccctcggagctgactcactccgagctgagctgggctggcctctggggctgggctgtctgtttggggatttctcaagaagccaggagggccaggcgtggtggctcatgcctgtaatcccagcactttgggaggccaaggtggtcggcttacaaggtcaggagtttgagaccagcctggccaatatggtgaaaccctgtctctactgaaaatacaaaaaaattagccgggcgtggaggcacatgcctgtaatctcagctacttgggaggctgaggcaggataattgcttgaaccaaggaggcagaggttgcaatgagccgagatcgtgccactgcactccagcctgggtgacagagcaagactccgtctcaaaaaaaaaaaaaagcctgagtaggggtgaggtgggaacaggagggtgcagcaggtgtcagctggcttcaccactggagccctcagaggaaagaggaaaaagcggctcctctccttccccaagcagggtctcccaggggtctggttgggagatgttagctgggctctgggtcttctcgggtggggtgcctgggggagggcagggaagctgggtctggaggcccctgagtggctgtcctcacctgccctgtccttctgcaggactgccccattgcctgggccaacctcatgctgtttgactacaaggaccagcttaagaccggggaacgctgcctctacatgtggccctccgtcccaggtcggcccaggcccaggagggagaggcgttgggagtgtgagggtcccagagatgctggtcacccctctacaacttcatctgcccctgtgttcagatgagaagggcgagctgctgaaccccacgggcactgtgcgcagtaaccccaacacggatagcgccgctgccctgctcatctgcctgcccgaggtggccccgcaccccgtgtactaccccgccctggagaaggtcagtgggggccccgccgcgtgaggctgaggggctggcgcggagctctcctggccctgctcctggagctcttcagagggtgctccctggccacgtcggggctgggctaccaggcatatctggggccttcccaggggccattttgcctgcagggatgctgcgcagtctgatgacattttcggttgtcacagctgccaggagggatgctcttggcatctcgtgagtggaggccagagctgctgtggatgcgcctccatgcagaggacagcgccccctcaaggatgattggggtggcaatgcccggcctgggggtcctgcccgggctggtccaggcccctggggacgctgagtgcagccgtttgttgcagatcttggagctggggcgacacagcgagtgtgtgcatgtcaccgaggaggaggtgagtggggtgggggtgtggggtggggggcatggagccggcgtggaaccagagccctcactcctgcccacacccctcagcagctgcagctgcgggaaatcctggagcggcgggggtctggggagctgtatgagcacgagaaggacctggtgtggaagctgcggcatgaagtccaggagcacttcccggaggcgctagcccggctgctgctggtcaccaagtggaacaagcatgaggatgtggcccaggtgggtggggaggcgcacctgggggcggagctgggggcagaccacagcctctggctacccaccaccctgaccccggccaacccccaccctcaccctggccaaccttcaccctgaccctggccacccaccaccctgaccctggctggccatcacccttaccctgaccacctccaccctgaccccggccgcccccaagcctgacctcggctccccccagatgctctacctgctgtgctcctggccggagctgcccgtcctgagcgccctggagctgctagacttcagcttccccgattgccacgtaggctccttcgccatcaagtcgctgcggaaactgacgtgagtcccagctgggcgctccccacttctccagagggcagctgtgtcctggctgccaggacgtgggctctgggtggggcctgaaccttcccgtgggcttgctccctcctgcctggcctccctctggctgccgagggagctccctcctgtcctgagtcggggagctccaggccccagcgccttccttccctgcagggacgatgagctgttccagtacctgctgcagctggtgcaggtgctcaagtacgagtcctacctggactgcgagctgaccaaattcctgctggaccgggccctggccaaccgcaagatcggccacttccttttctggcacctccggtagcgggacttgccccagccgttctgtgggaatcccagcccctgagtctccctggaaggccactggggacgtttccagcaggcctgggtgtcctggcctcgctaggtcctgctgggcgggaggggctgcgtggtgctgcctggtgaggctcagccctcccttcaccttccagctccgagatgcacgtgccgtcggtggccctgcgcttcggcctcatcctggaggcctactgcaggggcagcacccaccacatgaaggtgctgatgaagcaggtgaggcccaaggccctggggggcgggcagggggcggccctgagcgtctgggaatccccagggctgggtcgaggctgggacctgcccaccgccgccctcccatctgcccaccagggggaagcactgagcaaactgaaggccctgaatgacttcgtcaagctgagctctcagaagacccccaagccccagaccaaggagctgatgcacttgtgcatgcggcaggaggcctacctagaggccctctcccacctgcagtccccactcgaccccagcaccctgctggctgaagtctggtgagcccaagccccgccacaagggttcctcccacccctgggaggccggtagaggagcccctgctgactgcccgctctctggcctggcagcgtggagcagtgcaccttcatggactccaagatgaagcccctgtggatcatgtacagcaacgaggaggcaggcagcggcggcagcgtgggcatcatctttaagaacggggatggtgagggcctggcctccccacaccccgcctgtactgccctggggggtcctggggtgctcctagagtgggggtggagaagacagaatcctgggacttaagggcttgggtgtagctggaagcagagaacctaccagaaactcacgcttctcctcccaccggccggtggcacagacctccggcaggacatgctgaccctgcagatgatccagctcatggacgtcctgtggaagcaggaggggctggacctgaggtgaggacccccaccccacatcgtcccttggtgtctgtgcccagcctgggagtctgtgcccctggaggggtccttgttgaaggtggcatgaccatctcagccggggaaagggctttcctaggaagacccggaggcggtttaactctaggccaggaggcggcgggcagcaggatgcgtgaaggctgctcctgaggcttagtgtgtaccctgctctgttgctttagttgcccaggtgcccctggcttccccagcccatcttgggaagcagtggcgtcttctcccaaggcctctgtctggttctcttccaagcaaatgtgaactcagctgtggtgctttctgcacctcagatgctggtgccggcatctccaaggagccagcatctctcacctgctttttagcaatgtgggcagcagcatcttctgtggctttttggggcaccatgagtttctggggctcaagtggcctcagggacagcccttgaccatgccatttgcccgtccctcttcccccttgcctaggatgaccccctatggctgcctccccaccggggaccgcacaggcctcattgaggtggtactccgttcagacaccatcgccaacatccaactcaacaagagcaacatggcagccacagccgccttcaacaaggatgccctgctcaactggctgaagtccaagaacccggggtgggtttcaggcccagggataggttccctctcctttccaagaggtgtggagtgggagggcctcgcctgtcagaacaaaggagcggggaggggcctcagaccatctttgtggctacttggctcagttgaggaccagcctgtgtctgggttggggtgaggtaggtctctcttccccaagtatcagtgtctcttgctatgcaacaccatccaaagcgcagggctttaaaaaacagccatttacgattggctcacagatctgcagctggggctgggctcagccgggtggcttttctgctggttccacataatcactcatgcagctgttctcatctggtgccttaactgggccagtggggtctgagataacccatctcattcctggggccttggcgccagctgtctgtgatgcctctctgcatgtggtctcctcatttagcagcctcaccttccttccgtggctctgtattgagggtatggggttcaagatctgcaggggtcttcatgccttggctctggaatagcgtctgcaagcgatgtccagcattgtgtcctccatgttctgttggtcaaagcaagtcacagggccagattcaaggggagagggagtaataacccacctcttgataggcggagctgcaaaatggtatggccatgctttttaatcttccccacccagggaggccctggatcgagccattgaggagttcaccctctcctgtgctggctattgtgtggccacatatgtgctgggcattggcgatcggcacagcgacaacatcatgatccgagagagtgggcaggtacaggggctggtgctggcggctgctgtggggacttggcttctggccccagcctgctggcccctctgcctagcacacagctctgtggcaggggtcccccagccctgctggcttcctgtctcccctggattctctcctgtctgacaccttctcaatcctccccctcctctcccctcccctcagctgttccacattgattttggccactttctggggaatttcaagaccaagtttggaatcaaccgcgagcgtgtcccattcatcctcacctacgactttgtccatgtgattcagcaggggaagactaataatagtgagaaatttgaacggtgagagtgcctgagccccaccagatgcccctcggtgtggggccccagggaacagggcagaggttcccaggcagggtgcaggatggggctcaggtctcaaccccacacctggcccctcaccccaactgttgatgggtttggaacatgcccctgctccaccctgcagtgccccttttgggcaatgtgggcaggtttgtgggtcatgtagcaggaggctggctggggcacgggggtcagttagcagaactggaggccttgtgtccacccattatcagggcaagggcaggtgtccttggggaaggggctggttggatgcagagcggccctctggcctgtggctgggagttcccagagcctcacttcctctgtcccctacctgcaggttccggggctactgtgaaagggcctacaccatcctgcggcgccacgggcttctcttcctccacctctttgccctgatgcgggcggcaggcctgcctgagctcagctgctccaaagacatccagtatctcaaggtatgtgccgggcaggagactgctgtcgccagtggacttccaaggcctgcccccgagcaatgtgacctaggagggccctgaatgcagtaggccccaaagggcactgagctgtgtgtgcctcatgccgtcccaggacccagcagtggagctggtgggcggtggaggggaaagtggctggaccagagttgagccgcccaggcatggttccactcagtggcagatgtgtagtgacctctcctggttggggtgctgtgctcagggctgcggggctttcaggtgtccactagggggccgcgtgagcgctggctccctctgccttctaaaagatattttttggccaggctgggtggctcacgcctgtaatctcagcactttgggaggccgaggtgggcggatcacctgaggtcgggagttcaacaccagcctgaccaacatggagaaaccccgtctctactaaaaatacaaaattagctgggcatggtggtgcattcctgtaatcccagctactttcgggaggctgaggcaggagaatcgtttgaacccaggaggcggaggttgcagtgagccgagattgtgccattgcactccagcctgggcagcaggagcaaaactcggtctcaaaaaaaataaaaataaataataaaaaaagatatttttccaggccgggtgcggtggctcacgcctgtaatcccagcactttggggggctgaggtgggcagatcacgaggtcaggagttcgagatcagcctgaccaacatggtgaaaccctgtctctactaaaaatacaaaaattagtcaggtgtggtggcacgcacctgtaatcccagctactcaggagactcaggcagaagaatcacttgaacctgggaggcagaagttgcagtgagccgagatcatgccactgcactctagcctgggcaacaaaggcaaaactccgtctcaaaaaataataataaaataaaaataaacataaataaaagatatttttccaggctgggcatggtggctcatgcctccgtaatcccagcactttgggaggctgaggcaggtggatcacctgaggtcaggagtttgagaccagcctggccaacatggtgaaaccacatctctacttaaaatacaaaaaatcagccaggcatggtggcacatgcctgtaatcccagctactcatgaggctgaggcagaagaatcacttgaacacgagagactgaggctgcagtaagcctagatcgcgccactgcactccagctcgggtgacagagcaagactctgtctcaaaaagaaaaaattggccgggcacgatggctcaggcctgtaaacccagcactttgggaggccaaggcgggtgaatcatgaggtcaggagatcgagaccatcctggctaacacggtgaaaccccgtctctactaaaaaatacaaaaaattagccaggtgtggtggcggctgcctgtagtcccagctacttgggaggctgaggcagaagaatcacttgaacctgggaggcggaggttgcagtgagccgagatcatgcccctgcactccagcctgggcgacagagtgagactgtctcaaaaaaatgtatatatacagatacatatgtattttttttccttcttgtgtcctctccatgtgagaaggtgggatggggcggtgaggctgctggggccacacatgcttgccaggaccttccctctggtgaccagtccctgcaaaagcagctgctcccatgctcctcccagagccatttctccagtaggggaggcgaggtcacttgggaactgggggctctggggccaagatgtctttggcaccttcatttgagggtgggagcggaatagagagcttttcctgagatgctgggagctctctactaaccatttcattcagtgactctgaagtccccagagagggacgcatcccagagcaaggtccgggcccccttaacgtggacaccgctgtgatttgtttgcaggactccctggcactggggaaaacagaggaggaggcactgaagcacttccgagtgaagtttaacgaagccctccgtgagagctggaaaaccaaagtgaactggctggcccacaacgtgtccaaagacaacaggcagtagtggctcctcccagccctgggcccaagaggaggcggctgcgggtcgtggggaccaagcacattggtcctaaaggggctgaagagcctgaactgcacctaacgggaaagaaccgacatggctgccttttgtttacactggttatttatttatgacttgaaatagtttaaggagctaaacagccataaacggaaacgcctccttcatgcagcggcggtgctgggccccccgaggctgcacctggctctcggctgaggattgtcaccccaagtcttccagctggtggatctgggcccagcaaagactgttctcctcccgagggaaccttcttcccaggcctcccgccagactgcctgggtcctggcgcctggcggtcacctggtgcctactgtccgacaggatgccttgatcctcgtgcgacccaccctgtgtatcctccctagactgagttctggcagctccccgaggcagccggggtaccctctagattcagggatgcttgctctccacttttcaagtgggtcttgggtacgagaattccctcatctttctctactgtaaagtgattttgtttgcaggtaagaaaataatagatgactcaccacacctctacggctggggagatcaggcccagccccataaaggagaatctacgctggtcctcaggacgtgttaaagagatctgggcctcatgtagctcaccccggtcacgcatgaaggcaaaagcaggtcagaagcgaatactctgccattatctcaaaaatcttttttttttttttgagatggggtcttcctctgttgcccaggctggagtgcagtggtgcaatcttggctcactgtaacctccgcctcccaggttcaagtgattcttctgcctcagcctcctgagtagctgggattacaggtgtgcaccaccgtacccagctaatttttgtattttagtagagacgggggtttcaccatgttggctgggctggtctcgaactcctgacctcaggtgatccacccgcctgagcctcccaaagtgctgggattacaggcatgagccaccgcgcccggcccactctgccattgtctaagccacctctgaaagcaggttttaacaaaaggatgaggccagaactcttccagaaccatcacctttgggaacctgctgtgagagtgctgaggtaccagaagtgtgagaacgagggggcgtgctgggatctttctctctgactatacttagtttgaaatggtgcaggcttagtcttaagcctccaaaggcctggatttgagcagctttagaaatgcaggttctagggcttctcccagccttcagaagccaactaactctgcagatggggctaggactgtgggcttttagcagcccacaggtgatcctaacatatcaggccatggactcaggacctgcccggtgatgctgttgatttctcaaaggtcttccaaaactcaacagagccagaagtagccgcccgctcagcggctcaggtgccagctctgttctgattcaccaggggtccgtcagtagtcattgccacccgcggggcacctccctggccacacgcctgttcccagcaagtgctgaaactcactagaccgtctgcctgtttcgaaatggggaaagccgtgcgtgcgcgttatttatttaagtgcgcctgtgtgcgcgggtgtgggagcacactttgcaaagccacagcgtttctggttttgggtgtacagtcttgtgtgcctggcgagaagaatattttctatttttttaagtcatttcatgtttctgtctggggaaggcaagttagttaagtatcactgatgtgggttgagaccagcactctgtgaaaccttgaaatgagaagtaaaggcagatgaaaagaaagaaaaagcctttttatgttcttttatgttctcggctcaaaaagaaacaagggagtgtaggtttaaaaccaaaacaggagagaagacaaaccccgctccggctggagttagttagaaccagaactttattgtagcggatacactttctgacctatcatgagtatacacatctgcgaagggaaaccgcgcggcgaca

SEQ ID NO: 182 - DNA, 145935 bp, Homo sapiens
gctaactgcgccccagtttctttttattgatttcttttcttttctttttttaagtatggaggctcaagtataagatgtagatttttttcttaagctttacaaaaaaacaaaataaaacaaaaacctccttttgcattccatagaaattgacagaaaagcacctggccggaagagcggaacggtcggcggcaccccccccagcccccaccccgcggcctccgtgggacgggagagtctgcgcaggacggcaccgagggccacctctgctcccagagctgtcccctgtccccacgacccccaaccccaagcaactcccaaacacacacggaataagatttccagtttttcttctctctttcacacaccacagttagttcataaaatttttttgttttacattttttacaccaatgtaccaaaaaggtgggagggaagggaggctggcagacagtggattttatgcctataaatggggggacagggaggaagacggggggcccgggtgaacaaaaaccacacggtctctatggaaatgtggagagaactgagagcgaggtgtggcagaagcaggctcggagccggaggagggtggctatcggctttattctcagggagagatggcgctgtgcggtcaatgatgcagctgttatgtgacctgtcggggagggaagggacgagggaagggagcagaaaacgagttttctaagaaaggaatctaacgagtgcacggcgtgtctggttagcatgaaacagaggtttagcattgctgctttctcttcaaagcctccaccaggtcattcttcagagcttcttgttttgatttgtctgcaaaagtctgcacagacctgcaagggaggaaaggcgttatcagcagattgaacagggactggtgaggcggtggaggcctgggggccaccatgccagtgcctggctgatttgctgcatggacccgcttcctggggtgaggctctgggtcactgggctgggcatctgcccctctcagaaaggggcaaaggggtacatggccgagacctgcaccctctgcaccttgccaggccctgtgggggtggcatatggcttacatggacaggtgctcatctctgcccctggccaccggtgacccggccatagtccctagaaccctaagttcactcctctgtgtgtaggtccctatgtcaccctaagccacaaggtggcttctgggcttccaaacacaatggaacaaagcccctctgcttcagaacagctaccctgggttgctggctggggactcaggccaggggctaagaggggaggactccggggccatgcgggttcctctataaaagcttctcccttgcccaggccctgcccagcagaagagcctcattcctcatcccacaagtgcaaggtgcagcgttatcccacccttgggagtgggtaagaaccagtgtctctgcgtgtctgagcacactgtgtttatggcccacgcagcaggtgctttcaggcctctgctgtgaggcaccatccgctgttaacttggcccagaaaacccctcagcccggattgcaaagggcggcacaggacagccaagtgcccctgggatccctgctgtcaaattctggatttgtggggaaacgttcagggcgaccgcattcacgtatgtgtggggacgctcatcaacaaagccagaaacaatgaaggcttatggagatttcacagtttacaaaacgcctttcacatatattatctcatttaattttcacgggcatcctggggaagtctcaactatcaacccggccggatgtggtggctcaagcctgtaatcccagcactttgggaggccaaggcaggaggatcatttaaggccaggagttcaagaccagcctgggcaacatagtgagaccccatctctacaacgacaacaacaaaaagcgaagtcaaggcttaaaaaagaaaaaagctatcaacccaatttacagatgaggaaactgaggctcagaggaatgcccccctagcaattctttaatcattttgtcaaatttacccaacatattggttaggcaaagacttcctaaatgtaggttttataacagtttagaagcagtggaaagagtgggtagagggctgctcaagaagagtgctacggagagtgcactcagccggactctcacgtttgattcacaccagccatgggaaggaagaatcagaaaaatcaatccccagaagcaaaaatgggcaaatggaagtgaagcagggcccaggagaagcaacagcacccagactgagttctggctaccgaatccctacaagtcacaggaagagccctcaaaatactcagcaggtgccataagacaagacctggaagcaagctgcatacaactgaaaaaactcccaggagaaacgcagacatttggttcatgctggggaaatacacgtttctgagtatcttcccaggactgtccctggctctgcggcggccaaaggcatcagcccccacggcccccaggctccaaatctcagccgattccccaggggcttcttgccaagctcacagcgggaggtcaacatggccagcgggagatgcggcgggcaaagcagcagcgcacaggacctctagcctgggtggtcactggctcttctgggaaggaagagccaagcccgccaggtcttggctggatcacacgaaggagaaagttccagagctagaatcatgttagacacaggaagttagaagtgaaatggtggaaggcggaaggagcagggggcttatttaagggacaatgcttgggaaggtcacggccaagcaacctcgaatcagcgcttggagacagtgctcgactctgtgggagggaggagtcatcttgagcagacctggctgccagggtttctacgccaggacgcccccagtgggcggccagggaactgcaccatcacggtgtatcttaaaaagagttttttctcaatgccatgatggaaatgcctgatggccacactgtgaggctgacccgagtcgtgggccttaagttggcacacacagaccagactggtgcacttaagtcccacggcctcggaaaagcagctccacctggttttctaagtgcctgaccccacctccaccttggaaagtctgctgcaccccttctggggtgggccttcagtgcgcagcccctggacctgggctctgcagccccagttggcagggttccaaatgccttctttttacaaacaagtttccctcctactctccagggatgctgcctccttccctacatctggatctgtcacaagctcaagtcatggttcttggccattaccaacaagcaagactattttcctttccattagcgaaacctgtttaaaggaacagctgcagctcgttaggggcggaaggttatgctggttgtggccgagtcggcactgggcgtccaggcagctccagcagagcatctgggccagccagggtggagtccagccctgactctgccctccaaccccagagactcagagatcagagagtgaggtcaccccttccaagccagctagccctggacaggcaatgtgccgctgagcagcggggaggcttatgtggcttctgggatccctgcaccagcatcagaggctcctctgaagcatgggggggtggacggcaggcagatccctgccctggggacagtcaggccggtgcacacaagtggctgctgctggagaggcagcatccgtcccttggcctgggcttcttcagaagcaaaagccaaaaaatcagccgtcttccccacacccagcctccacccagagtggaaagcacacacacgtgataggtgccgtgttacatggggccgaggctacacgggaatgtggctgtgcaccgaccgggagcacacgtgggggttagtggtggtttaaatggccgcggagcagcagccggaccggcagggtctcggcgggttggtgagtcctgttttagtggggagggtctcgcggctctcaggcagggtacctggatcggcttaattatcaggctggatgtagatctggcgctgggtcagcacttgagagagctccctctgcaactgcttaaacttttggttgtcagggatagcatcaatagatctacagagagtgttcaagatgagtggagtgggagggaagagaacgacgagaagccaggaacgcagggggccacagctgaggaggaaattcagggagacccacgaggcggaaggggggatgccgtggcggctctggggtgtggagtggtatcgccgctgcagaggtccacgctggcggtggtcgtggtattcaggggctcgccaccaccacccgcaggctcttcggcttctctcccccacttcccagccactgcctggggactgtgcaggttggctgggcgggaaagtgtgtttggtgtatcgggcagtggctgccagtggcaggcctaacgccagggaccactgggctctaaccctgtcacaggtcacgaagaccaagcctcccccaggtgggcaggggatcagaagacaagggtccaaagaggactcctcctctgttttaaaactgtaaagcaggtgactgaaatctgtcgcccaccccagtccacgagctggggcagccccgggactgcagcctgcctctcctctgggctgggctgtgagagctacaccacggcagtgggtgagagggctggccgctaaaggcatagcacagcccgactcacacggtgctgctggactgcagagcgtgttctagattcatcatctcagccgaccgtgcctcctcgactggacaagggcctctgcgaggagtgccagaggccatgcagctcgggatgacagagcttaggggagatcccggcctcctgactctcctgactccaaggccagtgctccctccacagccgtttactgcccccagctgggctctggcctcatgtcagaggcctgcctcctgctctgtccgccgtggacctggagggtccagagagcgcccggcttttgtttgggctgacactgcagagctgagggcacgaggtgggaaggatggtgcaggacactggccactggcagcagagccctggcagaggacgtcagagaggctggggccccctgagaacgcccaggctgagggccctgcctgcatgtggcgtcagggaggctgggggcctgagaaggcccggactgagggccctgcctgcacgttgcgctctgctgtctcggagagcaggccagccagaggcagccgggctgcccggaatgtggtgtcatggctcccctaggcccaggctggagggtggggagatttttgagcggggactgacaaactgcagggctgaggaggctccgggggcaagggcaccaatggctgttagggtgaacatgccccagaaaacaaatggtgcagatagggaccgacagctgctacggagagtgcagatgacacatcaggactttactttccaaaatcaacataatgatcatcccagaagaggggcactgcagcctaccaatgaggacaccgaggcccaagaccacacagctagtaactggcagagccagggttcaaatccctctgtctgcttctaaagcttgtgctttctggtacattacctcagcccattgacgatatcctttgtttttccaaagtagatctcgttcagcgtacttctgattttattttccatgtcctggaagggaggtcggtcagcgcagtggcaaaaggtcaggaaccctgaggcccacgccctccctccacctgccagccctgcagtccccagtgtggccactggagggtggcacacgcctgctctggggcatcagtgagcgcgctccaggctgccaagaccccacctgccatctgtgctcccggcaccttcccatccacagtccacaggcagggaggaagccagtacccagggattggcggccagctctgcccatgcctgggagctgctctaaaccacatcaccaccccttgggctccccactaattttgtgaacaattctgtgaaacccgagagcacctccctgccttcccaaacaacgtggtgacaggagggccaaggcagccgcaactgaagccacaccagggcccactggcattcctgggatctgcttcctctcccagcgcagggccctgttcacacccaggcgatcaggggagacaagacctagtgcgccccagagccagcgcctgagcagtcttctgggagcccaggtctgggggtggagcaggaggtggccctgaagctggagcctgctggcatccaaatcagaggctccaaaaatatgaggccagggcaaaatccaagaagcgctctgccggctgcggtggagctgagagaaagcagcagagaaggaggccagcacagcggctccggggctgcagtgtcactgctgtgggtcactgcaggagccagccagagcccaggtcactcacctctaccaggcgcccgatgttggctatgtgtggggagcagtcactcacagtttcatccttctccatctgcaaaagacagaaacattccaagtcagagaaagccagagatttctgagaacggcagacagcccaccccacctccacggtctgcaaagagcctactgttcccaccgtggagccagctgcaggtatgacaaggccagttttgcagcctgggaactgaagcacaaaccgacttcagtttcagaccataaagagcccagagggcagaagcccagagtcccacttccaagggagaagattttgctgctgcccatggtagagcaggcagatgcccagagccacagcagcagcccttggcaggcaccagctcacccgagccaactggagaagactcactcggtttgtcttcaggcctctactggcaggcccaggcccacgctgggccatccaccccaggttcagggcctgacactgcaggggaagcttctgtgctgctgctgcgccctggcgctcccaaatggtggctttggggtgccatctgctgcagtctcgcagggagggacagacaacctctgacggagacttcaggccagagggattcagtggctcaccctagtcatgcaggtggcaatggcagagcctgggtcaaacccttcctcgcaccagggcctgttcgttctactctgcgaggagagtttgagcaagagagtctcaatatagactctgaggttatgaggggggcagcagcactcaagccccatctcctcttcccaagcccaggaagagctggctctgacccaatcatctcaactcggaggagggaggaaatggaggcaggttagggtagaaggaattcggcactttcccccgaattttttcttatctgaagccttatttccctgacaagaatataaattctttcaggagagatgtgcctgcctcataacgcacagggtacctggaagagtgctaggaacataaatgctcaacgttactacactgaaaacaggaatacgcagctacgatgactaatgttgttgaaataaaatgtggaagctgaaataaataatcaagaaagaggaagaaaagaacagcatcagaaagggtagagtagaaaccatgcaagaagtggccatcaaattataatacaaaaatgcagtactctaaggctaagcatttattgttgagattctaaatctgcttagacattatttataatttttgaagctttattaaaataaaataaaatttgtgagagaagctaaaaaaaaaaaaaaaaaaaaaaaaaagaaagggtagagttcaaaatgagaccaggcccacagaagaaaaaccagcaaaaggtgggttcctctctttggaaccaggagaacagggtggagtctggggggagatactgtctcagagggtacgggctctgttgcttctcacctatttctacatctcctcatcagggagactgactttcaggctgtgaaaggtggaaccaacctggttaagagcggggtgagcagagggcaggagagaaccaagccactttaaacgaccaggcttccagggtcgggcaaaaccgacctgtgattgaaatccttgacactgggggcggcagcactgacccgacttttgtctttttttttttttttttttttttgagacggagtttcgctcttgtcgcccaggctggagtgcaatggtgcaatcttggctcactgcaacctctgcctcctgggttcaagtgattctcctgcctcagcctccccagtagctgggattacaggtgcccaccaccacgtccggcttttttttatttttatttttattttttatttttagtagagacagggttttgccatgttggccaggctggtcttgaacttctgacctcaggtgatccacctgcctcagcctcccgaagtgctgggattacaagtatgagccactgcacctggccgacccaacttttgtcaaaaaaggaagaatggcctctgcaaggaaacgctagctcgaaactgatccagacaacaatttttgatgggatcgttaaaatcatctgctggcacattttaaactcagagatcatgaggagccagccaggctcactgtgaacaagccctgcacgagagcacttcttttcctgttttggtggggatgctgggctggaagaaaacacaactacttaaatagggtcgcatccttctggcaagttcccatctaccatcctgcacctgtggctgagaggaagggcaggatggagcctctgccgataggggtagggacctggccacatttccacagccccccacccactcccctccacacctggtcagggtcagctcgctggcaacaccgacccaccaaaaatagaaccatttgtgcactgcatacactatgtggcaccctgtagcagtctctgcctgcccttggtcaacttgtttgtccaggacttaagtaaaggcccagctgagagaacgaccagcttcctatcgacagtgtcaagggttgagatggtcacagggttaatacggaacccggaaacctgggctagctacagaacgagagcagcaacttggaatggagccaggcggcagccacctttttccatctcagcttcctaggaaccctgttttaaacccaaggaaaccgaagcttaaagaagcaagaatcatacagcactgttagattccgacgcctttgctcctcctacttcaccacgccagttaaatgtaccagggcaaatgcaagccagatatttaggctcaagggtgcatttcatgcagtacaaaatggggaactgctgacttgcaaacagttcctatgaagagacttgtggtttttagataatttcaagtttgacaaggatgagatgtcgctactaggaaagcttttgtgcaactttaaggtgcacagatgacactattccttgtgcccagataaggggcagcattcccaccccatcgcgtgatgaagacactgcagctgccagtttccattgcttgcttgggaaggcagtggttaccctctgttctgtcctggcccagctacatctgcagggctggattcagtttagggcacttttttttttttaattttcttttaaaagacaaggaggtcttgctatgttgcccaggctagacaggaactcctgcaatcctcccacacagctgtaactacaggtgtgtgccactgtaccctgctaaggcactgggttttaaaagccttgaatgagttagcattcatctgcttaaaaggtctgaacaccctgacaccaagaaatgggagagaactagggctatccaggcctggcggtggtgggtggggagggatgtgtgtgtgctaggggagacacaagagattctggcagggctctgaaggcctgctgtctgccaggggaacagacccaacctatgtcgctgtagatggcagaggggggaccgagcagtgagagaacatcacggctcactgggctggactcggtctgttctgatagagctgtccctgacaggcatctgctcacaaagcaatgtggtctgggagaccgacgggtctgagaaaacgggtggcatctgacaaggggggggggcggtctaggtgagggcaacagtccagaacctgctgcctcccaagtcataacagtaaatatctgcagaaaaaagacatctggttctggcaaggctgttttactgaggactagtggaaaagagggagagaaatgctagaaagaccggcttctctgctcccatctgtcttggcatgctctggcaagtcatcctgaggaatctcgaccctcagaccccagggggtctccataaaacaggagtagtgagagtgcccatgagcttgagagtcacagttctcatttcaggtctaataaacacaccaacctcggcagcactggagcgtctgctggaacatcatctttatctgccactagcaaaaccctggtgccaagacgacggggtgggctgtctgctcaacaggagctggggagcaccctcaggagggagggggctccatccacccagcttcaaaaagaacttttgcatgctggcccccggggactgtgtgttctcccagacgtgaaggtggttactgtgcctaggctcagggctgggtggagtcagctcggcaggcagggaagcctgggggttggatggaaatgaatgaggtccttccagcaaatcagagtctctcctcctccccggctccatgtggacggcagattcccggccaccctagggaagggatgagggttttgagctcactgtgggccccattttaaatgggcaccaacagcccaaagagaggccgcggccatcggcaaaggtcctgggtcacctgggcaagtccagtcacatcagcaatttggcctcttggttaccatctttgtgtttcagaatcaagagccatcttaaaacaaacaggcgaaaccccttggccaacaaaggtaggagaggtcgggtggaggagagggctgggtcttgcagtgtgcgacactgtccccaggagcagactgatcccctagaacacaggccccctcagcccatggcagggaagctgagcccacgtaaatggccacgcagcggctggggagggaaggagaaaggtgcttggggagtgaggggcacagggctcggtgcacccggccgtatttccacagcccccttgcccgcccctgctcactcccctccacacctggtcagggtcggctcggtggcaataccaacccaccaaaaacagaaccatttgtgcactgcatatattattacatccttataaaagtggctgccggaaggaaaacattttcatgtgttgtggctgcagatgttccacgaggtggttccaatggcgtctgaagccggagcctggcccgtgtgtccccagcaggcgcctctcctcctccccatggccctaacacaggcaagtgtttggaagctggcagcctttcccccagaggggatgtattacacctcccactgccacgtggcatcttctagcgcgacccgcagggcgtggccctaaggcatgggccccactcaccggcgctgaggccccgcagctcctgtgctgcagcccgagaggaaagggcctgggcttgtctaggcctccatgtctttgccttcacctcgcactaaataaacaaatgtacacaaaaggcctagagcgggacttgccagaatggcagctctcaccgattgtcaaagcacagctccatccccagcactcttctggcctctggcatcctcctggtcaccacactgtgctgtgggttggaggtcaggacccggcgtgcagccaggccagaagatggtggtcagacggcttcccagggaaagttacggttgcccagtttaggaaaattttgaatctagaattgtacatattcaaaaagcctctccttgcaagatatatggtagtagcagtaattgtttttatttttatttttgagacagggtctggctgtgttgcccaggctggagcacagtgttgtcaccacggctcactgcaacctcggcctcccaggttcaggccatcctcccacctcagcctcctgaatagctgggactacaggcacactgctgcctcacctggctaatttttgtattttttgtagagagatggggtcttactttgttgcccaggctggtctcaaactctcgagctcaagtgatctgcctgccttggcctcccagtgttgggattacaggcatgagccatcgcgcctggcaaaagttattatttattgagcataaaactgtgtgtaaaacagttttttgtttctactctacaatgatctttcctttttttttttttgagatggagtcttgctctgtcgcccaggctggagtgcaatggcgcgatcttggctcactgcaacctctgcctcccgggttcaagtgattctcctgcctcagcctcctgagtagctgagattacaggtgcatgccaccacacccagctgatttttgtatttttagtacagatggggtttcaccgtgttggtcaggctgatctcgaactcctgacctcgtgatccacctgccttggcctcccaaagtgctgggattacaggcatgagccactgcacccgatctttccattttttttttttaataaaatttgtttattatgttttttagagacagggtcttgctctgctgcccaggctggaatgcaatggtgcaatcatagctcactataacctcaaactcctgggctcaagtgatcctcccatctcagactcccaagaagctaggaccacagatgccaccctacccagataactttttgttttgttgggaggggtgaaggggtggggggcagtgcaactgttgcccaggttggtcttgaacccctggccaaacaatcttcttgcctcagcctctcaaagtgctggaactattatctttcaaaatgggcattatcaacactgagtttcaaagaggtggaggtctgtctaggtcacacagctggaaagttcctgagctaggatctgaatcaaggtctgggtgattctgaaacctgcttccttttatgagatctctctgctggctcaatttcacatacatcctttaccagaaaactgaaggacaaaccacaatccagggctcagaaaacctgagcagggtccatccctgcctcagccgcctcctgccagggatctccggtcccttcgtctcctgtttccgcccttcacagcacgggatggttgtggggagcctgtctcaggccagctttccttctcagccaggcactggtcactccaccccaggtcatctggcaaaaacccagacgccccttgaagctgcgctgctcaagcatctccacccctgaacccaggcaaccccacaggacacgaggagcgggtgtgcagctgcagccaggcctccccagcgagcgtgcactcctggaactgccaagctgggcccggcccaccctctgttccctgcatctggaagggcaatgggcttcttccctgtgacaaaaatatactgcctggcctaactgccaaacgcaagtcaaagaggatgttcctgctaggatacacaggcaagtgcctctactggggatttactgcctgaagatatattgggggtgtctctgctgagtggggagagactgctcactagccaatgacctgcctgatctccccactcaacaaaacattccaccttcatttctaaatatttagaagctgagaaaatatcaaacgaacatctgcagggcccttccccggatgggaaaccttggatctctttccagagatttacaatctcgcctctttcccacgtctctgctgtcacataggagaagtgacctctcagtacaacttccttttcaacattttggaacttggggcttgcaaccttttttcgcttgctctacaaccctcccatggggggccacgtggcagtgtaccagagggtaccttctgcccgcctttcctcacacacatccacaagcctgggcaggaaggtatgatccggccggcctgcggctcaccttcactccgacagcctcactgctgcgggaatttgccagaatactttagctgtttaccttgtcttccagttgacgtccctgagaaacatcttttggtggttggaggtgggagaagtaaaagccgaaaatgatggaggcagggctaggtggaggcagcatcgcctggtctggctgtgttctggctggctggcaggccacgtgcccaggagagtggcgctctgccccggccactggcctaccaccagccgcctacactggggcacgagtgggcacagggcatagcctgatgtgcccacggaagggacccctgcgaggtgccagcaagccaaagctggcggccttctccagatgggccgtgggaaacaggaagacaagggtgcgcccggggccacacacagggaagggcagctgccgctgctgccggggtgaggcaggctgggccacaggaccctgggaaagctgaggacccatggggccttgctgagggtgctgatgctggctgggatggctcttggggctagggcctggcactgtgggcctggggagacagctccaaaaccaagcagccttccttcctgacacacgtggggcaagggcatgtgagcgtgggtgacctggatgaggccaggtttccagaggaaaaacccaggcccaggttgctgtaaggactgtgtaaggaggaactcgagtgaggggctctcatctgacccccacctcacatcttggtcgtccagcccctgaccacgccacgccagaatgccccccagcctgcccctcttcccctgcccttctgtttctgcccttgccacctcatgcctcagactgacactagcttcttcactgacctctctgctgcagggctgtcccctctgaccctcccagggctgcctgatccaggcccttgtcatctctctccttgatgactgtaacagcttccccctgaccacccatcccccaagccgactggcagagccaccttctgaaaacacagatccaatcagatcattggactccctagaaacctcaaagccctcctgacagcctctagtagtgaacacaccccagtggccaagtggcttccagcaggagatcatcctgaaagacaaaggcacacctgcgggaggggcccagagggcagcgctgctcagcacacacctggggagccttgacgccgtgtgcggctctgcagggttgatcctgcttgcggggcctgcttgctcctgaggctacaggtccactgcagctgctcatgccggctgctgagacagagtcctgtctacactgagctgactgctccatgcacttccatctgactatttagcagtcaccgaatggcaggcacagaggacgaattaagaccaaaacagttgtggcatggtagaaagtagcatatttttttctcaccaggcaaatctgggttcacatcccagctttgcttcttactggttaaattatatgggcaaattatttaagtttgaacttcagtttcctcacctgttaaatgagaataacttgaccttggttacaatctaatccaaggggacagcctgcaaaccatgcatgttcatgctcactgagctgctcacttctcccagaacccttcgcctcccatccaaacaagcacaggcgtttttccaaggctcctctgggacccgtagccaagctctgcaaccctcacttcccctgtttgctcagaagctgtgcatcattaacttagatttgtctacctcattgcaatccctcccccttctgtagttacttacattggaacccagccccagctttaatgcacctcaaatgaatgatgtggtgatcggccgttagaatgatggcagagcattaatttcctcattaaagcccccagagcaaaaggcaacgcaaacaaagtccgaagccctggccaaggtgtgctgaggacaggcactcatcaggcctgggtttagcttggcaggagacactgctcacggcaagccggaaccagactctggccatgggctgacagctctgatttaaactattaggagggctgaggattaaatatttgtccaggtcactgtaaaccgggtggaattatcaacagcctggagtggtaagtgatacaggaagcagtctctggatacagattcaggattttccacccactccccaggtggcaggatgtgggagagtcaggctgcaggggagctggctgcctgggggtttggctgttcctccctagccaatggcccctggaagataggagtccacttccacgcaaaaaggctaagtgccccctgtgtgcactagtgagtagtcctgggatgggactgtgacatccctgcccagaggccaaaaagaggaccgcaacatcccttctggcctccagcccctctgacacaggagaggcagtggagcttctataggtggagggagggtcccaggtatgacggctgacattcaccttgcgccactattttttcaatgcatgtagatgttgttgtaactagtagaatgcaaattcacttaaaagatttactacactgggccgggtgtggtggcttatgcctgtaatcccaacactttgggagaccgaggtgggcggatcacttgaggtcaggagttcaagaccagcctggccaacatggtgaaatcccatctctactaaaaatacaaaaaatgagctgggcgtggtggtgcacgcttgtaatcccagctactcgggaggctgaggcaggagaatcgcttgaacccgggaggcagagattgcagtgaaccgagatcacaccactgtactccagcttgggtgacagagcgagactccgtctcaaaaaaaaaaaaaaaaaattttactgcatcgatcctttcggtcatattttttctatccacagctattgagagcataattatcttaccgaaagagatctctgatgttaaaaggaattctcacagtggacagtcagggactgctggaactgagaacggaagggcatccttgcagaaagtggcgccccgctgaggctctcaaggctgtgccgtttctgccaataccgacttctccgaaggcaaagaggggtccttgtgaaacccagttgtgcttggtctatgctttctcttccccctttacgccaagcatcttgtggcactgcactggcacaggtttaaggccttctcttgggatgggaatgtaaagggtcctgaacatggacctttatacaaggttcttaaacccacccagatgcttatgggagcatctaaggtagaagggcgggcaagtttgctcaggggaggcagtaccttccagtccaagtccaagtttgccttagacagaacctgggaacaacatcgtggagaagggttgctagtgatacccaaacaaaagatggataagagagaggtatccagtagggcacttctgaaatttcaatgtgcacacattacctgggcaattttgtgaaaacagagatcctgatatgctaggtctgggtgggacctgatatttctgcctttctgacaagctctttggtgatgctgatgctggtccttggactactctgagggcagcaaggtgcagacactctgagctcaggtaagctgctcccagagagctggcctgactgatgggctgggcatggccacagagacggcaaacagggccaagcaccacttctcacagcacaacatgagctgaagcatggggatgtgcggggccctgaggggtaaggaggagccacagccagcacccggcctccctcagcaggaggccagcagagtgccagcagctgtgggcaaccttgcacagcccagagagcttttatttgaaaatgcaaagccctacttagatggtggatttatagctggctgaacatgcttaccctaaatggggcacctgctcactcatctctgcaggtcagcactgaggccagcacctgtgggcactggcaagtggctatgagcgggtaactctacctgtctggtaaggctgcctccgaggttcatggtgccagagccagatttgttggtctgcagccacagcatcaccgtggaggtcaacttgtaatgggcggtgcgaccgctggatttctcctggaaggacaagacagagatctgttgagctgagggagagcctgaagtggcccctggaattcagggtcatcctaacatctcccttcctaggtcattatcacaatattaccttttttttttttaaattggagacaaagtctcgctctgtcacccaggctggagtgcagtggtgcgatctcaagtcactgcagcctccacctcccaggttcaagcgattctcctgcctcagcctcccaagtagctgggattatgggcgcccgccaccacgcctggctaatgttttttgtgtttttggtagagatgcggtttcgccatattggccaggctggtcttgaactcctgacctccggtgatctgcccacctcagcctcccaaactgctgggattacaggcccgagccaccgtacctggcctcacaatattgtctttcttaaaaaatctcaactggtttttaaagggacatttgtaattatgtatttcttctgggaacttaatcatcaatgactactgcagacttatctttatccaaatggctttgaggcatttctcagaattaggggttcagagatcacagcatccccctactgcatctgttagagagcagcgcggcactggttggtgtgccatctgtacttagtggcccgggccaccagctgctgggaggcagtacctgcacttctaccacgtggatggaatcccagcagcctttgatcttctttgatccatctccagccttctttatgaggatcactccagcaaagccatgatccagatcccagaggtagacagatgagacgccaccttcaaaatacctgcaggaaacaggccaatgtgcctgttagatgctaaaggacagatcatcagcctgggtcccaggctgctgctcagcaaagattctgggattcagggccctccctgcgacagttatgggagccgatccttgggtgtgttctgatcgttctgtggctgggggagggggtgcagcattcctgggggtgtagtaggtttaggcgtcataaagatgaatctgaggttggactctgccacctcctctatctgtgtggtctttggcttactgaacctctctgggcgtcacactcctcccagataaagaatgcagcacgactgacatccagtgacaatccatgcaggccatgactactggagtcaccacggttgttcgatatttctgtcttttgggatattttacagggcagatgagaaaatacagcaacaaactccctacaccctgatccctcctgagcctggcagaccagggctccagttggtctttcggagcaacctcctacaaagcgctagccggaaatgaagggctcagcttgagacagtgcttcctcctcaaatccgacgcaatgcaaaaacatcttttctttttttctgtttttgagatgaagcctcaccatctcccaggctggagtgcagtggcaccatctcggctcactgcaacctccgcctcccaggttcaaacgattctcctgcctcaacctcctgagtagctgggatcacaggtgtgcaccactgcacttggctaatttctgtatttttagtagagatggggttttgccatgttggccaggctggtctcaaaaccctgacctcaagtgatccacccgcctcagcctcccaaagtgctgggattacaggcatgagccactgcgcctggcccagaaacatttctaattataatcaaatggaagagggatttctaattacgatcaaatggaagagggaacgaaaaggttagatgagaaatgggaatcagtctgggatcccaaacccaacagacccaggtcaactactgtggctcactgggactgccgtgagcagaggtgaggggtggagtcagctgatgggaaccgcaaatgctgttgataaccaacaaaaactatgcgaaatctcatttcttgtggcgaaagtctgtagcctctccgaccccaattaagccccaaagagagaaatctcatctctcgtggtgagcacatctttatcagaaagtctggggcctctctgacacctattaagccccaaagccacggtgtggcaggtgcattctgggagcaccctgccctcagccctggacagctgggaaggtgggccgcagagtgcactgggtgggtacaggcttgggagtcagacagacccaatgacagctctagcacgcccagctatgagttatgctcatgcatgcatgtgtccaacaactatttactaagggaccagcggtgtgaatatgggcctcagggacttaatctactttctacggctgttgagagacaaaaacaattaggaaaagtagacacctgccaaacggttaatgtaaaattaagtactagaaattaacatgtatctgtagattatgtctcaccaaagctattatataacaaaaaatacacatttacagaatgtgggtgatgggtatacaagaattctctgtactcttttttttttttttttttttttgcaattttacagtaagtcataccattccaaactaaaaagcttttgtgaaaaatcagtacacgaatacaccggagtgtaatgtaactaagagaccaccagaccaagaaagcaaggcatcctcccaggagaatgagggtgccctggctggtctgccctcactccaacccgcagacctgcggagcatccagggggccgatactcaggtgggctacccttggccccctgcccagggctccctcaggcaggctgcggccagcccctgcggcaggaccacatcctgtcccattcccctctccggcactacccactatgattaagctctcaaaccgagtacaccatggtgtgtccacgggtgagtctacaggagggcagatgagggcagggctgtctggctaaccaagtgtcactcagggaacacctgtcggatggaggtgtcaggtgtcagatgctgagcccatcgctggtcaaactgcgcagggtggggaagggtctggctctggccaggtgcagcacaggcatcctttcctacgagaggaaaaggaccactggatgaacagacacacctgtgaggcccagagctcactgctggcagaggtgatgtccaggaaaccggccaacactggcactcagagatcccactccagaagatcatttcctttattccggtctgctccaaagtccccattcttggggcgaggcgaggtaagcagatgagtgttttggtccagggcccaaaaccccatctgcctccatagagccctcctggtctggaccgggcccacacagagttggagagatcaggccattctgcaatgttcctggaacacctggagagggatggactgcccctgctggacctgagggttagcagggctcagatgactggcagcatgggctccgtgagcctttctggcttgttctcctggattcttgcaagttaacttacgaggcacatcaatactaccaacggaagagcaactcataacagacctgctaatacccttcctgttggcaacagatggcttggttctagcacaccgttttccctttcagtcggcttacagggagagcagccccacatcaaaagagggggaagaaaaacaaacaaaaaaaccctactttgctggcaaaaaggatgggccaataatccgttctttccttcagcccttctggaaagaaggcttgcagcccaggggcatttcatccttccactccttcacagatccatgcagagctgcggtgctgtgcctgcccaaggcttgctctcctctgtgtgctgggacactggggagatgcaggtcaggatgccctggaggggaaccaggagaaatcccgatggcctgacagcccttgtcgacaccctccggtgaccagttcaaaagcaccaggtggcccacggctgcttcccctcagtcccatccctgagcgtttcatttcttccagaaaaataaaacaaccgcattaaagttttatagggtggaactggccgtttccactccaatgtcccaccctgtggcctggctcccactacgggcagcttctccttggcgggccacggtgaccaggtctaaagtttcaaatgctggagccaggggaggtaaaaatgcaagctcaattgtcactccttgtggggttactattcttttacccacaattttaaaacttactgcaggaacattattgttttttaaaaaaggaaatctgaaaattagcccacaatgccataaatcaacttatcccataaatctgatttttccaaattcccttccagtccagatgcatgacttttatataactgtaagcacagcaagagtaccatgctgaatttggctttttacacttggcacagaatcattagcatttttccatggagccgcatgatctccataatcatttttaacagcaaggatagtattcagtcgggtagtatcctaatttaccatcaatctgacttttaataaagaaacaacggcgacagagttagaggcggcgtggtcaatctctcacttcgaatctgttccctctctgaatcggggtgttccaactgaggtgagtcagacgtgctgagacctggcctctgcaggtacagctcaaacactacaataattcaagaatggacttgcattccattcaccaaaagggatctccagggactggagcagccacaagtctcaacctgacattccgagacaaagggagcagaggactgcatggttagaaaggcctgtttcagaattgcccagaagcaccagcctctcctgcgagtgccatcagggcgctccggcaccttcaggagggaggtgactgcagggcgcacagacagcgcccccgctacatggtttatggctttgctctgcgcgtgaagcattaattaaagggggaccacaacacgtttttgaaaatttatttcttacctactgtactttgatcataatgatatgaaacaaggaaaaaataatttttatgtggtttgcatttatgagtttttacataaaggcttttgtgggtattttaagaatgtgctaaaacgttgtctgaaaccacataaagccatctgaggagtcgcccgccagaattaacagcacatacatggaagcagtttaactggtctttgtatatttaatgagtcaaatagtattaatattgtttaaatgctaacatgctatttcaataaggtggctctaccatcgccagcgactcactctcaggccttgtacttccatgtgagtgaatgatcaaatgtggccaagcgctgagagcaggctgcagaggaattaatccgccctgccctggcccctgcccatgcctgataatttcaaaatctcccaactctgcagggagggaggaatgggcccaggactcactaccacagctcagctgatttgggctcaagaggaaaatcccagagagtccctgcagtgaggtctctggtcaaggaggtagaagggggaaatttttattatatttttttgagacagagtctctctgtcgcccaggctggagtgctttattttatttttttgagacagagtctcgctctgtcgcccaggctggagtgcagtggcatgacctcagctcactgcgacctccacttcccgggttcaagtgattctcctgcttcagcttcccaagtagctgggattccaggggtctgccaacatgcctggataattattgtatttttagtagagactgggtctcaccatgttgcccaggctggtctctaactcctggcctcggtctccactcagtgttgggattacaggcgtgagccaccacgtctggtcaagaacctcttttaaacatgcaggcctaggaccaggcgcagtggctcacacctgtaatcctagcactttgggaggctgaggtgggaggactgcttgagcccaggagttcgaggccagcctctataaaaaaaagaaaaaagaaagaaaaaaaaaaccgtggaggcccaaagagaaatgcatgagcttttcctaggcttctttcctaaatggaaagccagacagcacgggcagcacagggctgaaatcaatccccacagtcaagaggctgaatgacatgctcaaatcagagctccccagtggccaggacaacacagggactagcttgcaaagactgcagagaagtcaacttggacaagtgttgaaccatgaagtgggggggcctcagaagctccaggaagatgaggagggggtgaaatgacagaccaacttgggaatgactgggagcaaagtgctggagtcacctgtttgcttgcgtccactgaagagctaactctttcaactgagtgccatcagttttaccaacggtcccggcgccttttaagactttcctaacacagattaacatcttgttttgttttttgagacagggtcttgctttgatgcccaggctggagtgtggtggtgcgatcaccgctcactgcagcctcgacttcctgggttcaagtgatcctccttccccagcctcccaagcagctgggaccacaggcatgcaccaccatgcatggctaattaaaaaaaaaatttttttttttttttttttagagacagggtcttgctatgttgcccaggctggtctcaagccgtttatcagcacagccaattacaattaaacatctggttgggtttttgtctatcgtcaccttggtccctaaacgtggatcagctaaaagcctaatgtgtcagtaattctcttcttctcagagttttaggtcgtttctccctgaaaatcactcttccagttgaataatgtcatagtcacggatatagattctatgtccgtaacttttcaaccacaggacttctggggggaaggagaaaaaagggaaaacataatacttcacactcaaaatgacctaattcacaaaagtaaaaagaaaagaaaatgtttcagctccaaaagctttatggagtgtctgaagctgaggtgtgcgtggggtggaaacgtgctcggggaatctgagctgtaactatgaatgacccaattcccaggcctggccaacacggggctgcaaatctaacagggaaaacgggaggggaagaaggggctttgaagctgctctttactccttcctttcacatcacctcctgggagaagagctggattcgtggctcgaatacaaaggctcccaacagataatgagtacatgccacatgccacaagaaccaaggccaggacagacctgctgggagcagggctttccagcatgagccaagaaacagactctgtggttctagggttcactgagacatgtccttctggctattagtgggctgggccacactcacaggacttggacctctggcctgagatacctgtgacgctgaggcacaggcagcagccaagttaggggcattattaaggtgagctccataggtgctggaacagggctttctcttgcagtcaacttcactgaataaagccaagggaaaggcaatatttggcaccaacacagtgcaaaagacttttttcttatttgtaaaatcaaagagctggatcagaggccagcgtagagggtcctcccagttctgacattccaggatttggtggttgcatcagggcctgtatgaggcagactgagcaccacagggcaggttcctaacatcttagtctctgtcaaactgctgcttacacacctccagtgacagtgaactcattacattcctgaggcaaacatttctgttctgaacaactgagacagttctctctggacttgagtgaagacttctcactactgccttccagaatcacaaaaaaacaaggacttcatgccctttccttgcatagtcctttcaaacatttaaaactggcttacaccaagatttctcttttctggccttctcctccttgtaattcctcatacgactcaataccttgtttatccttctgaacatactccagcttgtcaatgtccttcataaaagaacagaaaacaatgccccaactaagtgttaaccaatgcatagcagggaccagcacatctcttggcaaacaggctactcctccctccagcactcaagaccaaattagctttcattagcaatcacacctaatccatgctacacatactgaacttgcagtcatctcaaatggagtattttttctttttttttttctctctttttttgagacagggtctcgttctcttgcccaggttggagtgcaatggcatgaccatggctcattgcagcctcgacattctgggctcaagtgatcctcccacctcagcctcctgagtagctgggactacaggtgcatgccaccacacctgggtaattttaaatttttttgtagagacagggtctcgctatgctcaggcaggtcttgaactcctgggctcaagtaatcttcccacctcggcctcccaaagtgctgggattataggcataagtcaccgtgtacagctgaatattttttcttatgtgttgccatgaaaatacctctcacatcctggacttgagaacttggtagactggacccaagaatatcactttccactcaaatctgtgacagatcactctcgtagacatggcttcaacatttcaacgtctcttttgggatcccgaagctgttgtgatctgtattctatccaagccactcttcccccgaagtctttatgcacaggaatatacgtgaaagcaggagactgtgcaaatgaggatgtcactgagttccagatcgcgtggatttccagaaagagcacgggcagccctagtgaaggcttctgtggagaaactgatggtccaccaggaaggagggctctggtctgggcacttttttcatgttggagtcagtataaagatggaaaccaggccgggcatggtggctcacgcctgtaatcccagcatttagggaggccgagacgggcagatcacctgaggtcaggagttcgagaccagcctgacccacatggagaagccccgtctctattaaaaaaacacacaaaattagtcgggcgtggtggtgcatgcctgtaatcccagcgacttgggaggctgaggcaggagaatcgcttgaacccgggaggcagaggttgcggtgagccgagatcatgccattgcactccagcctgagtaacaagagtgaaactccgtctcaaaaagaaaaaaagaaaaagaaaagatggaaacgcccacagccttgatgaggcagaagtagaagggaacacaggaggtggggctggctggaatgccggctgaagagctcaggctaaaaaatttgaagtgttgatgtaactgaaaaaagcagaattcctctatgatctggtgctaagctaggaacctgggccctcaaacagctccaacatgtaagattccacgagtctttcttctcctaccctatgttctcccgtcacatgtatggtgtgttctgcttctgggatctcaccaaggagtagcagcaagacttgggacaaataagtggtcttaggtcaggcatggtggctcacgcctataatcccagcactttgggaggccaaggtggggggatcacttgactccaggagttcaagaccagcctgggcaacatagtgagaccgtgtcttaaaatatatatatatatatatatatatataaataaaataaatggtcatgagggacactttttgctgtactggtgcttggtcatgacaaagacaaggtcatacaggcatgagttcaaacaaactcctggccgggtgcggtggctcatgcctataatcccggcactttgggaagccgaggccggcagatcacctgaggtcaggagttcgaaaccagcctggccagcatggtgaatcccatttctactaaaaatacaaaaattagccaggcatggtggcaggtgcttgtaatcccagttactcaggaggctgagacaggagaattgcttgaacccgggaggcagaggttatagtgccttgagatggcgccactgcactccagcctgagcaaaaagagcgagactccatctcaaaagaaacaacaacaacaaacaaacagaaactcccaagctccatgactgattttatggcaaagaggaagagaataaaacccagaggcagagccattccccggcagctgaggttctggccctaaaacaatgcctttttgttccctcctagggtaaaaaagaaactaaaatccccagctatcagcagtagtttgtttttctgatcatccttaacatccttacaacaaaacaggcacctggtcttcacaggtgggaacaatccaactccacctcaggaaaaagagaaaactgtccattctgctcagaggggcatccaaaacctggctcccttcctcgtggtgtagaccaacgttcctttttgctctgctggctgccatctagccaacttcaaaaagaagctgagcgcatcccctgtccaatggatgggcgtgggtgctgcccagtgggcacaatgttgcaaagtccagagagctgcagacggcacacgaggggctggagagtgtgggttctcttccttacactggttataccagcctgcactcaagatgcatctggcaaacaagcatgaggagatataaggaagatcacaagaaaaaaatgaacgggcaagcacttgccatggcacctggcagagcaagcactcaacaagtggtggctgctggttttcatcaggctcttactttctgaacagaggggaggagaaggcaacctcgacgtgttgtgagctgccctggaagtgtccgtcagaaacacaaagtgccgcttactgggagcggttccgtacccactggcacaggctccacacaaaatggagaaagatcaatgcttggctttgggcgggccatgtccagagctgatgctgaaactcaaccacccttgtttgtgtgttgagaccagctgttttcaccatggtttagggaacacggcccagaggctgcccatggacacgggacaggtattcagcggaaattccttccagtacacacaggtgcaacaatcccccgagtcaacataccaatcagcttaggcatgtgcgactttaatgccagctgcacttagaaggcacatctggactgtggctgccgcgctttagtgtctcgcttttacgaggcttttatttttttacttaaagaaataatgaaggcctctctggaaacaatggtgccgctgcaggggccggctatctggctctgggatctggttttgggatctggccaaactgtccacacttggcaccactgcgactgtcttctgccctctggactacttgtgaaaacactgctggccccatggagctacctcatgagccgtcaacagtcagggctttctgggcttccaagtcatcactctcatccaaagctgccattgttgagaactcattctgtgtcaggggctttgcatatcttttttttacagttaagaaaactgtaacccagagagataaggaacgtgcccaagtcacaggctgagaagcagggatctgggagtagatgtcaggcttggctggccccagtgcccatattctgccccatgccaggctgcctggccatcctgagacgtgccagctgtggtgggatggagcgcaggcggacagaacagggtcagccagtaggttagatgcccgtatgaagccacaccactgaacacacagctgccccaaagaggagaaagtcaggccaagtgcagtggctcatgcctgtaatccccagcactttgggaggccaagatgggaggatcacttgaggccaggagtttgagaccagcctgggcaacagagtgagagcccccgtctccattttttttcttggaaaaaaaaaaaaaaaaaaacggtggagagagtccgagttaaaaaaggaacccgctgggtgaccaggaatccgggacatgccccgagcaccctgtactggggattttggagggttctctgcctcactgaggcagctggggctgctggctgggtcactgcaagaatgccttttttttttttttttttaattagacatggggtctctctctgtcacccaggcagaagtgtggtggtgggaccatagttcactgcagcctccaccttctgggctcaagtgatgctcccacctcagcccccagacactgagattacaggtgtgagccactgtgccccaccgcacctattcttgatacttgcacaaagcagttttccatcacagaagcctcggaaacatctcagtgaggggagtgcagggtctctggcaggatgggggagcttgaccaagggagggagctggtccctgcttccagcagcagagtttcactccaacatgtgcaacggcccaaaccaaagagtgactgtgtgccatctggttagaggaacccaagaattctagaggcatcagagtccctgatgctgacgtggggatcatgttcataagcaaacttgttttctgcacactcctgttttccatttaactttctttcagcagatgaaaatcagactgcacatgccaagcaaccagacactggcctgcagccttgggatgccagatgaaagggaaccccaggacagggggcaacatgcaagcctgtctagatccactctttagggacttgataactgtagcagacacccccactaggagcagtggtcacgaaagagctgaaacgcactgcgagagcaggaagcaggctcagctgtacccctccaaagctgtgaggtttctccagacctttctctctgctctgtgaaaacaacacaatagaggtgggcttgggtttccccattaagtgcttctggcactttctcacaagccccaggcagtggcaagccggtgtcccacagcaggcagggcgggttctcagaggccctgtgcgcacatggctgaagacacaaacatgttcaaacccaagtgctaattacactgtggacatgccagaagccagagacggcctggctccaccctgctgtcccgagtgcaagatgagtggcaagcggtgcccgtcacgggatccctctggaggcctttacatctggggaaaggtcctacctctaggcaaggaaatgagaacacagacctcgctgaagggacagggagtgaagggggatgtccccaaccaaaccgtccctgcagctccaggatgttcttaagcattctccgttactccccttactctgcccacctcccagtggggctctgagtccgcaggcctggccgtttccagcggtggaaaaagcccccggggcacctggaactgcagagttcactcagccagagcaaaggaagcagccctccactctagctgagctgtcaggcccttcctgctcctggcctctccaatccagcctccacactacttccgaggaacttctttggatgcacatcagagctgtcctacccttggaaccttccagacctttcccaaggctcccagaatgacacccagagcccgcaccccacaggcctgtgcgcctctccccactgccctgtcctgttccggcctccactcactgcccacgaccactgggaatcccttcagggcgtggcccaggcggttcccactgctcagggcactgtccttgtcctctcccatcacagtacagggctgtgcccgggatccccagaccacccgaggctccataattcgctacaaggactcacggaatgtggcacaaagttgccctcggggccaagggttattgaagggaacagagcaaaggaggctgagggagaaggcgctggggctggggtcctgagaaaccaggcaccagctttcaacgtcctgctccatgacgtcacacaggacgtgatacactcccccagggatgggcttgacggcatgtgtgaagtactgtctactggtgaagcaagccagggactcagtgcccagggctgtactactaagcaccctctacctagcacatggtgaaatttcagatgcccacaaggaaaggagaaggaaggccacactgtttgcacacagttcagacgtcggaagtcactcttatcagggagtggtaagagccctcctgaaacccaagttcccagctgccagccgcgggccaagctggcaagcatgcctccgagggacagcagtctcaggccagctctgttagccctttccactcaagggcaacccccctgtaaccgacccacagttccttcctcagagccttccctaacatccacaccctttgctcttccccaccgcaggacccagctctcattcctttgcagcgtttatcaaactgtgcaagtactgtgttcatctgctgacttgttcctgtgttgaaacatgggccccatgagggagggactgggcctgacacatttgccactgaccctgggcacatgacaccatccccggcaggttctcattaaggacctggtgaccgatcccaaggattctctctccagtcactgcagacgggcactaccagcatctctgttcagcctcactacaccctgatgatgtggattgagcaggaatcattaattccatttttgagacagagatttcctggaggccttgctgtgggaggtggtggaagagccccatcccgaaactacggccttctcgcatgatcacgaagcctgctaccccatcaggtccgccacccaaatggtcccgtatctgtgatcataaacgcacagaatgtaagatgcaggtacagaatgtaagatgcacgtacagatacctgctgcacaattagaagagccctgtcacccagcagcctggaaggtgctggctggacgcaaggcgtgagtgcagcaggggtctgacgcacagtgtgtcactgagtgacgcctcagcccacagcatgggtaaggaaacggaggctcagagaggttaactcactcgcccagtcagtcagcaagaaaagacaaagagagaatccagtccaaagctctttaaagccaaggtcctctccattccgtggctgggcctcagacgccatgggtgagggtcagaggcttttggtgggaggtggtggtgccttctgcctgggaagccccccagcacctcagctgcccgctcacacttctgcactctttccctggaaaatctccccctaccgcctgcagttcctccacactcacgtcccgaggaaggggtgccctgaggggtctggggctgggaacctgcagtttcaaggaccccggaaatcaggtgcaaacatttctcacatgtgaacatggacatcctgcccttcctgggccaatgttcctcaaacatcaaatggcgggaaggagcaggaacaactgcagttctgaaatggcccagagaggggacaggtgctggggagcccaggccggggggtggggcccatccacccagctcctggctgctccactcctggagaggcccttgggccctgggactgccatgaggacgccagccttgtttcactctataaacttcttccagacaaggagggctgattggaaaagctaattaaagcttttgaagattatctcagaactgaagcaaggaagaacacaaaataccctcccaccctgctcctccactccccagactctggccttcattaggctttgatttcaatcaattgcacacccactaaaattaacttataaggccaataaattgcaaccgcatgtttgaaggtattatctgctccaagccaagagccaaggacttcagagcattgggcgagatgtctggcgcagatgggagtaatcatctttggaagaaggcagtgccagccctttggtcagaacatctggtcccaggcagaacccggggccgacacaggccagggccagacttgatgtgaaagctggagcagggaaggtttcctatcttctccaggaacctgaaaaatcaaagtgttaatcttggggttcatggcagcccactggtcgctcacaccagcaagatgttcctctgacagctgctggtgcctgacctacagcaaagtctccacttctaagtctctcccaagaaagatcacttaggtcaaaagatgaggttttgtgactgatgagctagcctaggcttggacctaagaaagcagagtcggctctgctgagaaagagtgtcaaatgatcctccgagccagctgcccaggagtcggcccgctcggctgtcttcccctctgcctcagtgctcagttctcgtgacatcccctggatgagtcaggcccatcaattacaggcagaaaaccatcttggggcttggtagagagaatagcctagatgttggggaccaggtgggtgggctggctgggaggggaagtgatgaaaatgaaggtgacttgcgagcagataataccctcacctggccccagcacaccagcaaaatgtgcttgtcatctcctaagcatttgcgcaaactggctcttttcatctaaaaacaaggctgtttgggtagtgacagttactctcctagggaaagtactactatgatctctttctgcccctgaggatggcagagaagggaatcatcagcatggaagggacctggacgtgagaatgccgcagggacccagcagaggcagggcaagccaggagctagtggacttcagagggagccgtgaggacacacggctcagccccctgcacccctactcgccttttgcccaccttaaggagtcacgctcccaactgctagccctttcaatccacaggggagaggggctgccacatctccaaggagttacaagccagaaaggcctgctggtcaacccgtcccctggcccagctccatcattctgacattgattccatgtgcttatgattaaatccaactccctacaaagtcagagcctttacagagccagggatcaaagcccagagcctgaagacagaatctacgtctttccctcaggatccagtgaagaagatttttctctccggtggcagagggagcctctggggagacggtaagttctgctatctgaggaggctggtgtggcccgtgggctgcctggatcatgctctaggtctctggaccctcaagcctatctctttaccaatgtctcctttcacatattttttattttttagttttcttttttttttttccagagacaaggactcactctgtcacccaggctgagtgtatgatggcatgactatagctcactgtaaccttgaactcctgggctcaagcaatcctcctacctcagctgagtagctaggcctatgtgtgtgtgtgcctctatgcctgactaatgtttatattttattttttggaggtacagggtcttgctatgtcgcccaggctggtctcgagctcccggcctcaagcaatcctcctgcctcagcctcccaaagcaccactaatcttttcaagcagggcctcaaggagtaaggacaaagctaatgggttaatgggtggggggcaggcacctcgttcctgactgtggcacacacacggccagtgcctgtgggtgctacgtcagccgacaacaaacatgcccacagacagcaagtccagtcttctggcatgagccagcagggtacggcgggggcaggaacaggggcaagacagggtatccaaggcctctttattccttttcttgggtcaaatctctgtgtgagcaaagtccagtgtgaccttctcagcataaagagactttttaggccataaaacaagcggctccctggaggctggctgcagcacagtgtccccacgggaggattctgagctccaacgtggcaggagcctggcagctctcagtcattcgatggggttggtggtcatgaggctggagctcaagccaaacatagtcctgattgcgattcatcaggatccaacaattcagaagcacctggaatcgtgaattaaagaccctgtcaacacagtctgctcttccaacccccaaccaccaggggcgcaggccaagctctagcttgaagtgtgtggtctgaaagtggcagctgcacctgtgcagccctcctgggcacaagggcgagcccagcctgctctcaaggggtggcttctccggccactccccttttctcctggcagggtgggtctggctgaggctctggccatctctcacaggccggggacaccagccactttcctggcccctcaggcagcagctcagggtgaccaagccagcagacgggagcattgggtggaggtctcctctcagaatgacccttgcctgaacccatctgccaacctgaacagaagataggtgggagagctgtggccttgctcaggggacaacaaacaagtctttctgtgagaaagtgtttgtatggggaagggctagataaaagatgaagagaaagggatggcctactgcctctccaccccatggaacagcctggtccctagaaaaccgagtgtgaccctggccaatgcccctcaggagacaaggccacccagctgactcccctctgctccaaagccacggggaaaagagcttgcattccagggcctgctgtggtcacttatgtggccaccaacagcctcgcggggcactctgggaatgggaacttctggagatgagcaatgtaccacaatgtaccaagatgtttttaaaaaagaaaaaaaagagacttgttctcataatttttagactataaatgggttggttcgtcacatgtggttcagctgggaaaacgttcctcgcatgtggtcccaggagagagagctcttcagcacactccgatggcactgggtgagtcaaaattcatgcctctggtatcccggatggcagctccaactgctgtccctttggtggtctgcggtccctgtcacccaggaagagcctggccccactgcccctgcacatgcaaggtaaggaagggcctcctgcctctcctgcggggccactctcctccttcctcccgaggtgctgggaacagaacggcaccagcctggatcccactacacactgttgcagaccctcggggtctgggttatccagttcgacccccaactgggggcaggatgctgtcgtcacccctctttcaactcccccgagtcagtttaccttcagagaggagtgtgtaggcaagtcaaaggcacacagaaatcaaaagccaccttacaaatacacatttcccagggaagggaaaggcttcaccagaggcagcgtgaagagtgaggccttagctatgactcccggctcctgtggttttctagctgtgttaaccagcttgagtacttatctgagcctcagcttcatcagctgccaaatggaataactcccacttgtcctatagtcactgtaaggattcagtgattattctgaagagttttaatgatagtagggaaattctcatgataacaggccataaaagcccctgcagaaccatacaccatgtatcattacatatgtgaacgatgagatgggaagggagaacaagggaagcagaagtccaagatgaaactgggctcttccccaaggctggccctaaatggcgaagtaaggcaacacatctgattcactttattaagggagtaacaacatgaacacttaagtctcataaagaatcagaatcacccccacctccatatctcaacatgcagcccagtaataagccagagtacagcctcctcatagaacagaaggggtgaggccaggcaacttcctcaggcttaggggatgacacgcatggcacgttagctccccaagctgggggaaaatctagcaaacactttcaagggggaactttccacttccaccttcaaacttagctgaaagggcaggctgtattcctggagtatcctgagatggctcccaagaagcttacatataaaaggggccaattttgcccaaatctctttcaaattgacttccaatttaaaagaggctgagggtgtgcacttgctggttgacagctgtgtgtgcacattaaggggcaccagtctcagggccttagacaggtgagtttgcccctgcctcagagaccctggcacaaccagcccccctgcctggctggcttcctcaatgtcagacctcagtcaagtgtctcctcaagaggcctcatgggccactctacataacaagtcagctgctccctgttatcactagcagcaatgacttgttcactggtccactgtttgtttttccacaatggagtgtggtgagggcaggggcctcatctaccacgtacgaggtgcatccctggtactcagcaagcacccggctcatgggaggcactcaaatgtctgctgagtaaataaatcgatgttggactctggagctgggtaaggatggtttgatatcccagttccaccacttactagctctgtgaacctgggtaagttatatcacctttctgatctgtcagctcgtttgtaagagggggataaccctctctcatgggttcttgtgaagaccgaatgagacagagaatacctggaggcccacttgcatggccactggtaactgttatcatcaccatcgttattttattaccagtattatcactttaatattaaaccaattctacttgggcattcttgtttaatagctggattggcttcttaccaaatgggcaggtaaaagaagatagtaaaaaacaattacaagtaaactaccatagagcaatgagtcagcttttcagtatcactggggaaggaactattctacaataggacaaagttctagatgtaagaacctttaaaagactgaagcctattttaactgtgaaaatcaacaatttgtgggaatttcagataaatatgggttcaaattctagcttttcacctccatgtcctgtggtcttgtgtgagtcatttaacctcttggaaccttggtctcatttgtaaaaggaggaacaaaaccatcttccccagaggttcttgttaaggagtaaagataatgtatataaaatattcgtatataatagaactacagactgggggccaagccccacccacctcaaagctcaagaggtgaattttacattttaaaggttcaacagaaaacaaaccaagaagcagcaacagagaccttatgtggcctgcaaagcctaaaacgtttaggatctggttcttgacagaaaaaagtctgccaacttgaattagtattgcctattttacagttttgctgtattttcagtatagagcttaattataaatgagattctgttgattatggctaactttctctggagcccttccttgtaagcctgaacaattaagtgacatgttggtgctgtggtgctgggaggcaggattagacggagcaggaagaaatctcaacagatctagcaaaacgctttttaaggaaggtgccgaggccacaaacaactcaggattcaggaagatgtttgctgctctgctcctgctctgtaaggactgcacttatcttggcctgagagcagctggaggcagaggcccctgagctccaggtcagaagtgagcgtgtggtatggcaaaaaaatccatacgggcctttggagataaacaggtctgactttaattcctggctctaccccttgctgtggacaaatactttaatctgtgtcttaatttcttaatctgagaaacgaggactaaactagctatgtttgtgaggatttgagatgctatgtagaaatacctggcactgtttcttatacacagtaggcactgtaccagtggcacctgctgttattatgaatcacgatgcaggggaacagcacatagtgaagtctggtagcattctatgaccgagtcatctcataaccaacccaaccaccaaacgagtgccctgcatcctgctatgggaggctcccaattttagttaggtgagccaggtaacagattcaagggagaatgcttggccgggtaacagattcaagggagaatgcttggccaggtaacagattccagatagaacactgccacttaggatttacctctcaaaactcacaagcgctaaagtgcaacaggagaaaatgactcacaggtctcgatactggtcaaaggcattgttggcttccacctccagctttctcagccgagctgacggcatggccccatcctccaagggagggtcatacttgttactccatggtgacctggagggaaggaaggaaaagtatataccatgaatcgttccatgaagacacggccagcgagcagggagcctgagccctggctatctgaaatctcggaggcaaagccgctaactccagcaaagatttttctgggtcctggcaacaaacagggctttctggaggtttggagaacaagggctctgatgcgggcagactggggcacacgcccgtgctccacctctcactggctgtgaatgctcagcaagtgtcccaactccctgagcctcacttttctcctgcgtaaaatgcggctgctacttgctccgcacacagggtcgtcatgagaaatgagacaagcagatcaagcgcccagcccagagcttgccagactgtcagtgttcaacaaatgctagttctttcttacccgctttctcagttttgtgttcaccacctatttttttttctttcttttttttttttttttaagacagagtctagctctgtcgcccaggctggagtgcagtggcgtgatcttggctcaccacaacctccgcctcctgggttcaggcgattctcgtgcctcagcctcctgagtagctggaattgcaggtgcaagccaccaggcccagctaatttttgtatttttagtagaggcggagtttggccgtgtcggccaggctggtctcaaactcctggcctcaagtaatctccctgcctcagcctcccaaagtgctgggattataggtgtgagccaccgcgcctggccatgtgttcaccaccttatagttcaacagatgcccctctctcctccctgatttgctggaggctctacataaactttaagaccttcttacatagtaagcgttaagaagagagctgtcagttacagaggcgggcaagagatacagctccacagggaaatgctgattacattagaaaacctgagcaatcaggttctccacgtgaacacaggatagcttttccaacatccaagagctatgcacacatatgaagactgctaagtaatgagaaccagtctttttgcagcccaaaagacttgctgtatttcttgaaatgtattttgccacatcaggaaagcatttaatcacactgagaactggaaagggggttataagggaaagatctactcattaattcctgcaggtggggttcagagggccgagtgttcagagaaagtagcagaattaaaaaggtgagagaggaatgaaaagacagagaagacaacatggaattcagaaaaagtccttcacactcttggtctaaacgcctcgctgtttccactgtcagagacccacaatgccttttccgcatcccctcctgaccacatcattgtgatgtggaatgcatgttaaggaaaaaaaaagtatgctcatcatcttccaaaccccagttttaaagaattctgcacgcagacatctttcttcttggtaagtgatgctccaccaggcacctacgtcagtagatcatggagtatggaaccagaataagctgggcggcctcttccaccagccacccgcaggcagctttctcagaggctggttcacaaacggtatgtaggggaagagttgctgtgcttggtgtccccaaagagtctccaggcaggaattacactcctgatcacctcaaagcagaaggagccttggaaatccttgtttccaagctgaccactttctgctgctcaccgcagttttggtagagactttgcaagaatggggtgagacaccccctgctgccccatgagcagcagccagctttcatggtcacactgggccatcgcacaccatgggaagcaaactgtcaacaagctgggaccccagatggctgggaagacaggcgtgccgcccacaatcgatgcctcagttctcctgagaagccaagcgcgggctgacctgtcagttcttgtagcctgtcgctcctccctctgaaacggggctgcccaacagaacttcctgagacgatggagatgttctaaatctgtgctgtccaaaacaagtcactagccatgtgtagctacttgcatacttacaatgtgaccggtatgaccaagagactcaattcttaattttatttaatgggaatcaatttgaatgcagatagctcactctagaacctcagctaggaggcggcaagagccttttctgtcatcttctcttcgggttgctcagcacctagaacagtgcctggcactcaactacacgctcattaaaaaaaaaaatgtttttaagaatgaatttggccaggcgcggtagctcacacctgcaatcccagcaccttgggaggccgaggcgggaggatcacaaggtcaggagtttgagacaagcctggccaacatggtgaaaccccatctctactaaacatacaaaaaattagctgggtgtggtggcatgcacctgtaatcccagctactcaggaggctgaggcaggagaatcacttgaacccagaaggcggaggctgcagtgagctgagatcgcgccactgcactccagcctgggtgacagagcaagactccatctcggggaaacaaacaaaaaaaaatgaatgaattcttcttgtccaatcacagttgtaaataaataaaataaaaaagcatgaattcttgcacccccgcccccccaccacaacagaaccaaccactccctcctccctctcacacagatgttgatcctcatgcctgtcatatccttgcccttcttccctcaccctcgactgcaagaggtctttgacagcagagagcctgtgctgcctgcccttgtccccagtacccagccctgagttagtgccaagcagatgctgctggtggaccgaagcctcacagcccgggagaggaagaaaggggaattctgctggtgttccacttctccaaaccaagagatggagcagctttctggctttttcatgctggtcacgggcatggcgcccaggtgctgtccttcttgggagcatcttgctctgtcgcccaggctggagtgcagtgatgtgaacatggtccactgtacaggaccataggcatgtaccaccatgcccagctaattttttttttttttttttttttttttgagacagagtctcactctgttgcccaggttggagtgcagtggcatgatctcagctcactgcaacctgtgtctcctgggttcaagcagattctcctgcctcagcctcacctaagcactaaaaaacaaaaacaccaaatcaacaaaagcctctcatcagatctcagagacaaagatccaggtgaaaagatgctgtcgccatgatttatctataaacaaggcttggttcttctgctggccgggggagtggataagaatctgagggtgtggagctgaattccctccttcccctgggtggccctttgagactctgcagcacactcatacgcaggaccgttcccacagttcgatgacagccatcgccttcctgtaggctgggaagacccgacccaagtggcgttcatttcaaggcaccctgattagacacaagagcccatctttcgggcagactgggggcctgcaatttgcaagaagcctgtaactcacatttctactggctcacagacgatagcatttcaagctgttagtcctgaagccagggtaattgtagctgagggaaatatcataacattaaccagaatattcttagtggaaggggcactcagaacacacttaagagcttaaatggaggccatttgaaaaaagacagatggacaggaatgcctagatttcaaaagtcaggactttcatttccctccgagaaggctttttgtttcagctaacaggtttcaaacggtgctgctggcaacggtcacaccataaggatcttatttaagcaaaccatcaaacacagtcaggatggaaatctgtggacagaatcagaagaccttgaagtttcatatcgagaagaggagaaagaaagacatactttctgcctccacaccccaggctcctctctaaaggcctgagatcccccagagctggtggtagggcctcaggaatgcaggtgggggacaaaggggtgacctggaagggctgcaggtaccaagtctcccgcagagcctggcctagccacggacctagacatgatcccgtccttccaccagctcctgcagaacagctgccttacacagtcaactggagtttttaggtggaaataataaatataataatgatgttgattaagcaagaccagttcaaggaacacctcctccaggaagcgttccctgaactgcatgccgggcgagaatacttctccctgcctgctccctggtctgtcagaccactcaccatcttcactggacttctctctctaagggctggtccacccacttcatcagtggctccctggctgggcaatgtggctcacacctgtaatcctagcaatttgggaagctgaagtgggaggactgcttgaacctaggagttcgaggccagcctgggcaacaaaatgaggcccccatctctacaaaaaaaaaaaaaaaaggagagagaaaaagtcaaaaaaattagctggggctgggcgcagtggctcatgcctataatcctgacattttgggaagccaaggcaggaggatcatttgaggtcaggagttcaagaccagcctggccaacgtggtgaaaccctgtctgcactgaaaatacaaagactagctgggagcgatggcgtacacccgtaatcccagctacttgggaggctgaggcaggagaatctgcttgaacccaggagacagaggttgcagtgagctgagatcgtgccactgcactccaacctggacaacagagtgagactctgtctcaaaaaaaaaaaaaaaaaaaattagctgggcatggtgatacatgcctatggtcttgtgcagggggccatgttcgcatcactgcactacagcctgggcgacagagcaagatgctcccaaggacagcacctggacgccatgctgtgaccagcagttccaggcacagaatgagcccttcaaggatgaatttgatcggcctcagggctgtatcaccatctatatgctgggacatctgcagccacatccccagcctaaacctctctcctggaactccacatggtacatccacagcctacctggtatctccactttgatctaatgggcctctcaagcttaaagtgtccctatgcctgctcctccccgagtcctcctcacctcaatcaacagtggctcaggtccgaagccttgtaatcacccttcacaccccacctcctcttcttccatccccacctacctgcagaggccgctggctctacttttaaaagtgacctcaaatctcaccacttctcaccatttcaactctagtctgtggtctgaaggagggcaaaatataatctctacctaatttccatttaaagccaggaaagggacatgattataaaactgttgtctagtctcttataagtcagtattaaactttttaagtatatgacaatgtctgtgccattcaacatttcacgtgtgttacttcttttatccccccaataaataaccctgtgctaacttttattaccctcagcctggccttcaagaccctgccagacctgccctggccatgcctcctccctcatctccgcccccactgccctcccctcactgccttctccacctctggccttctgccagctccatcctggtgagctcatcacccagggcctcagcacccagcaggctcttccccagacctggaccttttcatcctccagttcccacttgtgggagagccttccctgcctgcccgtcctctccctccctcccactgtcctctttattttcttcaggaagcattctgttgagtaaagaaacactactatttccgttttacagatgacaaaactaaaagaccagcgacaataagtgatttgtcaaagtcccattgacacagggagctgtgctggtttgaagcccacactggctgactcctgatcatttttcctgctttgacttcccagaagccttgccccatctccaaagagagcatcagggtgaagcttcaagacaaccctggttctgtggtctccaaataaacctaaagcaggctgtgttcctctaccattctccaaggcagtgactactgcaattcatcatggaaacactgggccagtttaaggattcccactcttaaaaaatagaggtataactcctacatgcccttaaaacccagctcagacatcacctccttcaggaagtcctcctggagttgaccatggcctcttctgtgctaccgtcccaccctgaacagactttgcactggctgtatgaatcacatcatacagttaccagttacccaatgtgtctcctatgctagacctggtgatcagacacccagggcagggactaatgtcaacttagttatttacagccttgggcgaggtgacggaaagagagaggagagttgtgtatctgacagagctgcgttcgtagatcccttaccacagagaccctcccagccctcaggatccccatcatatgcgcaccctgtacactgccctccgcaggactgaatgcaattataatagaacagttgtttttgaacaacatccctctcccgttagactggaagatccatgaaggcagggggcctttggtccgctgctctatctctcatgcttgtgggtggcactcttcaaacgtctgctgcatgattggaataacagatggaacgatgagaagaatggggaggacaagagaagaaaggagaggagggcagggaacaaacggaaggaaagctgaatgggctgccagctgcccaagtccaaggtccccgtgctctgcagcaggtacctacggcagcccgcgtgtgcctgctgtgcctgctgcatccccggggcatgagctcacctataggagtccccatctctgttgtagtcacacaaaaggtaatcctttcccaccaccttgtctctggcaattttcagtggctggtcaacagaagacaggagatcctcacatagactggggacctggcagagagaaaggacaaggtcgaaacagaggttaaaacagcacaccaaactcaggtggctaacaatactgcagccatattgtggtcagtacctttaacatctggccctgggcactgagacaaaattatgggcctgttcttttcttttccacatgtgtctgacaccaactgtgtccctctataaagaaacccattcttgaattacagtggagcgtgatttctaatacagtcttccttccaaaaactgtgtgcagctttaattacctggtcaccagggtggcctagtaaatttaagtgtgtatgtgcttggtattggtctctggtgggcaaagtacaagctgaagtcccgagaagaaggtaaacatttcaaatacacaggaatctaaagaactcggagtagaaaaactcgtccgtgccgggaactcccacaggctcctatgctgggtggagtctccagtactttccaggcccctagccaagtgttaccagttggcttgtagagtcaactctatctgctgcaaagagagcttcaccccggctcccccacagcacagagccccagtgggctcacctccggctggcctgccagggggccgcctcaccaagaaagatgaccccgcggtcgggggctggcaggactcaaactctgggccaatgttgcgactctgacacaaggctctgcaagtaaccaggccactggcctcctcctcccaactcaaacatcaatttctaccaaaatatcccagaaagggatggcagcactttcagaaatggattccttcaggcctgagtcacttccacgctatattttcaatgtgctgacttatttgtttcatgggcctgggtttatgggggctccaccatatcgtttaccaggaaagtgcctgccagttgcaccaataacccttcccagtggaaaaattccatcgtatggcaaagacaccagcagagcagctcagcagacgggctgacagcgacagtggttcctgtgttcttccagaaggcccttgccaccatccaagagacaggcagggacagggagtcccaccaccacagggaccacccagcctccacgggctcctctgctgcccctccagggtgctttagaactcagcttggaaagcaacgcccagcacaactaaaggactgtaaccctgcctcataactcacagaaattctggccttggtgagatgatctgtttcttatacaggggacagtacccaaagagatagacatacaccaccaacccctgtgtacaatgtgctgggcttacaggtgtgagcccccaggcctggcctgtacctgtgcttgttttcagaattctttctccatgtgtatctgccctttcctaacaaacataataaaaatgggggctactttcaaagttggttttggtgataatatcatgcaccttaccatttccatgtgcctgccatgcaccacgcactatggtagagcatattgttgacttgaaagctcacacgcattctgcaaagtgggtatgcaaagccccattttacagattagagttgaggccgggagccataaagttacccaagggccacacaagaagcaagcagtggagacagaaaacaaaaccagggccagatgagtccaaagtccctactcctcctactctaactttggtttaatgtccagctaaggggaaggacagtgcatgctaaaggcaccctctggtggcaaacagccctctcctagccccagccctgcttagctgtggccacagagcccttcaactggaaggaagtcctggctgaggaaggaaggtctaacagcttccacccgaggccatctgggacctgaaagaggccttgctgtgctgccacagccaatgaagccacctcacctaacacatcatgcctgtccctaagcatctctgtttataatgctgggatgctgccttggcttatctgttgggcctcaacttttgcctggaacccattctctctggttggagtcctgacaccatcagctcaatttttcctcaattacagtagagactgagcaaacagggtctgaagttagacctcctgactccgctgcgtacaagtagccttatggcctgggtaagtcattttacttctctactaagacttggtttccgtacctgtaaaatggggataataaaaccaacccatctgggtgcccatgcccatgtgattttgaggacccacatgacacaatgcattccgtgttcagggcagagcctggcacagggaaatgcacgtatgttactgcctgacacgttcaggttcctttcccttcctttagacaatatcatctgtcacctgttactctcagatggcaacaatagcctggatcatacctgaattcactgtgctgcttcagacacagggtacaaacgtacctgtgaggatccggtgcttcaccccagttccacctggagccagctgtttcccttctcctgccaggcacactgcttgcagctaagtcccctcaacgtaggaaagctcacaagaaaatagggtttggtataaaagaggcttgactctactcctatccaagagattcatctatgaatcgaaagcatctgagtaatctcttcctagcacttaacaccaggtggagtattttttcattgatcagttatctgtatccctcactagaatgtaagttttactggggcaaggacttcgatcttactcactgcaggattctcagtgcctgtggctgtgcctgacacacagcaaatgcttaatatatttgggaggaaggaaagaaaggagggaaagagggaggaaaggaggagttttacaacacggagcctcccaaactccaatcaactttactttaaaattaataaattggcaggtaataggaatctttagcaaaagcacttgtccagaactaaatctgaatggatgctgatgacaagtttcctgtgtggttccaacccagcactctcagatatgaaccatggtatggtgggaaagcactgaacaaagagaaccggagctgtcatgaaagccctggcattttttattaacatatgacctcaaggagccacagcattggtggaaagagtgagaactaagagacctgggttctagcctctgctctgctgtgagctggccacggaaccttaggcaaagcccaagactgttcatttgtcaaacacagtagatgagctgcacggagacagaccacccttgaagatctgtgatgggacttctgaaagccagtatgccaggtactaaccaaccccagaaaaacatacatttaaactggaactcaaaaactggcactgcttgtcctacagtgaaaagcctctgggacttgatatggccaacggactccacccaagcaggcaccatttttgccttttggatcaactcttaagctgggccatagttttggccatatttccatcagcgctgtttcttttgatcaaagataatctgctctggaataataacattttcgttgtcatggggaatgagaaatgtggaataatacatggtgtgcccacagacttggaccacagcagctgcccaaaggtgcattagtcacgacctggcaccatcactgatcccgtctcatacccacgccgtccctccacctctgcccgaaactcctcaaacaaccacacggtcccattcaccactccctgaacatgcacgtgcattcccccacttaaacatcttccccattgagggttgctggataaaacagagggaggccagttcagtctgaatttcagatacacaatgaataacattttagtatgactacttcctaaaggttacatgggtcgtgtgttttttttttctcaatgagatggagtccagctctgtcacccaggctggagtgcagtggcgcgatctcggctcactgcaagctccgcctcccaggttcatgccattctcctgcctcagcctcccgagtagctgggattacaggtgtgtgccaccacgcccagctaatttttctatttttagtaaagatggggtttcaccacgttagccaggatggtctctatctcctaacctcatgatccacccacctcggccacccaaagtgctaggattacaggtgtgagccactgcgcctggccaggccatgtatttttatttgctaaatctgacagccaatccccactgctctcttaaatcttactgatccttcagggcctggcccaaactccaacttctttatcaagatgtcaaattcttcagaattcctgcagtaacactaatatcaactgaatcctaaatgctttggggatggctgttctaatactgccaatgactttcaccttactccttcctcaccacttagcatttttcattgtgaattgactccacacctacagaggccaagacaggccctccagcctcagcgcagcatcacgcccgctgcagcagggatcagtcaatgcatgctgattccatgtaagtggatattaatcctgtggtctgaggccatattacagaaccagaatgaaggcagtgtatctctgtaatctaaccagtccctacactcatctgaaccccggcccccgccccctactcatgtcgagtgcttagagcagtggaagaaatcacattaagtgtcacagaccatgggtttgtacagtgatttaaatgaaacgacaggtccaaacaaagccgagagttcactttggggtgcatgtggcactggctctgtcgcctccaaagccagggagggcctctgaggaggaggagcggtgctgacacgcggcagccggatggtttctgtctaaaccacccatctgaactgcctaacggccttggagggaaggttcagataacaccaaaggtgtcagaccaatccaggctgttggggggatttaaacataattcccagtgacttggaataataaacactacactggtcaggacagtgcctgccgtctttctggtgggagttcagggctccaccagttcctctgctgccacaggagtgtgcccaccccagggagcaggagccacaagtccttcaccaccgatacttttgccgggctcggtggtacccaggaggccactggaaagacgggtggggagtgggtaaagtgaactagggcagggaaaagaaaaaaccccagaaggtagaaggtaagggagagactaggatgccattggcaacggcctcaggtgacacctgaataataatccgtggaaggaccaggtgatcgtaatagccctgccctgcgtggcaggcactatgctagcagctctccctgcccttccctatgatcctgacaatggctcttcacacagacacgcactccagtccttgttttaaagaaggggaaacagggccttagagaaataacttgaccggagccacgcagctacgggccaatgtctgaggaaggacatgcagttatatacagcacagctaggttcaaaaagaaactgcttttcccaaactgaacactttttttttttcttaaatcatccaacccaacagctgatcacacgaagagatacaaatcagaagtttccggccacaagtgaggttcgtgtttgtgccgccatatggttctactttgcctcttcctcttctccattagttattaatgttgaaaaaaattgttcaaccagaaaaagaaacttgagatgaacccttaaaaaaagcacaaaagccagagcagctcagacccacggagtctaacccacggcgcccttgtctttaagaagtgcacccttgtacctcggttttttaaaaaatggccaaatgaacacattccatcttttgatctgcctgttggccgagagcccaccaccagcaagataggaatcaaaaacagattctgcgtacttgggtgcactcagaggaaactgccacgccagaatgctgcagctgccgacgtccagcagagggctctgtgacaatttgttccttttatttttccagaaggcccaaaactttcttaaaaagataaaagagcatttcaagtggcacatacactcgtgtcagaaacaaaatatacagtgtggcattctgtaaaaacaccaacctcgaaaccgaacaggttcaaatcctcggtcagtcacttgctggctgagtgtaaccttcctaagtctctggaactgggggttacaacatccatgtcaaggagaaattcacactgttccataaaccccgaatgcccgctccaggcccgtgtcaggtgcaagggctcagcacgggaagagatggacatgggcggccctgctctgacagcaaagtccagccacagaggcatctccaagaggcaagggtaggccaggcatggtggctcacgcctgtaaccagcactttgggaggctgaggagggtggatcacttgagttcaggagttcaagaccagcctggccaatgtggcaaaaccccatctctactaaaaatatacaaaaattagccaggtgtggtggtgcatgcctataatcccagctactcaggaggccgaagcaggagaatcacttgaatctgggagatagaggttgccgtgagccaagactgtgtcactgcactgtagcctgtgcgacacagagagactctgtctcaaggtaaaaaaaaaaaaaaaaaaagaggcaggaagcgaacctgcaggagacgacagaagggggttgctgtgggggcaagtcagcagtctaggaggtggcacagagatgacatgtgaataatgaccaaggagccggccctccaagactgcagggaaaaataacaggggcatcccaagaagagggaagagctggcatgaggctctgctgcagaggccactgaggcaagtgcaagaacagagaggagcaaagcgcggctggagtgagacccagtgaggcagcacgcagcacctcctgggtcactccaagtgtgagggcaggccctggcacactgcttttcttaagaattaaaaaaaaaaaaaaaaaaaggccagctgcggtggctcgcttgagatcaagagttcgagaccagcctgggcaacagggcaagactccgtccctactaaaataataataataaaaatagccaggcatggtggcatgttcctgtagtcccagctactcaggaggctagggtgggaggattgtttgaacccgggaagtcgaggctgcagtgagccgtgtttgcaccacagtactccagcctgggtgacagagtaagaacctgactcaagaaaaaaagtgtttacttatgtataataggtaatacattcacataggtcagaattcaaaaaggtacaagagcacatgctgggaaaggcctcccagtgagggcctgcaagctggctgtcctcgcctagggagatggcctccaggtcaggatcccttcagtggggctcccttcaccggtctgtccagatggacacatggcctccaccagcctatgagagatgcaggaatccccaccccaccaccactacttagtgtagagaaaacacaagcctgctccccaactccccaagggcagcttcgttacagggaccccagtttgtcattaggaacactgagccacggaagcacagcttcatgtagccgaggctggagcttccgacccattttgcctaatggctctctgagcatggccacctctgcaatgagaaggcacctgcacaggcggcagcttcgcgccgggcctgaaagtcacacccgggtggccaagcttgtttttggacgggaagcagctgtgctcccagagactcaggcaagtggtacccctgagtaaccagagggggaccccaggggctcccgctcaccccaggaagcatcaaaacatatctccttaggataatagccacgtgagctagggtatggcgcacctattcggaggcaggattgagggcaccccccaacctgtggatgagaaaacccaggcacggggaagctgctggccccggctgtcccagccaacacgaggtggagaggaatgagaatctcaatttgagactgacccagctcttccaaagaccaggccccaccgggtcaacaaggcgagctgcccccatccccagtcaggctcaggggacaggggaggaaaaaagaatagaattgggggaattatgggactgtgaggaccaaagctttttcccccaagtgcccggtcacggcagacccaaggtgcctggggtcgcctgggaagggctgcagggctgggctctcctgcccctcaccacagcccacagcccacagcagatccgacatgtgacctttccactctgggcctcggggactcctggcgtgtgggcaggggctcagtgcctactgcccagcagagcctagtgagaaactggccccccgcctgccagggccacacacaagaggacacttccaggtccagcctctctcctctttaagaagtcacttggcgctgagggccatatttttttgttttgttttgtttttgagacgaagtctcgctctgttgcccaggctggagtgcagtggcgcgatctcggctcactgcaacctctgcctcccaggttcaagtgattctcctgcctcagcctcatgagtagctgggattataagtgtgcaccaccatgcccagctaatttttatatgtttatagagatggggtttcaccatgttggccaggttggtctcaggtgatccgtcctccttgccctctcaaagtgctgggattacaggcatgagccaccgcgcctggccaagggccatattctttaagtgcaagcacagcctgctttcttcctgtgaaggctgtaagttgtaagatgcaccagtaattataacatcgctaagtgtacacattaagtgtaagaagcaatttcccaattttggcaacattaaaacgcaagcgatggctgggcacagtggctcacgcctgtaatcccagcactctgggaggctgaggtgggcggatcacctgaggtcaggagtttgagaccaacctggccaacatagtgaaacgctgtttctactaaaaatacaaaaattagccgggcgtggtggcgcaggcctgtaatcagctacttgggaggctgaggcagaattgcttgaatccaggaggcggaggttgcagtgagcagagatcgcgccacagcacttcagcctgggtgacagagcaagactctgtctcaaaatacaaaacaaaacaaaacaaacaaacaaaaaaagtgagcaagccacgcaacatagatttgagataatggtacatacagcacatctggcggagtaacacagatgtttctgacttaagatttttttgattctgcgatagtattcagtagaagctgtagtttgaattttgatcttttcctgggctagcgatgcacggtctgatcctccctcatgacgcagggagacagcagctcccacagctccccacaagccctgtgatcaaaaaggtgagcgatgacactctacagccaccgcgcgccaggtgctttcaccaaactgtaggtgtgttctgagcacatttagggtcagccagcctaagccacgacgcttggcaggttagggggattaaaagcattttctacttccagtggatttttcgtcacgtaaccccttcgagggtgcagcagcatctgtacctgctcatatgaggcacatgactcaaggcgggggttgtggttggttacctagggtttaatacaactgaggctggccgagagggccaacattaggaagccatttttgaccaacaaatgatttattctacttagaaatgagtcttccacatgccattaacaacaaagagctttttcaggaaacggtaagtcccctccatctctttcttttctcagacaggtgccctgaccatccagagataaataataaacaaaagcaggcctcctgggctcgctttcagccattcatactccaaaccccaaagctttgccctctggaatctcacagcctggaaggggccacaacggtttcctaaagaaagggtcaggaaggggcagaacaaagaagacaaatggaaaggagaaatgaaaatcactacatttgggtcaaccacaggcacacacaaggctcctgttgtccacatgtaaccttaagcttccctgaaggggatgaaccaggccctcggagcctaattaaatgaaccatttcctggccaggcacacaacccatcacctgtgtgcagagaagccagggtctctctaagctcccggctgcttttaattaaggactcgtccctgagagatgaagcacaacatacaaaaccaccttcgagtcaccagaatggaagtcatcttggacttagtgctgagaactgcctgcagccggccagccagccggcaggagaagctgccgcctacagccaggcgatggcctcaggctaaggagcacagggaggctcccctgactcaggcttgccccacacccagcatcctgcatgtctatccagaccacctttcttccccgtgttccacctaagtcatccttcagggtctgattcggccacgcctgcctcttccactgcaacctcccaaagccgcgacggcagaggccgttgccccgcctctactcctgcaccctgtgcaggatgcggtcttgagcctcacaggtttgtgacatgcatgtgtctccccagggcagtgatgagctgtctggacggcctcatgcccggcttgatgctggcaggacttctgaagcgttggtgggatggtgtgggatggtggaaaactagggccacttgggtcaggttctgatcttttgaagcccaagcctgccttggtgggaagcaagttctcagcactcttcagcacctcccttaaaggagggactattcttcggtgagtgggagacagaccgaaacttgacgtggatggcatttcatcttcctgactgccagccctgagttggatgaaggtgtgcacccactgggcgtgggctgccgcctgctgtggagctgccgctgcccctcgtaccctacacaggctcctcctaaagccagacccgcagccttcccagcatgaaggcaagcacggggtagctgctgttctcttcccggacggtcctcagtcctcggtccagctttctcagtccacatttttattaaggattattggccagacgcagtggctcatgcctgtaatcccagcactttgggaggccgaggcaggaggatcacttgaggccaggagttcgagaccagcctgaccaacacggtgaaaccccacctctaataaaaatacaaaaaaaaaaaaaaaaagaaattaggcactgtggcgagcacctgtaatcccagctactcaggagactaagggaggagaatcgcttgaacctgggaggcggagggtgcagtgagccgagatggcgccactacactccagcctgggtgacagagaggactctgtctcaaaaaattaaaaaaaaaaagattatcgtattggcttgtattcttctgtcacctgaaatctttttgggaaaagaccaggtaaaaatacacaaacataactcatatataagttgatttttctccaaagacactgtaatttcacagaggatctctgtcctctcgtttaagtgaaaagatacatagtgaaaccaaatttttgttctcgtcaacattttaatgaaacattattcaagggcctgctgtaggtcataattcccaagaacctatggacaacattaagtgaggacttactgaactatcaaagttatgattggaataacagcaaagatgtttaggtcttaccatttaaaaggcatgtaacacacatcctcattttatcatcacagcaaccctgcagaaggcaggggtgttattatcccacattactgtttacaggtgaaaaaaagaggcacaggtaggttaagcaacttggctatggtcacacagcaggtaattcaatgaaagccatgcgatcccaccctaaggccgtgcggactctagaatgacacctggtgagtaacctagcaggcaaaataattcagctgaaagagtcaccagctggatggtggcagagagaagtacttggcaagattggtttttcacacaaggtcaacgcgaacggaacctctcataccagccacctactagggtacagcatcaagacctaatttcagggagggaaatgggaaatgcatccatttcatcatcactggatactaagggttaggcctggcctcaggctttataaaccacatgtgtgccaaatgtccacgtctaaacctagagtttagggtgaaaactatgaatgggctaccatggaagttacaaaataagaatgcagggggaagcctgagggcgcgcgccacccgaatgcgggaggagccagatggggcagcataggaagggctgttctttaccactgatctggggggctcatgatcgcccagagggacagaccaacagcatcggggtctgtgggttgatattcatctgcacgtcgacactggtggggatgccagggaaatctcacatgttctgtttagcagaaacgagacacctgaggcagaaagtgacaataaggagtcacacggccaggcaaccatgggcaatggcaacgcaggggatactttagaatctgaaagcctgtgaaacaccctcaagtccgagaggatctgctccatgatgaggaactccgtgacctccagggcccacacacggaggtgagccacagtcatcctgccacacctgctcagtctcccgatgagccaggcgaggtgctgagccctgtactcctcgccccaggggtcctgatagccccttgggaggcgaatgacctttgaagccacagcagaggctgaccagctcagagcacggagccactgagtcagagggcggaggtctggcttcctccaacagattctccaaaaatcctcacgatcacaagcttctaaacctccatgacctaccatgattccagtaatacttctgtttcccttcaagtgggagtgtttgtgccatgtttacgtgtctgagtgggggagcgggtgctaaggcagactcaacaagtcgggttgcttcgctgttctcagcacaaaagtcacccaggctgtctggccacaatgtttcacactggattccttccactggagggatgtctcatcaggttttgctgtaatttcactgagtcacccatagaaacgaccaagcaggggagactggaggggacatctccagggggccacatctgagctgagttacagaaagtgaggcagggctggcagttagggcaggtcgcaaagcagcccaaggactaaggtgcagacagagagcatctctgtctgtcaaaggcagacagcgtgggatgccgaatgctgatagctgcacaactctttttttttttttttgtcacccaggctgcagtgcaatggagcgatctcgagtaccgcaacctccgcctcccaggttcaagcaagtctcctgcctcagcctcccgagtagctgggactacaggtgcttgccaccatgcttggctaatttttttattttttagtagagacagggtttcaccatgttggtcaggctggtcttgaactcctggactcaagtgatccgcctgtcttgccctcccgaagtgctgggattacaggcatgagccaccatgcccagctagctgcacaactcttgcgtgtgctaaaaaccattggaccgtacactttaaaagtgtaaatgttatgttatgtgaattatatctccagaaagctgttgttaagaaggtgaatcaagagaggatattttaggcagagagaaccacatggatccaagacatcacaggtagacatccaggaaaccaacagtttcagaatacgagtacgtcatgtgacccagagttaggttggtaaaaagtgaccctgggtgtcaggaaccatgggcagtgttgtctttctcctcactctcagtcgtagctgtttgactcttcactcttactacccagagcttttcctacatcaaaataaaccaaggtactgcagggacttgccactggcctggaagtcagagctggttctgccatgaaacggtgctacatggggcatgggccacagctccctggtctctgcaatggatggttctctgagagaggagcactttgagggctgtgagtacagagggaggagctcagggtgtcaagagtgggagaggaagtctgggcctaccaccttctacctggtttattcaagttctaagattttgcttaaaaaaagggctgtaccaattttccaaatgtttgaaaaccactagatgagataatcggtaaggttcattttagtgttgacatcctacgaagtttcatagttcaagacttgagagttactcaaaagtttgtgtcatccctcctaaaacaaacctttactaagcaaggtactctgaggctcaaaccaactgtggactgcccagctcttcggttcacagccttaggacacagatgcaagcagctgagtgagttattcacaagaaggggaagaaggaaaaggcttggaacccataatcttctcccctgaatgccatgttcaaatttaaactcttagggaatttctatatttgtatacagaatccaaattcccttctcttttctcttccaggagagattccgagcccaccccttgcctgcctccgagacctcaacaccatcctgcttactaaagggagcccagtttttcccgctacccatggcacaggtcttcgtcaatttcagtgtgcccttcatgaatctggcatgtggtcactggcagttaaagggggtgatgatggagaggagaaaccccaggctccaactacaaaaccctgcgggacacgcaggctcctctgggcttcccggcccacattcctggcctatttcaaacatcagggaagcagactgagcgtgccatgccctcctcaagtatttttaacctgtttccaaaaccagacatgttctaaggggggcgacccaggaattcctcatccagggccagtgcctgccaaccgcgagatgttggctttctaacagctctgaggagggagttgttgtctgccttttctggcacgtggggaagtgggatctctctccaattcacttttacgtctcacatttctcatcaaccagagggcaggatctaacttaaagtgagagtcttcagaccatcctcaatggaagctctccaaacactgttctccggcttccaacaacaacaggagtccataaggttccccaaatgaaggacctggatagatcttgtaggaaaaaaaatcctatgaggacaaggccaaggaacgggcctatatgcacttcacttgaattatgcctcctggctctaggtgacaagagccatctttttcaccactggagagctcagcctcctaccaccttgccccgatcctgacctggttcagattcctcgctaacatacttctctcaccttgtagcactgttgcacattgaacaggagggaaaagctcttttgttcattttccttagaatggaaccaaaatgatactccagtagctccatctaaaagctcaagtggcagctaacagcacggacaccaggggcatcccttgccagcttccaatgccatggtgagagacactcatcatggtttaaaaaaagaccagagagcattttcacaagcaattcctaagagacttaaatttcctacacataggcagaataaaaaccaaaaaggaaaaaaaaaaaacttcccccaaacaaaagtgagggctttcaaggagacttgctgagtgggcaaacattttggaaagatggaattttaaacacaaacacaaaagggcaaagatttgcagcagaagagctatgcacacagccgggaggactttaattagggaaagctttgcaaagcccagggagcatcagcatcggcaaatctccccttggtctccggaatggaaagaatgtggaaaccaatgggtgatcaaggagttcgaattttgcctgacactcttgctgggaatgaagcatgcagtcctgtcttttgccaccttttcagcagcctcaggtgagccttttaaaaaggtgaaaaacgaaggaccacctagcctgggagaagccagggtggatcctctccttcctagggtgcttcctgcagatggcacacagccaaagctcttctggtgttttaaggcagaaacagaattcaggggaggactaaacaacccctttagagctacgtgctgtgttttttgtttgcatttttccaagtccaggcatttttccaggtatttccaatgagactgaaatggcctacacataggctgacgacctataataacataagaaagtgatgttggccccctgctccacccagaggggacatctgcttatttggcttccaggtggtgggagcagtggttttccccaaacagctaatacccttcaattctttgctttctgtatcatgaagttcactggagtttggagcacagactctttaaaccagtaatttaactctacttttgaggataccctatgcccccagcagttatgagaagggttgccaaatcttaactcataagggtgacaggatcaggaacaaaggcctggactctccacccttctcctctgccaaaatctacgagttcaggaaaatggcaagccaggagtttactttaggttccctcaagagcagcagctgttcccaccagggctgcgaaggaatcaacaggaactgagagaacacctgaatggtctgattcagaaagtcccagctccctgtgaggtcaataaagaactttgtctcaacagaggcaacaaggccactgcctcctaggaaaggactgatgtgggcttttctagaggcaggcaggctcttggatcaacaggcttacaagggcacatttctcagttacgatcttaaaattgcagggaacctgctgatctctgtcccttacccatctagaaagtctgagtgggagctaacagctgatcctcagcaaaaccagagtgtgcgcccatcacctgctttctggtaagggacccatgtggcctgaatcaaaactcaaagctcactagacaccaattcacacgctctatctaatcaggcagaaacccagctgctcctgctcagtccctgcccagctagtaccttcccaccacccaccagctgtatctcaggctctgcccactctaagctttccctgggatttgcctgccaagggtgggccacggtgtcctctgtggtgctctgcagtgcccatgttcctcacatcagaagccttgcattctggctgggagcggtggctcacctctgtaatcccagcactttggaaggccgaggcgggtagatcacctgaggtcaggagttcgagaccagcatggccaacatggtgaaactccatctctactaaaaatacaaaaaattagctgggggtggtggcaggcacctgtaatcccagctacttgggaggctgaggcaggagaattgcttgaaccagggaggcagaggttgcagtgagccaagattgtgccatcacactccagcctgggcaacaagaacaaaactccatctctaaaacaaaacaaaaaaaaagaagccttgcattctatccatcctgggttatctggctcccaccgtggctatgagctctttaaagacacaactattctgttgtcactctgaccctggtgcttcagcttaggcagggccttgcattcatgggggctcaagtaggcatgcactcactgaatgtccgcttcaggcttgacagtggggatacaaaggtgaacaaaagaaaagatccctgccctccaagagccaaagctcctaggatggagcaagtccaagagacaggagaagcaaggggcatgctggggggcagggtgagggaagtgaggctccagcggagatgggaagatgagcagttagagggagcagagttggtgtggacatgtgtcccagtcaaggaaacggcatgtacaaagatgcaacaagacagggcacaggcctgggagtgtgcaagacaaggagacaggaggaaggggcagggccagatcaagagctcttccacctagatgtgttctccgggcttgatcccgacaatgtggagtcattaagggacattatccgaagtgcattttggcaagactactctgtatgcagagcaggcaggggatgacaggcaggaaggcctgtctacaggctattataacactccagtaatgcagggaggagcagtagcaataaacattcattgaactgctctaaaatgaggattgggacataccttcacccaacaggctggataaggtggatggcactctgtaaaaaagtgaccccgctttgggcaggtggaactacatctccactggccttcagcagcctgagctgcacccagtgccccttctgcctgcctccctcctggactccagccgcagttcctccctgtcacatgccctacttaacgcctgcagcatcaagactcaagaggttgaagtacaagaggtaacagtagtaggccgggcacggtggcatcacttgaggtcgggagtttgagactagcctggccaacatggtgaaatctcgtctctactaaatatacaaaaattagctggctatagtggtacacacctgtagtcccagctactcgggaggctgaagcaggagaatcgcttgaattgggcaggcagaagttgcagtgagccaagatcgtacaactgcactccagcctgggagacagactgagactccatctcaaaaaaaaaaaaaaaaaaaaaaaaaatatggctgggcgcagtggctcatgcctgtaatctcagcactttgggaggccgaggcaggcagatcacttgaggtcaggagtttgaaaccagcctggccaaattggtaaaaccgcatctctactaaaaatacaaaacttagccaggcacggtggtacaggccagtagttccagctattccagacgctgaggctggagaatcacttgaactcgggaggtggaggctgcagtgagacgagatcacgccactgtactccagcctgggtgacagagcaaaactccatgttaaaaaaaaaaaaaaaaaaaaagaggtaatgggaaaaatgctcgcttgtcattgcaagatctgagctcacctcacagtccctctcccacctggaagaaggcaggacatttcagagcccgatcaagcagcattcacccacctatctggccaaacagggaaacgcaggctgcttttgacaaggggcacgcaccctcctccttaaaaggacagctcagcaatcatgggaaagcagtggattccagccgctcctgtcagggattccaccaccttctttggatgatttgcaccaagtattttccctacatgacttcctttaatattcacaattgtcctcttttagagtgaggcaaatccagaattctctccattacacagatgaggaaactgaggcctggagtctggtagcttaccgagggtcacctagatattcaggatgcatgctcccagccccagctaactcatgactccgtgaccttaaagactctgtccatatactgccacctgccgggaccaccagcccttgagtcccaggggctgaggtctcctgagtcatagctcagctccaagaggcatccgtcccttctcatctctgggtctcagatcacacagcctagaatgtctaatgtggactcccctcagaatttggggatagcagggtttttggttcattatctcatatttatttgtggccatatcgacatgtggccaggcactgtgttagggtctggggatagaggtgagcatcatggcatcccgcaggtgctcggaagccagagggccctccagtgctaagagtacagttacagcacacagcagtgctttcagtgcgttagataaaacgtggagatttggctgcccctacaggcagcgtttgggactaggaaggtcaatgagacaggaaaacaatgcgggcgaagaagtattaagcctctttaaaacacctgatgtacatatctcctctactcccaactgatgttcaacacatagctagaaagaggcaaaaaaaaaaaaaaaaaaaaaaaatccccttgtatgaaggataatcctttcagcctggggcaaatctcctgaagagttttgttctgaactaggagtgttgttttagcttccagtcaatagtaattaagagtcccaatatattccagaaagagggagagggagattaacgatcattaaatctcttctgcatttggctccaaatctcttttcggaggggccggctgtcagatgatccctccaaagcgtccatctgacagcactcccgccgccaccatctggaacatcaattcgagagctcgcctgaaggtttcaattacataaaaggcaatgggcccattaggacccgagagtctggagcttcacaagcgctgctcacaccccctctcctgtacacaaagcctctagaatttggttggcagtcatttgcaaagggactcattttggtgggggcatggggctggccagccccttggcaaggcctctctcaggcaggctctgtgcgtgctatgactgacagggtctctaatgaaccttaattgtgagctcgacaggcccaggaaggcagccacagatgtggcaaagggcaaccgcaaaccgtctgattagtgaataagaagtgtccggcccagtgagggccaatgacccaaaaaaggaggagggcgggactattcctcccccacgcatcccttctaaagctctgaagcttctttatgtaagcaatgcaaagcctctgggtgcactggaacccaacgcacccctccccccggcactactgcttggcagctggcagctgggatgttggggtcttgtgcttgttaccacggatgcttccgtctccatcagcagtgcacctttaaccacaggaggccagaacagaacgccctttcaacgtgggaagggggaagctacccactacggagactgagtaacttcttgccggtgctaagaattgtgaagacagctgcattcagagtcagccatcctctggtgacctgcagtgacaaggagaaagctactcctggggcagctttgggcacaaacagcgtgacggagaagacaggctttgcagacgggtagatcccaactctgctccttactaattagctgtgaggcttggaccaactcatgaaacctcacttggtttcctcatctgtaaaatgggcataaaagatcaaccttgtggtgtgcagtttaaataagcaaagggtctggaacagtacctggcacacgatagtcatctcttaaaacccgggagaacagcagagtattttgcgcaagtttgacatgacctcagaactccatgcagacagctactacaagccaggtactatgctagaagctttacaccccccatctctcattcttgaagttagtgtcatgcccatctcacagatgaggaaactgaggctcagtggtcacacagctaagacgtggtaaagacaagagctgaacaggattgtgcctttcgatttcaaggcactccactatcaacttcaatgctcctaaccaagcatttcaggcatcctcagactaacagcctagaaacacctaaccaagaattttgtagaatttgaattcccaaatacaccaaaacaggcttctctggcctggcatataaaggtgtggtagggggcactaaatggccaatctgtttccaaggaagtctgcaaaacaaatgaggactccacttccagccttggtctgcttcttggctagtggcacctcacaagcattttctgcatcagggtcatgaataggtagcagcaggtgagctgctaaaatagcctccccaccagaaagcagtcccaggagaggcccagagatacagaacagaggcccatcactgggaggttgtgtaggaccctcacacatagactggggggctctcaagctggggaaaagggtacctggggggagactagagatgtaggttcaagaaggggacaagagattcagaggaaagaggagcaagaggtgagcagtgctgataaggaagagggtaaatggcaaggaagctgggaaaccgacagaaaggatcctgaggacccaggtttcacaggtgacctggcacctctggaaggctgaggattgaggggtctgatgacctgggaggctgcaaggctggcttgtccttggacactgagatcaacctaagactccttcctgccgccttagaccatccagccacgctcttgtctagctttctctcccagggcttccgaagactttcccaatgataaccggggtcagctcctcattcagggagcagaagcaggaagaaaagtgcctagcaagcaatcaggaagaggagggggagagaccctcaccagggcggactgtgcagctggtgtcagatgacccttatctctgcagaatggaaaccagccagccaaagtctggaggctcaccttctgacctccatgactcgcctttgggtggggggccgtggcattttcagcttcccattcagggatccttaccttgacaagttctcatgactatctacaaggcctcaatggagggcctcttaatctccttcctcagttaaataagccaagtccttgcaaacgtgcactgggttataaaatgccccactgtgggagccaaggctgggacttggttcacctgtgaaaactcagcccaaaaggctgcccagggcatcagggcacagcctctaggctggtggaacccaggagtgagccaatcggccctaggaagccaacaaaggcagtaaaggcaacagccagcatcaattaagtgcctgtcttccactcacatctgcagtttacacgcaccccaaatcctcacaaccgtctcatgaattcggctttcggaaactgtgggagatgaagtgccttgtccaaggtctcaaagctggaaggtgaccaggccaggattcaagtcctagtgagccttctcttctggctctagtgagccacccagggacaaagactgtgggctggagtatctgctggaggcccctgccggctctgttctctccacctatttaccagatggggcagctcataggcctgagagaaactgaggtctcttctgccagcaaaaggggagcctgaaagtggtgacatcaacagaagggtatccatggtgatgttcttttagttctaggcaacagacctccagttctgagagactgagagaccatcaggcctgcacttcgcagagtgggggcccgagacccaaagacctgcaattcccaaagcaaattagtggcagactcaaagccacagcccaggtctcctgacttccagtaagatttgccaaggcaccttcttaatggacatagtgcttccttttcatctacctttgtccctcctattgaagcagcaggaagtttcctgaagcagttctctatttgcacaaatagataaataattccaaaaaagctatgtttccttctaccccattttaccaaacacttatgaaaataaaaggtttggctaatatcacacttagggccattgtcaaaaaagggtgtagaatccaggccacttagtgtgtaggttatgatccttcccaggaaaacaatgtttcccaaagcacattccttgaacgtgagttgggataacaggttcagttctttttttattaactgtgggacttctcagagcctttaatatgccaacatgggtgatgatgctcttaatggataatggagtctgattatccagactctggatttctcccagtcaatcgctgccctttatccctcaagagactcaatgccaaggtgaggggatccacttcattagaaagtcacgaaatgtgcaggtcacagtccaacaagaaacgaatccacccaccaagcagaaggaacagtcatccatgaaggaggcttttccagccatcccatctcggtttattttgcacttctaactactagtgaggaccaaagtttcacatattaggcgtttgtgtttcttcctctgtgaattgcctatgtagccagctctttcttctaacaaagtattcctacttctcctattgatggaggcaatgccatgtggtagttaagagccccggagtcaggttgtctgggttcaaagcttagctccaccatcatacttggtgaccctggataaactgctggaggccctgcttcttcatctgtccaatggggacaactctaatagcctcagcaggtgttctcagatttaaagagagaagcgttttgccaaaaggtacaaatgcttttcagagtgtgttccttgctttttaattttgtgtaaacttctaagttaaatttgcatgcagtcaaagctatcatttcggcactggcttatgcaccttctaaaggcctcttccatctcaagatcaaatactgatgtttgctctctgggtctttcatgttcgtttaatagttaattcttcagtccatgagaaatacgcaatatgactacatgctgttgcaatagagttttagtgtgttttccttcaaaagtattagctgtttcaacacatttattgaacaattatttttctcccaaataggaataccacttgtgattgttctaagttcttccattactgagtctgtttctgagaattctgactgatttgcttccgccactcagcctggagctctgcagctgtcttcacgcactgcctgcttgcctcttaggtgactgcctttaaattaaatgtaccaaaatcagcctgtgctccagcataaatcagttagaacagataggatgccaggggagatggagggacaagagcccatttgtaacagcaaaaggagatgccacctagaaataagctcccttactgaaccatcccgttggttcttgcagtgcactgctttttccaaaatttttacatttgttttaactgaaagtatagtgatatactacttgtgtctgggcaggatgctttcaaaatagcactttccccccaaacacacacaatgcaaagtgtgtatgggtggggggtggtggggggctgcaataggaagctttgcctctgccccactgttccaactgagcccgggttccccacagcccagccggttgaagggagcggcggctcctctgctggtcaagctctggaggaacatcgcctgcccagagctccacaccagcagtggcaggaagagaagttcaagtccttttcccttaggtacttccatggtgaccattcttcccaggccctcattataaatttcctttacattttcacttttaaaagattatttagctttggcaggacatttaagaaatggcatactataatattttcatttgtaaggctgtaattcagtggaaaatactgactggaatcaagaggtgggcttgacacctcttccccgcaaccccacagcacgcatcacctatcaggtcagagactcactgccctcctccattcctcagtttcctcccactcacttcacagaatggctatgaagacagataaggtcctggatgaagcgtattaataatgagacccatctgtcagtacttgctgacatctgatggagatccattaaaagttacttattttggccaggcacagtggctcacacctataatcccagaactttgggaggccaaggtggaaggactgcttgagtgtggaaggactgcttgagttcagaagtttgagaccaacctgggcaacatggtgagacccccatctctattttctatgtttaatttaaaaagatgaaaaaaatttttttccatgtaattgaaaagtattttatagggaatgaaagagggaagagtcaaattgttaatctgagaccaaacaaaaaatactttctgttttgaaatttgtattctctgaaaaataaccaaagcttactgcgtggctatcttaaagatgatgggagagcatcaattttcaaaatagttggctttggagaaattcaagccccttcccctaatggaaaatcaaccattactgttctaggacagctcaggactggtggatacatcgttgcagtctcctggaatcagtctttgctccccaaggaacacacacacaaaataaagccaatggccctactaatctctttggttcatttcctttctcttgcactcctctctttcattcattccaccgtaattgtctggattgcctttacagaaggcaattaatcgcattcttaattggataaaatgaggaaccattacgctgcatgtaacagaactcatcagaatctgaaatcacttctggccaaatctatgagggagctggtcaggtaagagcaccccaggaagccccacttcctctttctaagcaaatcatgccatttcttcctggtgaagggctgcctggctgccacctggacacaaatcagaggctgcactactaggtggcaggtcctcaggttgataacaggccggggtcatgaagggccgccatcctccggagaggccaggatgggcaggaaacgccagcttggcacccaccgtccagagcatgcctcctgctctccctgcctcagtccccacagctgccgcccattcacagagcaaaaggctcacgtgaaaagactcaccacaattttccaaggaatggagtttattaaaatactgctggaggcttttggctggaatgttttttctccttgtaaaacgggaactatagcagtgttgtctataggaaagctcagaatacgctcagaaacatcagtcacaacagagactatgtaggggctggtgcatattaccagtgattccatccattccgcggctcctgctccagagataacattcggctcagaggagaaaacttccaggcagaccctaggatgggtaggagagaggaagccaagtttccccacccttaacataaacccacggggaactctggtggaaaaagcatttttttaatgttaaaatgtcttgcatgtgggcatgttatggattggaatacaatttattttttaatttttttcttacgagatggggtctagttatgttgcccaggctggtcttaaactctgggttcaagcgatccttccacctcagcctcccaagtagttgtaacttcagatgaatgccacatttccagagagaaaacaatttttaaataagacaaaacatacaatgctctccttgaggcaggcacctgtggattttcccctaaaaccccagaaatgtgtatttgctcttctttcttcctctattgacatgagtactttggggaaagaatgagaagcgccaaggcacaagtcactgagaaaccggttaaaaggtggcgagcaatggcttgcagaagtggacaaacatttactgatagctgggcacgaccattaaagagcctctaacacctttatgagtaagtaaaaacaaataagcacagctgccagttatcctgttcaacagatgtacagcgtgcaaagctgaccacagccaggtcctccttccagaaattaattccccataaaatgtcagctccatagagcgaggcttttcatctggttctccacgaaaaccccggcacctagaatagtgtctggtgcatggatggtgcatttaataaatgtttgcagaaagaataactcagttctgcagctcttgctactcatcctcagagcttattcactggtcaatgaccaatggcctgagagaatccaactagggtcattcttttcggggatcaagctgaagaatccttgcattttgacccgtggaggagaaggcaaggaataaaggctgcacttcttcccagaattaaacacagtgcctgacttccaggaggtgctcaataaatgtcgactgaatccattaccttttcacttacttcagctgagacccttttagaaaggcaaaaacttaaaaacaaaacagggtctcattctctcacccaaactggagtgtagtggggtgatcatagctcactgcagctttgacctcctgggctcaagtgatcctcccaccccagcttcctgggtaactgggaccacaggcgcatgccaccatgcccaaaacattttttaatttttagtagagatggagtctccctatgttgcccaggctggtctcaaactcctgagctcaagcaattctcccaccttggcctcccaaagtgctgggattataagtgtgagccaccaggcccagcttaagtgaagacattttaaatgttgtctttgaaataaaggacgaaaaatgctggtctgagattgtttgaatgacaaggctaaaggggaagctagggaagaagaaaatgtaagcctgcttactctattaacacagataaagcagatcctatctggccttcaagatccccaaaggcaggggtagtcgtcttgggtcccaggcccagtgcagcttcatcacctgggggacaaaactgagttttgcttcactccacacagctgtccctggaaaaatgatttccagatttcattgctttgactattaaagactgaaaactgagcagcactgcttagcagacatcagatattctgctaatcaatcgtattaatgaactattgactaatagtatcatccttaacgtcaccagtcaattacaaatgtgtgtgagctggctccatgggctgcttcacggagagcaggtttttggaaacgtaagcagcgggtgtccactcactcgttcactaaggctcgaatgtggacacgtcccccaagcactcagccttctcatctgtcaaatcacactccctgcagacatcatgctgccccgatgggggtggcgatgcgggggtgacagggataatttcaaagcatggctaccgctgaggctggcagtgtgaatacctgtgcccagctggctctatttctagagggctgctctggctacttaaaaagaagaatatgctgaaaacagttaacctatgaagttatcaactccccggtaaaaaatcaggatgtctcttccacctttacctcactggcctggatactttcccagccctgatgtcttccccttgatagagtaaagtctggggacacccaagagctgagccttaggacaactgtaagaaagaaagaagtgaaggaactaaaaacatgaagtgaccaatgtttgcaagcagagactttcttgcctagttaaacagattcacggctatttttggtttgctcttaaaaaggcaaaggatggaaggcctgctgggtgccaatatgcagaaacaaactccttcctcagctcagggctcaaaatacaccccagctgagacatttctgctcttgctgccagtgtgcagagtaaggccatagaagggccaagtttatgaagccaagggaacatcttcacatcatatgattcttggccctcatggatgtgtgggtatttttgaaacagcttaacaacggatttcagctggattcactctagcacaatgggattaatatgtaataaaatgatgttttggccatctgcaaaggaaggtcatttcccaccaatcagagcaggcctcataatcccaaggcagcaaaaactctctgatgctgggaagaaaaaagaaagctgacctggcatgataaattgggctgccttggcctggctgccaagcatccctcacatttctcttcaataccactctgtaatcagaccatggtggactggatccattcccccacagttccctggccctgacatcttaagcgaggccattcccttcatggggaatgctggcaaatcctaacattctcgtccatcttaaaactggagacttttcttgaaaacaacaatctcccccccttcattatcttgggcaggtgagcagggaggaatgactgctgtttgcatggagcagcagtgcattagctactttcaaaacatctgactgatcccagattacacgagacaaaggcctggatcctttgcctttagacaggtgcataatagtgtgaattttctgaaactaccgctttgggaagaaactaaaactgcatgtgaacttcaatgctacaacagtatactcagcacagaccaatccttacagaataaaagcatttcgtaagttcagttaaacaggaaaaaagaaaaactgtcattcccagagaacactggcagtgatgaaaataaaacattcaaagaagaaacctccaggatcagtcacaggatccagtacaaagccagcgcactgccccttatatgagcatcgcacgtagcgaggagttcaaagccaggccatcaatcagaaagtggcttctgaagcatgtcaatatagttttttttcagtagagatgggttttcgccatgttggccaggctggtctcgaactcctggcctcaagttatccacctgccttggcctcccaaagtgctgggattacaggcatgggccgccgcgcctggccaatgcatgtcaatatagttttaatgaggcatgcattaccagatcctaatttgttgaaaagtcatgctccatttccattttgacattcctcatacttcaattaaaaaattaatgagaacaccgtttccccaacccactctggacgatgggaatccactctggcctcttgttcagcctctgaggtagacaaggccccaggtggcctccacacagccggtgaagggagctggtgcctctcaggccgtcccgaggcagtggaggaaagagaaccactaatcataaatggcctggttccgagaagggtttttttgccccgtgtctagttcttgcttttaaattatgtgaatttaacattattctccataatatacctatgtgttaacattttagattactaatgaatttaattaacagtttctctcccaacaggcaaaactgacacagcacatagacacaccacatttactctgttgctttcagtgtgactaacccaaaggaacctggcaagcaggagaaaccagacctcccggcgctcccaagccacatccctatcctggcttcttccccatagagtctaaatcatctaaaggaggtgaggtggccatatgtaccttacaggggtgttgtatgactttgaagaaacaataaacaacacaaacagaagtccccagcttagtcctgggcacacggcaggtattcaacacgtcagctgtccacctcaacctcagcccacctccaccagctctagcatacattctacagaagacaaagttaaaaacagaaaagtaggattgcctgaggtcagcagttcgagaccagcctgggcaacatagggagaaccagtctctatgcaaaataaaacattttaaaaaattggccagatgtggtggtgggcgcctgttgtcttagctacttgcaaggctgaggcagaagatcatttgagcccaggagtttaggaggctgcattgagctttgattgcaccactacactctagcctgggtgacagagcaagaccctgtctcaaaaaaaaaaaaaaaaaaaaaaaaaaaagtatgctctgacagtaatctatagaatgtcacacagtacaccatatatcagtggtagatacggcctggcacttcaacctgtgtccaagtaccatcctgcaactaagcctcagaggtgatctctctcattatctggctatggcgaaagacagctcttgatactctccttcattcaccatcaatgctgcaatttccctgttgagcccagggaaaacccgcacgggcagcaagggagccagttgaccaggttttcataaaagcagctacatgcacatccctgaaagagagagtgatgagggagtcccggagaaaagacacagctgtagtaaaacacttcagttgccataagaacaaaatagcctattaaacaccaggaagggtccaatgagaaaaatttgctcatcatttcctacttctatgtttggcttatttctaaaatacagtaataactaaattggcaaactaaatttaaactcagccaagcatgctttcatgctgagtttagaggaaaaacaagcccctgcagctgaccaaattaaaggcagatcacaccttcaacttttgcccacctcttccacgtaggatcaatcatagatttctgaccaagaaaaatgcaaagccattaaagcacttcccagaccacattctgtagtcctacctcataggactgatgagagtttaaatatggctgcgcatgaggcactgcatacaagttcagccgtcagtgggctgatggtgaccattctcaccacatcaagtccaaggtctcctcactttcaaggatacctcctacctatccaactttatacttcagtatttctcaacaaaggacatctcctctaacccctccagcccacactgcccgaccgcccccagctcacatttcacatgctcaggcccaggttctacacaaaactggacccggccaatctaacgtgcagcccaatgtttaaaaatcaggatattctgctgggcactgtggctcacgcctgtaatcccagcactttgggaggccgagacaggcagatcacttgaggtcaagagtttgagacaagcttgaccaacatggtgaaatcccatctctaatgaaaacacaaaattagctgggcacggtcgtgggcgcctgtaatcccagctactggggaggctgaggcaggaggattgcttgaaccggggaggcggagattgcagagaaccaagatcaccccactgcactacagcccgggtgacagaatgagactctgtcaccaaaaaaaaaaaaaaaaaaaaaaaaaaaaaccaccacacacaaacaaaccaggaaattttacataaaaccccaaatatatggctcctctagaaaaatgtgaaaatgagcaacagaggcttccaacagggcaacaagcaccaggagtaacgagggcagctgctcttcccacaggggcctgtgcctccagatcccaccatgcccacttcaatgatcttcctcactcgctggctcctggccggggacccctgatcctgagcacacagtgggttcatttgcatcacaactatgttactacccccctgaaatgtcgactgtctggcaggaccctctctttttgatacctgccttctctccgcttacatcacaagcatgtgcagttgtctctctgagcagccagtgacctcaagaaacctctttcttcccacttcctgaattactatgaatgagatacagcaggttcccaactccctccacaggctccgctctgtgtcacacacttgcctctcagctgggagtttgcatccctataaatatacaaatagtcgcactacagacctttcgggctgctgtataaagttttctgtgaatgacatccgtgcctctcctagcagtcatatatttttcctagtaaaaatgttctgaatgcatacaatggaattaaataaatcactacagcatatgaacaagttcccaacccactctaaaaagatacctcactgatgagccatgcttggcaatggataattacatccaagaagacacaggacacagtggaaaaaacagaggaccagactcagggactcacgttccaaacccagcaccagaactcactgccaagtgatcagggtgattcggctggcctcttaggacctgattttatttctttccaatatttcctatggctttatagatgtttttgaatattttgagcactcttcaaataatatggtgctagtgaatttgaggcaacatcttgagaccaatcattctgagcataaaaatctatgaaaatgaatagaatatttaaaaactagatgtgacgggccctttaacaagccaacttttgcttgttataccttttcaaactagaaatgaagccacggaagcatcttacaggtagacgcttgtactgtgttggctggagaaactcacaccatagcagagactgacagcgtctggcctgcgtgcactgctgaatgcctgcgggatgggtatggcctcttcctcaccacgtctaaatgcaagcttctagaaactgaagacaaggcagctggggagggagcagactgtcattaactttagaactcctaacttgggcttcaacaacacagatggttctgaatgacagaccaccatatgaaatccatcttctctctgcctggaggaatctcatagtccagtggcatggtctgccagggagagaaaaggtttcctgtgttgtgaattctgcatggaaaaagctacacaaaagcaactaactcttagccgcagtctcaaatggaaccatatgaaggaggcacgtaccaggtcgatcaggtcgctgaggtttttctcgatttgctggggaggcaggcgcctcattaggtccaaggcacagtccagctgctgatcactctgtggagggagaaatacaagtgcgtcagtcatttttgccagaaggaatatcaaaaactccttttaaaaagcatgcttgcccaaggcattctaaaacccaaagagccacgcagtgggccctccgccaggtctctgtgtgccagcagcctggagcggggggcgactgtgcaggctgtttgctcccctttgacagcagtctctgtctcaagtgggggcatccaaaagaccctgaaagaagtggaagcaggctggagacgtcagaaagctccctcaccggctcccctgctcctgctcaacaggccctggtggctgcagatgtcgtgccccccagttggttccatggtgaacacactccagtagcggattacttttgccctttgttgtaacctgggtgtaaacatcaggtaacatccccaggccaggttccttgagaagctccaagggagggagaaaagccaggcaaagaacaagtggcaagatgcacacggggttaaaagtgcttcattcattcaatagaaacttaggacactaagacctgaaccacactacagtcaagagctcactccacccagcaaactggactgcaaatgcagtaaactatgtcactgcagaggcaaggactggaaagacaaccattactcttgtttatcaagcactcttttaaaaaatgtttttcattttttaaagatagggtcttgctgtgtcacccaggctggagtgtagtggcatgatcttggctccctacaacccccactttccaggctcaagtgatcctcccacctcagcctccaaagtagctgggaccacaggtgcatgccaccacacctggctaattttgtagttttttttgggggggagggggggaacatggggttttgccatattgcccagggtggtcttgaactcctgggctcaagcagtcgaactgccttggcctcccaaagtgccgggattacaagcatgagccatcgtgcccagcccaagcacctttttaaagctatgcatcctgtgcttcaccatactctcctcacagtacatatgctgcaaatatttactcagagccaccatgtgccagtcaccataaacatataaaaaataaataaataaagggagggggagaggaagggaacagagcggaggcaaggctggtaaaatgcaaagtaaattcaatgcacagtgggttctaacacagaaggctagacctcaggagatgagacaagaaataaagtgagaaaggtgggccaggtacaagggtgaagacctgtgtatgcaactcttagaagtacaggtgactccaagtaaggcagatggagtccccaacactacccaagcagccactatctgatttgtatctggaatctgctctgctcagaccaatttcaggatttttggaaggcctaaatcaacaagctacagtctcataaaatacacaaagtaatcctcaaaatgccacatttggccttaacgaaatataacttttgaatattaccgtttacactccaggtctgttaaccacaagtaggccgtggggcaaggacccacttcatagtcaccagagacataacacattattaaggagagtcaatttcatttttttaaaaaaagatattgacatggcatatacagccagctgttttaaaaaagaatgaaagaaaagaaaaagcctgtcccttgctcaagatggctatcagtgacagttcatcctggaacacacaacgaactggctcccctgcaaagagaaaagaaaaacaccacaccagaaattctaccacttgttttgctgaatgccagcaaccatgaattccctacttgtgccacgcatttctatgccaacatgtgtcagccaaggccacagtgatgggtttggcccactggcatgagaggaaattttaacaccacgtcttgggcagaacacacagataagctgattcgactctagagagacatattcaattcccaatactgccattcattaacttatggccttgggtgggtttcttaatctctagaagtctctatttatttatccataaaatgggaacacagtatcttccttagagagtgacaataatttagtaatgcatgtggaacatttaatacacagtagtatgtgtttaatgattggggatattgagtgcatacaaataaacatacagcttttaaatctttttaaaaattttaaatgattcccctgcccaacctccccgcccctcaacccagccctggatctctctctctctctcttgctccccttaaactagagctaatgttcaaactcaatacaaagctacgtattctcttggccaagcaagaatagaaaaccctaaatgattcaagtcaaactcgttaaaaggtataaactagtatttctcaactagggatgattttgcacacgtgcacacacatacacacacacctccaacaaccctgccaggagacatctggcaatgtatggagacatttttgtcacaactgggagagaagaaactactgacatctaatgggtaggggccagggatgcttctaaacatcccaaaacgcgatacacagcctccccacaacaaagaatcacccggcccaaacgttaatagagttaaggctgagaagccctgggcgaaaaataattggtttgggggctgcagattcccagaatctgattgacaataaagtccccctcaggaagactgcacatgcaggcaaacgttttatatataattctaatttaaagaccacacatacactttgggaggccaaggcgggcggatcatgaggtcaggagattgagaccatcctggctaacgtggtgaatccccgtctctactaaaaatacaaaaaaattagccgggcgtggtggcgggcgcctgtagttccagcaactcgggaggctgaggcaggagaatggcatgaacccgggaggcagagcttgcagtgagcccagatcactccagcctgggcgacagagcgagactccatctcaaaaacaacaacaacaacaacaacaacaacaacaaacccacacataacccctaaaaatttctggtcttcagaaagtatctcaactagatattagcaatcctccttataaatgaaaagcaaattaagatataagtaagcctgtctaatttgaaacggtgatccagacagaacacagaagggattaactagaaaactgagcagtgttatctaggaaaagacctaagttgaccagagaagctcaaggtgaaagacactgttttaacccttcttcggtgcctgttcacaagcccagttccaatatgctgatcacatccccaccccgcaaggggccggacagtcctctgtagacctgtatctagttgacagcactagaatactactacaaaaggatctgactcatattttgcattaatcccaattaatcttaattggaaatgtttcactacaaatttctaaggttaaggatgtttaactatcattcaatgaggaaatgactaaatgcttcccataagtgaagcaacatgggaaagcttaatgacagcttttaagacgttaaaattagagttaactggagccatttgcttgggagtcatcccaaaccctaaggggtccaaacaggaaacggtaccggagaatgaagcagatgtggatgaccttcagctacaagcaacaacgtaagtgacccaggaaatggaacgatggggacagagggagggggctagtcccaggggcctccctaggatgctgtcacttttatataaagctcaataacaagcaatagtgaacattctttttttttttttttttttttttttaaagataggctctcactctgtcgcccaggctggactgtagtggcacaagctcagctcactgcaacctctgtctcctgggctcaagctatcctcccatctcagcctcctaagtagcttggattacaggcacacaccaccatgcctggttaatttttgtttttcttgagacagggtctcactttgttacccaggctggagtatagtagcacaatgtcggctcactgtagcctccacctcccaggctcaagccatcctcccacctcagccctccaagtagctggggggccaccatgcctggctaattttttgtagtttggtagagatggggtttcaccatgctgcccaggatggtctcaaacgcttgacctcaagcgatccgcccacctcggcctcccaaagtgctgggattacaggcatgagccaccatgcccagccaatttttctattttttgtagagatggggttttgctatgttgcccaggctggtctcaaagtcctgagctcaagcgatccatctgcctcagcctcccaaagtgctgggtttgcaggcgtgagccactgcacctggccatgaacactcttattatttagacacgtgttttagactaatataacaaggcttttttttttctttaagccaagacaaaggtatgataaatacaacatttaagaagagtagaagagcagttctagggaagccatgaggggaagatgaaagctatactgtctaggtctcacatggaatggcaggttcaagggtattcatcatcaacgtgatgcttaagttatgattatcagatatctaaactttttttaaaggtaatagaaaaaactacaagtatgcagggagtggtggtgcgtgcctgtagttccggctactcgggaagctgaggcaggaggatcgttcaagcccaggagttctgggttgtagtgtgctatgcccatcaggtgtccgcactaagtttggcatcaatatggtgacttcctgggagcagggaaccaccaggttgcctaaggaggggtgaaccggcccaggacagaaacggagcaggtcaaaaaatacaaggaagagcaagtaaagagagggcttaggactcaggagtccagggtccaaggtatgccctgtcactagacgtctgtgtgctttggactgctcacttaacctcgtggcctgggatttggcccagatgaactctaagactccttctagatggagtgccctctatcctactgcgagagcagacatgcctaaccgccacacccttcaaaacaagaccatcatcctggatttggccgcttgcaggccagcaactgggctacagttcaacaactgtgcactgagtgccaaccctgggccaggccctgaatccggcccaacaaatgagacccagtcccaagcctcaaggaaccaattgtccataaaacagcaaataaccacaaggtcgtgtggtgtgtacaatgatgagacagagaaggtacaaagagacaaggcacagttcacaatacactgatttgtacttctttgtgtcaattattttcctaggacttccctccctcacatggctacaaaataaacagaaggccagtcaggggaagtaaactgtcacctggtggctaagagctctccacaggccagctccttcaaaactctgactggtccaggcacctccttcatacaatgagcttcaccagttccaccacccaatggtgtgttccaggtggaaaggtaaatagtaaaagaaggaccatttctccttatcctctggaattctctgtccattcaattaatcatctgatcattatgtgagtgtttcctaggtaacaagcactgtttctgatgctgagtggtgaacataaaagtctctgctcctcatggagcttatggtgcagtcaaaatcagtgtggaaaaaaaaaatcaaggaagagtccttgttaggatgtcaaataataaggaggggagttaccccattttaagctggcaaggctccaaggggtaggtttagggggttttttgtgttattttcttattttggtatataaactgagataagaaatatttcacctcctgttttcacatgatttaaagaaaaagcataaaattgcttaaatcaccctgcaataaataaaaccaccattaatacggactaaaacaatttttcagaataagaaatcagtcaaataaaaccccaccatctaaatatctgctacagtgttcagacatccgacggtattatgaaatcatctgcatacaggaaaacttggcctactaggcaaactccagggcaaagtctgatttggaaaccatcaagtgagatgtaaccagtacctacactccaagtttggtagagtaaacacaccatctacaacaatgtcaatgtcagagtacaggtgcccactaagtagggcagggagccccagaagatgtctcagaatggggccacaggagcaggttagccctggataagcaggtgtgcctttccaggcagcaggtgcagcaggctaaggagaggtgagccaggtgcgtggaggaggaggtggggaaccatggggcatggcctggggaggtgactggggccttgtcacaagagccagatcacacccaaactactcagggggcagctatgctggcccgaggagctaggctcagaatctcacttctccccgcagttttttgctcctgtccagtttataggtaaggcatctgtgccacattctttaaaatccacttttctgtgaaggttttggagcccctagagatttttccacaggggaatgacgactgctgttgtgacttagaaggcgaagcagattatattttccaaaaatgaccataacaagcagtcccatcccacatgctcctcttgcagcgtgactgtgacactcctcccacttgtggtggggcgggggggggctgtgtcccctccgccttggaaccggaggagcttttgtaactttttatcatcagagcccagcacaaatgatgccctatgacttgtgagcccacaagagacaacgcggcttctccctgcctgctaaacacacaggcctggagcccactcaactgccccgaggccaccctgtgcagaagacttcctgagactccatggacagagggaggcccactgagcccccaggtgctccaggctcccactgttccagcttcagctatctgactgcaatagtatgagaccccaagccagaaccacccagccaaggccctcctgaactcctgacccacagaaaccatcagagacaatgaaatgaattgttcctttaagtcactaggtttcgggatggttttgttagacagcaacagtaaatgacacagaaggatttgtctggtgaccttggggagacagcctgaccagagacgaaactggggacagaagagctagcagaggagcctctacagcaaccaggtctctggctggatggccagagaggaggagagccaaagactttaaggtcacaacagataggacgaggtcagttactggaaatgggaagaagcccaaggagcctgagatgactacgtttcctagctggggccaactgctagaggatggtgccacagcctcaccggagtgtgtacgttttgtgtgtgcttttaaaacccactgtttttaatttcaaagacaggcacaggcagtaactcaaattgctaatgcttgcaagcagaggtcctgcttggcctgctgtagtggctggttaaggcagatttgtgcttaacagcatctgtctgtacataaacaaccaaccaaagcttcaaggccttcagagtttgttcttaagttcatcaagaccttcactcgtttacattcccgagaggcttagcaaataacttcatagacagcacaaaggtaaactctgctggcgcccagaatgacttaccacaaatttatggagtctcacttaaccatggtttgtcttgtataatccgtgacccaataagcaactttgtttaaacgtcgaatctgttttctgccatgtggcccgggaacagtttgtgctgggggcgatttggagaaggaatcctgggccggcccagccgaccactcatctttaggtcactctggaaaactgcacattttggattaataaaaagaaaagtgcttcctccactgcctgagtgtcctctgggatgtgacaatagctgtgcaggagggagatgcctcaaccacaaacacacgaatactccttggatgactttctgttcccatgggaaaatccaataccctcgctgtcaagggaatcacagccacgacagaagtccacttggcggaccaagccttcttcaaccttttggggtctgctgtctaccatcatagccaagtcaatgtcatctttttaaattgaggtttttttgtttgttttgttttttaaaaaccatgcaacataaaagtaaccattctagtcctactctgaccatagagacaaacacaaaaccctgggagatggcagggcaacatgaaggaagaggctggctctgtggatgacccaccagccagaatgggtgacctgttgttatatgagaaataaactcctatctcatctgaggaataaaatgtaaccattttagggctggacatagtggctcacgcctgtaatcccagcactttgggaggtggaggcgggtggatcacttgaggtcaggagttcaagaccagcatggccaacatggtgaaaccccacctctactaaaaatacaaaaattagcagggcgtggtggcagatgcctgtaatcccagctacacgggaggctgaggcaggagaatcacttgaaactggaaggcgaaggttgcagtgagctgagatcatgccactgcactccagcctgggtgacagagtgagactgtcccacaccctccccccacctgccaaaaaaaaaaagaaaaagaaaaataagccattttaaagtgaacaattcagtggctatgttaaggtcatttggattaccgtgaaaacataactgctttatgtgtctctctcttttttcttttataaacaagtctctcctttaaaaaaattctgttgggatcacagaaattagatctggactgacatctcaatttcatctgagtcctgctccttcatttgacgatgcataatgaggtccagcgcaagttttgccaggttgcacagatagaggcaaaatccgcacctaaacctggatcttcttcgtgttttgaggcctggctctgccccgagcccttctcccccgtgagtctttcatccagggactgtgtaagtgactggcagacacaaccgaacagtgagatgagattctcaccctcaaggagctgtgacctaaggtagaggacagccagaaaaaaaaagcaggaaagaactacaccatcctcctacattcaacgcccagcatcccagctaccccattattttcgaggactggtcctcccagtgatttgtccaggtcatcaaggtatcaactttttaaaaaaattctagaagacagcaatctctctaaaatgtattacctgctctacatttttacacaatgcaaatgatcacaggacaatgcaatgaacacagctaaaccatttctcattagcctaaggacagtgtatgagtagccactcttggaacagcaccctgtgtctgctttttacatttatctgcttcttctgccaggctgtcagctacacttcctcaactaatatgttgcttctaatctgctatgaggttgagaacccagaaaattagaaatctgctctcatttcaaacaaaaaaaaaaaagaaactctgagagaaggaataaatcaggttgataacttggggtccagagtcacagcccacaaatagtttgtaagtaccttgacactatatgaagattacttcttccttttcttgaagaagttcaagactctaaaggcagagatacgatatactaataattcctactttcccatacaacctgcataagcaagtcaccacctcatcccttggaacctcagtcttctttaaaacctgggtccgacggtactgtctacctcacgggccactgggaatgaggtaccacgtctgggccataagggcaccgcccacagagcatcctccataaagggtaggaactctcccagagagtaaagcacatggcttatctgccaggacttttacataacattttttaggtgctagagggtcctttctgcctggatttttccctcacttgacacaggttttccattcaggctgccaggagtctctagaaaggtaggcggagtgttatgtcagtttccaagtcattaagcacccacaaaggagggcaggcttgcacagcactcactccacacaaccgcccctgccctgagtacgacggagcacatggcttccctaaagccacaaggagaagagaggcagggacagtgagagctgaaggaattccacatgtgtccatggaagatcaccttccctttgttttcctgcactctagtaactccctcatgcagcttgctttctgaagccctctgctccatttccccagcccaggacagcatcaagaaatatttccaccatctcatctatttgaaccttctccctatttactggtgctcccaaccccatctgaggccatcgaaaccagacaactgtggcagcactagcagagtccccaaactaccctgacaccctccctggcaaggaaaatttccacgcgcctctccctggcatatttattccagaggaaaacttagcaacctacacactacacacaggctctgtgtcaaactctacaacagccatcagttgatctttcccttacacatccctccaggaagtgaaatatccgaaatgagtcatactcaggagtcggagctatacttccactgtagtttttttggataaccaattcactgtttacactccaaaacctctaattgctgaacacagaacagttcctttgcagagatcaaagcttacctggtgaacctggcgaaatgacaaaaattctccaaaaggagttagccatccagagtgccagaggagggtggctgtacaagcacattttaattggcaaagcagagtcgctgcccagcaaggaagagtatgcaggggtttattctgctgctcttctatttcccctttaaggcatatatctcttacccctgcacccaccaactttagtcactcctagcacacagctggcggccgcccacccgcacccgcacctgcacccgcacctcagagagcttgctgatccctgagccgtgcactgaagcttccaagcagctctacctaaaggcaagcactgcctgctttttacaacatatacaatgggctaacctgatgcacagaaaaaccctgggtcacatgacaaccaacaaactcattgctcaggatggctctccgccacgtttctcaggcactgtgcttggctctgctggccaactgagtgagctggagcattttctcttgggtgtgcatacccctccacctgtccaactttaaaacacagaatcaacagggatgttacactaaaggggaccctagaaaccatataaacggtggaaaattgaggcctggactgacccataacaaatgagacatcacataatggcaaatgaaccatgaccagaaaacaaatctctttagtacacagtttagcgcttctgcttatacaggttgaacagccctaacccaaaaatccaaatcccaaactttttgagcgaagacatgaggctccaacgagcatatcagactttcggattaggaatggtcaaccagtaagttctgcaaatattcaaaatctgaaaagaatccaaagaagtctcaaatccaaaatgcttctggtcccaagcatttcggataagaaacctgtagtttaatcatcagtcaaaatttaagaatagagttgattttgggccgggcacggtggctcatgcctgtaatcccagcactttgggaggccaaggtgggtggagatcaggagatcaagaccatctggccgaggtcagcagatcaagaccatcctggctaacacggtgaaaccccgtctctactaaaaatacaaaaaatcagctgggcgtggtggcgggcgcctgtagtcccagctacttgggaggctgaggcaggagaatggcgtgaacccaggaggcggagcttgcagtgagccgagattgcaccactgcacaccagcctgggtgacagagtgagactccgtctcaaaaaataaaaaataaaaaataaaaaataaaaaaaaagaatacagttgattttatccaagaaaatactacttcgggctgcaagcaatggcttacacctgtaatcctagcactttgggaggcagaggtaggcagatcacttgaccccagtagttcaagaccagcctgggaaacacagcgagaccccgtctctacaaaaaactttttaaattagccaggtgtggtggtgcatgcctgtagtcccagctactcgggaggctggggcggaaagatcacctgaggttgaggctgcccagtctgcataacagaatgagatcctgtctcaaaaaaaaaaaaaaaaaaaaaaagaaaaaaaaagaaaatacgctttgactcttttgaataaaattctacattattagcattaacaatggcagtattaagaatatttatatattgtccagactgggcacactggctcacatttgtaatcccagcactttgggaggtcgaggtaggcagatcattgaggccaggagttcaagactagcctggagaacatggcaaaaccccatctccatccaaaatacaaaaattagccaggcgtggtggtgtatgcctgtagtcctagctacccaggaggctgaggtatgagaatcacttgaacctaggtggccgagtttgcagtgagctgagatagcaccaccgcactccagcctgggtgataaggtgagaccctctctcaaaaaaaatttgaaaaaaagaatacttatatattgtccagataattttatttttatttttaagtgaattgatctttattaagaatactaggtatccaaaaggcaaaccaatttcaaacgcaaaagggaaggaaactaacaactgctaagggtggcccggcatgggccaggcgctgcaccctgtgggtttcaggagagcctcacaacagctgcaggaggtggctcttgggtaccccagtttcacagataagtaaaatgaggccctgaagggttaggtgacttgccccagagcactgaatgacacagaaggacataacacaggtcccctcccatgcccaaacattctccaaagaatgttaaacactcccaatgaaataaaattaatttctaacgacttgtagggaacaacttgcaagctcacaaaatcagataggggcaatgagtctcttctcccgggatgaacaaattatggacaatgtcatctactaccaaattctgaaatctgtcaccgtggattacagacggtattctcacaaacactatccctggcaggtggatttgtcgaaaacaagaaagcctctcccacacagtttctctggttgacggtttcctggaccccttgagaagatctgcaaggcgccatcaccttgtgtctgatcattaatgtttcacagatgtctacagctgctgcctccacatgatcctggctggtttcatgtaacaagcgactaatccctgcactttgtcaactggcagttagacacataattatgggcaatcctgagacgtcttcaagggatgccgtacatgttgtccatttcccactcaatggcacgagaaattcaagaagcctttcacaaaagtggaagctgagtaaagcagggtgctcctgtcttccaaataacagttaaaagaaaaaacaattcagaaaaatgtcgaccacgtgttcactgacgaaggctaagaaaagtaaactccttttttcatagcagaagcagccaattcacataaaccaaacagatttataagatggcctagatgaaatctataatatttggacacaggtttactccaacaaaaccctgcacatggcttccaaagacatcggggagaagcttcagtccaacctgcaaacagcacaaacgggcatgtctggatgggaaagcaaaaaggtttaaaggatctggaaaaaacgaaggctccatcaatccaaatattttatctagaagggggtggtgctgcttttttgacttatgtccaaaaggaagcttgaggaaaagaacacagtgcttattgatccaacaaaccacttgggctatttcttccctgggctcttgggctccaatttcagatgcctgtgtgtgactcaatatggaagactctatcaaatctctatttgtccctgtcggccttccccatccagctcaagggtaactctattacagcaccacgctctacactgacaccatgggcccagcactgcagagcacaacagaattctgcaacaactggccctctggctcccctaaatagatcaccaaagttttaaacatattttagtgacagaaatgtacaatgcaacactctacccacccatgatacctttgcaaacttaacccaagacctgtcataacgttgccctcttccaattaatgtcaggacccactgggtagggagatgcctgaaacatgacatcctttgggcttcgattttccagaccaaagacagagtccttgaaggtctgcagctggcagaaagaccttggaagtaagacagacaagagttcaaagcccatactcgccatttcctagcaattaaggtctgaataattccttcacctctctgagcctcgattccttcatctgtttagcggcaataataatcaaacctatcttacagggttattttgagaacaatatcacaaaatatgtgtaaagaaagtagcatagttcctaaaacaacaaatattcaattaaataaaaaaaaaacaaaaacaggcattggctgggcatggtggctcacatctataatcctagcactttgggaagctgaggcaagaggacagcttgaggccaggagtttgagaccaacctgaccaacagagtaagccttttttttttttaagggttaaaaaaatacaaaacaggtattatcaccatcttcttatacagaacttcatttcagaaaacataagattataatgtttctagccaacgcagtggctcatgcctggaaccccagcactttgggaggccgaaatgggaggatcacttgagcctaggagttcaaaccagcttgggcaacacggtaaaaccccgtctctacaaaaaatacaaaaattaactgggcatgcctgtagtcccagctatttgggaggctgaggtgggaggacagattgagcctgggaggtcgtggctgcagtgagccacgattgtgccactgcactccagcctgggggacaaaacacccaaaaggcaggagagtgggtagccacagaacaaggggcctgataatcaagtcagtcaaaaagttttttttttcctttctgtctcaaaggaaaaaaaaaaacacactcattataatatggaattaaacatatacacgcacactctcacttatgtaagttaacattccctaaaggcatgagagtgggtagccccggaacatggggcctgaaaatcaaatcagtcaaggccgctcctttttggttcttttgggtaagccaaaatgatctttactagtggaaacattattcctccatcaacagacaagtttcctgagagctggtgaacatcttgccaacaagacatatttcgcaagctcaaaacctttctttccatccccaatcaaacgctgagtgttatgtctcaagaagaaagctggctgaggaaggagcttaacatccttccatgagcaaaaagaattaaagaaagggaagcaacaagttccagttccaaaatagctttttgataactaggaactaagcccagccctggacagtattactgactctcaccaccacctaaagcaggctctgccaaacacagcacaacaaccaactgctactaacaactttcactaagcaggtagtgcacggcaggcgctgacttagggcttaaaacacagctataatagtaatagctaaaacttattaagccattcttctaagtgctttatatgccaatatctcatgtaatcttaaaaatgaaccaaggagttaagtgccagtatcagtctcagatgcagaaactgaggtacggagagagtggtgagcttacacatttaaatggatggcagagctggggttcaaaggcaggtgcatctgaccccagaacctgtgtgcctactcaatactccacagagcccagcagctgggccacctgtgctaagaaccactgccatctctttgttttaaagtctccaaaagaagaggagcgggttatttagcacctacttttgcacagttgagtcacaagtgaggaaggcagcaccgctctctagttaaggatacaggttggaaagcaagattgtctgcattcaaatcctgactccaccgggtcccagctgtgtgaccttggacaagtcactaaactcttctgagcctcgagttcccccatctataaatgagggtagtaacacagtagtcaccccttatctgcagttttgttttttggcagtttcagttacctgtggtcaaccatggtctgaaaatactaagtggaaaattccacaaacaatttggaagttttaaatttcacgccgttctgcgtgatgaaatctcatgccttcccactccatcctgcctgggacatgaatcatctttttgtcccgcgtatccacactgtacaagctatgtacccgttagtcactcaggagccagctcggttctcagatccactgtcatggtgtcacagtgcttgcgttcaagttacccttattttgcttcataatggccctaaaacacaagagtagtgatgccagcaattcagatatgccgaagtgaagacaaaagggcttctttaagtgcaatttctcaatttaataaaggaagggaaaaactatatgcggagactaagatctatggtaagaatgagtcttctatctaaaattttgaaggaaaagaaatttgtgctagttttgctgtcacacctcaatgcaaagcatatagggttcgatattatctgtggtttcaggcatccaatgggggtcttggagtatatcccccatagctaaggagggacaactgctatacatacattatactgttattttaaggattatgtgggggtaatcctcattcagcatctggcacatacctgggacatagtcactgctccataaattctacatgttaagtcaacagaaaagaggaagaaacaagaaagtaaaagcatataatctaacaatttcacaacaaaggcctcgctggccttctgccaacctccagaaaacagtgctggactctgtgtacccgcagtgtggctgggactgcagacaccaggaagaccttgggacctgtggagcctggatggttcagttgtctgagccaaggagggctggattaggctcagtgatcgaagctgagcaagtttcagcacatacctctacaaagtggacgcccagggatggctgatatgatgattctttaggaagccaaatgctcagtttctcagaaaggtgttttcctgtttcatgacagataaaaaggtttctcatccagacaaataaatctgctgactgagagctttcattaaaagcaaacagtcttgcaataaggaaccgtaagctaggaaggccttccatgaatatatgaaatgtcacaagtcctcagcctgtgtctgagagtgagagagggagaaatttgagaaggtgctgaccagctcaaagactgggatatcataaccctaacaacatccagtcagtacattcctcacctacaaacgaaaatcacaggcaaggccacgcaccgctgagtcccaggagacacaccttcccaaataagtgtttgggtgggttgctgttaacttccaataaagcagataaatgtcatcaattgcttcctgtcttcaggtcttgtcaatacagaatgctaagtccgctagcctcgaaagcctgtgtaccttccacagtcttaaagacttgatgggaaactggaaaagcaatcaggaacagaacaccatgggcacgagactcattccaggtactgtcacagcaagatacccttctagtattccaaagctaggaacacacctccccttgctcccgccagcccagggaaaccgaataagctgtttaccagggaccccagcaaagcgagcctcaaaactcaccagtgggagaacttcatgacacaaagagaaaacattgttgctttcatttgccaatttttaaatacttagctcataagttctgtgaccaaaactaatagaaggctcgggaggagagctcggaaaagcagagggggttgttttcctaggctccttcctctaacacgaaggtggaaatcaattcgctttccccttctaacccttgaatccctggagaacgatcgtatttggatggcctacgaatgctcagctttccagtagtgccccagacgaggaatccatccatccaagtattgttcttacctcccactacctcctacgtcaggggaggggaccgggcacatggttccgaggtcatgctcctcacttagaggatcgtgggaatgcttacggaaacacttgtcacggcgctgccagctggaatcgctgcttaagaagaggctggaaaactagggagtgcgcgatcagagacgggaggctggggagagcagggaggcagatgttgtgtgttatcactgaaacaaacacaagccatccagttgtgcacttcagctacgtgcggcttagcgtacttcgataatgcctccagaaagtcagggaaaggaaatacagaggaagctgggcctctcttctaccacctcgaaactgtcctgctgccaaacagatctgggaaagcaggttttaatgagaaaattcaattaagaaataaacttaagtaaccccatagcatgctgagtgaagagaggagcctttctcaagtgtcttagtgccgaggagtggaccaaggggctctgaaaaatgaccaatgaggcttcccgccactcagaggaagccaagctcagaaaggccacgaagaccatcctcgcttaagcgcggggccagattccaaggccaggtctgctccgcctcatccatttcttgtgctgcttcccagtgagactcagcagaggacacacgaggccacatgaggtactcacatcaggatctcagctctctaacacagggaggggtgcaacgaaggcaaggacacaggtgctgtgcgtgactccccaccggggccggcgggcactgggtggctcagagatcattaggaacggtcgctccctccctttctcctggtttcccttctgtcctctgatagaggaaagtggcttagatcattctcacaggaagattaaatccagagcaagggaaagggataggaatccgtttccaatcaatgatggaaaccagattccctcatcagttgggattcattcttacatgttgtaaacatcacagagctccacccatggctacaagcgttcaggaggtatgaagcatggtggcacatcctgggtgagagctgcctgtggccaagaagcctcccggcttgggctggcccatctgagggacaggaagcaacacgtctcttggaagttatccccaaaactcccatctcagaaaggtgagataaagcacaagactgtcccactcttgtaaatgttctatatttacaggaataaagttttaaaaccatcttagacaactataacctccttcctgtagaacatacccatgtacatttgtactcatatgggaaaatatggtatcaattattaatagtaaagtatttgaattaaaggtcttttgttcttgaagaaccacgggatctcagtttcagtggccttggagtcccacttcccccgtatgaaatccctaaagcactaggtgttttgacccctgcttgatcttgactatggggaaaatgcaccatgtccccagtcagcctgtgtcacgcggtgctggctgtttggcagctctgccttacactgcagcctccagcacagagagtcctctgtccagaaccacctcaaggatgtgcaagttctctgccacatggcatccctcagacacctgaagtgagccatctcagcctccctccaagcagcttccctcccggctgacactcccagctctgctgtgtcctgcacatggcacgcttccgagaccactcgccctcggctgtcccctggggttcatgccactggatcactgggtgcttaataggcgccaaccatttcagaaaccacctcttattcccgtgagagcaacccctgcaagtattctgttttggttttgtttgtgctttttctttttgcaggaatcaaggccctaacatccagaacctcagcagtctctctggctgccatccacatcatctgcccagacacaaagagagcgggacaggaccacagcgtggccaggtgggggtgctaccggttttccctacagctgacgtaaaatacatatattactgcaaatctaataacctgcttagaaagcacttcaaggcagaaccattcaggaaataccttaatacaaaatacctttgtttttcttttctttttgtttttctgaagcagggtcttgcttgcataccaccatgtctggttaatttttgtactttttggagagacggggtttcaccatgttacccgggctggtcttaaactcctgggctcaagcgatccacctgtctcagccttccaaagtgctgggattacaggtgtgagccatgcacccggcccataaaatacacctttgtaatgaatatgtgagaaatagatactggaagagatgatgtaaaaacaattttttatttttatttaatctctcttatgcagattaagcatttcccctgaaatccaaccctcacagctcagtccaaacttttcctcaccgtgaaaaggtgaactccagaccagcctaaggccaaccgttctgaatggcaaccactagattcaaagcaaggtgctgtgatgttgctaggtgtttggtttgtgctcctatgaccagtgtggggggaagggacttgggcagacatccaagctgaggtcccctgggcagagtgactcagaattagtgtctggataggcatccgtgcacccaacgctactgacttactccagttcatcctgaagacagactattacagtaaaagccatgttttaaaaaagttatagctgctaggccgggcgcggtggctcacgcctgtaatcccagcactttgggaggccgaggagggcagatcacaaagtcaggagatcgagaccaccttggctaacatggtgaaaccccgtctctactaaaaatacaaacaattagccaggtgtggtggcgggtgcctgtggtcccagctactcgggagactgaggcaggagaatggcgtgaacccgggaggcggagcttgcagtgagctgagatcgtgccactgcactccagcctgggcgacagagtgagactccatctcaaaacaaaaaacaaaaaacaaaaaacaaaacagttatagctgctaaaaccttatgcagaaagtccacgaaatttgaaaatatacatcatataaacgtaagcaaggctgaaaacacgtgaatcccagttagctcaccctgcattcctgcccatgcagctcgtgacccagctacagccttgggtctgtactctccctgcagtcagaggatggggacaggtggcacactgctggcctgagcacaacaggagtccgtttgcttggggacatttcttggaaataaagtaagtataagggtgtactcaggaacactgcattttatctgggactcggctttgttgcccagcccagcacagggaaagaggagttttaaagtgtttcagaggaagaaagagaaaaccttgttggcctcaggggagtgaggtatagcacactcattcagcttcatttactgagtacctacctagtatacacagcagggcatgttcacccctttttttgcataacaacatacacccagggtggctccagtatactcagaactacggaactgaagaagcatcacatcacatctttcccaagtgatgctgggtggggtccccagtgtagaaggcagacagagaaaaaaaaaaaaaacagcagcaccaagcggctcaaaagctcaggagaggccgggcacagtggctcatgcctataatcccagcactttgggaggccgaggcgggcagatcacctaaggtcaggagttcgagaccagcctggcaaacatggcaaaaccccatctctaccaaaagtacaaaaattagctgggcgtggtggtggatgccttgtaatcccagctacttgggaggctgaagcaggagaattgcttgaaccggggaggcggaggttgcagtgcgctgagattgtgccactgcactccagcctgggcgacagagcaagactctgtctccaaaaaaaaaaaaaaaaaaagcacaggagaggtatccacagcccttaaaaagcatcagtgatagctccaaatgctgaaagatgaagggctctgtcatctttaaaccctgtttgtgatttccagtttcaatgagcctgttacattattactgtaatcctaaaaaaaaggctcacaaattttttaactgacaattttcaaaaaacaaaagtcagtgcttagtcctgttgtttacatcgggtacactattagaatctggctttcagaatggagagacccagactgctcatgacaattacaccagaggatctgattcaaactgattcgagctggggagtgggggggcgtggagtgagcaggagcagctgaaacaacgctgggcacggaggataactgctgaagttgagtgacagataattgggggctcattatatcacgtgcttgaaattctctgtaacaaaaagttctctgaatttaaatcaggcaacactaacttaaagttcccttacggtaaggcctggttgccacctactcctaggctcttgcaagctttaaggccagtatgagtcgaatgtttactggacattaggcagttttctcacactcacactcgcactcggtccaggaaagccctcccggggcagggggccaaacgaaaccctaaatgcagctttgtagcagcccagctgctctgaaggactgaaaaacacagggtcctcaaaaatcaccaaaaaaccctttggcttggacagcttttccttccctggcttcctgtaaagatgccgcaggctccctagaatctccaactccggtttgtttttaggaaagttccgttgctcctgccttcagcttggctgcctactccacgttacacaaatacacctcctctgtgcggcgcaaacaacctctacgccagtggtgctgaaggaggccttcgctacttgcatccatcctatcagcgtccagaggagtgaacacgtagatgtctatcactgacttcatacccttcccccaacaaaaaaaccttaaaatcataattacatccttctctacaatgacctttcttacttttataacaggattttaaaaatccattcctggccaggagtggtagttcacgcctgtaatcacagcactttgtgaggccaagctgggaggatggcttgagcccaggacttccgagaccagcctgggcaacatactgagatcccatctctacaaaaaaaaaaaatacaaaaaaattagccaggcatggtagcgcgtgcctgtagtcccagctactcgggaggctgaggcagaaggatcacctgagcctgggaggtcaaagcttcagtgagctatgatcacaccactgtactctagcctgggcaacagagaaagaccctatctcaaaaaaataaaaataaaagataaaaatccattcctttttttaaaataagacactgtataatattaatatagccacggcagcaccactggacttacggcctggctttagggagacctcagactgttgacgtcagtttctggtccacagctgccttggaaacctccctgagccaaaattaaaacaacagctttctctcagggtatgcttaagttattgttgttgttgttgttgttttaaaaagaaaaaaagacaacaggtttgatgtgacactcagtgtctccggtgtgccaggcactgtgtcaggtactttacaaacaaggaaagcaaggcacagagaggccaggtcacctgggcaaggccgcctggcagatgctgtgtgtggccgcagagtgaggcatgtcccagactcagccttcctcaccaagagggactcaaagccttctggggcactctgtgatgaaagctatgggctctctccccagggagtgcacacacacaaaagtctgaatgaaatatctggtgggttcatagtgcccctctgttccccaaacgtcccctctggttaaaaaaactctattcaggtgaaaccctgtctctactaaaaatacaaaaattagccgggcgtggcggagcacgcctgtaatcccagctactcagggggctgaggcaggagaattgcttgaacctgggaggcagaggttgcagggagcagagataatgccactgcactccagccggggcaacagagccagactccgtctcaaggaaaaaaaaaaattctattcagattttcatcaatgaagagcttcagcaggagtgtctcccatagaaagaggcaggtgtgtctctggcctcaatccctctctctcctgaggtgtacatggccccagggcttgcccctccatcagtctgcaacaccccccagccctgaggtctcagacacccagctgccacctccccaccctgtgacaacttgggcttgtatcttattaaaacactctagggtccaaccctcttaaaacaatgaaaacattttctcactcatataaacaaacaaacctttactgaaaactaatgacgaacacaaagggactatttacagaaaacagcgtgcctagccccatctagattataaacataactgcacactggctctaaggaccctgccatcttcccaggccctggcctggctgttctgccactccccacctcatgcctgaaactgacacaaaggaaccaatcctccagccaaagtaagcaattacaacgtgtagctgaaattcagagaggtgatctaaaaagcaattttgtaagatagctccaaattgggaagaaaacaaatttttgtattttatttttatttttgagatggaatctcactctgttgcccaggctggagtgaagtggcgcaatcctggctcactgcaacctccacctcccaggttcaagcgattctcttgcctcagcctcccaagcagctgggactacaggcgcctgccactacacccagctaatttttgtatttttagtagagacgggatctcaccacgttggccaggctggtattgaactcctaatctccagtgatctgcccgcctcggcctcccaaagtgctgggtttataggtgtaagccaccacgcctggcctttttaaaatttttttgacccacgagatctttgacacaaagatatccatttcagcattatttatgatagcaaaaagtgaaaacagccttcatgtccaacatgagtaaattaaggtacaactgtaagatgaagcactgtacgatcactaacaggaagtttgcaaaggtgttttaagcaagtgggaataagacttatgtgacccaataggaaaaagcaggatgcaaatttcagagccatattttaaaaatgtgctcagaagactcgaacaaaaacccaccaaaaaagcaaaagttgtttcatccatgagggggaattttgagtgacttttttttttttaattctctttatacattttggcattttccaagagtaaaacatgcactttccccgctttgccctttccttctgattataaatggaacataggctctctgtaggaaattcaaagcattacagaaagtgaaacatccccctgtgatctcaccacctagagactccccaaaggtaactgccaataataacttggttcccattcttccagatgttttccaacagggattacttttagaatcaaataatttctctaaaaaataatccgcatgattccatacatatgaaatggccagacagaaagtgaatggtgagctggggcaggagtgggcatgaagaataactgcaaatggatgcaggaggtgttctgggggtgatggaaatgttccaaaattggattgtggttatggatgcacaactctgtaaatttcctaaaaatgtacaaaaccgcactgtacacttaaagctggggaatcttatatgtaaatcagatctcaataaagcagctgaaaaaagaacaaaacaaccactagaggcagggagtgctgggctgtgcaggagggcagtccatggctttatgctctgccctcaagagcacatggtaagaccctgtagcaggaacagaggaagctggaggcctctcggcatcacctggacaaacagccctcggcagagaggctcaacagataacctgagagcggcagggtcagcgaggtcagttccagtctacacgggaggcaggaagagcgccagccctgaaaatgcattcctgaggctcaggctgcactgccaggctcgctttaaagccaggccaaaggaaaacagcactggccggggtgtccaaatactttaccaagttcaggatgcactgcgtgcaggaaaactgagaccatttttctctgtttcaacagaaacttgaaaaccacccctgacaacatgttagtccctggaagtactcaattacggtgaaaagccatcggcaaaagttaaagtgagtaatatgacagtgagccatgtaagaagtaaaggtgagtggaagattatgaactacataaaaggcacaatgatctgagtctagaaaggcaatctggaagcctgaaaaggtacaaatgggtgcaattctcttagaaagtaatgggcaagtaaatgtcaaaagcgtttaaaatattcataacctcctaggaatctaccctaatgaaaccactcaagctgatgaacaaagatgcccactgctctacccactgctccacggcaaaaaaaactggaaataatctcccccaacaacagggaagtgatcatctactgtgtaacccttacaattgcacagtgttaaaaacgtgggaaaatgttttatgtttaattagcgaaactgaatataaaaatttactatcaagtgagtaaaaaaatgcccaaatcctggaaatgatatataaaaacgttaacagtgtttttctttaggtggaaagattgattttttcccctcctttcatatgtatttagtgaactccaagttttttccatcacatgatttcagtctctaaaaatccgtgatccatcacgccaactggattttgtcaattttaccctctatggtttgtactgtgcaaaactaggcttcactttattttccaaacaaaaaatactattactgagtatgttttctcaaattaccaccccactgcccaaaaaatgacacctgccacactcaagattatggtggcccccaggaggtgtgcccatcccagccctcactgggtgcaagctctctctttcttctatcatccttctgcagagaaggattttgtaattgttgttgctttgttttaaagtgggaaagaaaaatattgacgaacttaaaactcgacatagacagagacattgggcagcaccagacctaatcttttttttttttttttttttttttgagatggagtctcactctattcaagcaattctcctgtctcagcctcctgagcagctgggattacaggcacgctccaccacatccagctaattttttttttttttttttttggatttttagtagagatggggtttcaccatgttggccaggctggtctcaaactcctgacctcgggtgatctgcccacctcggcctcctaaagtgctgggattataggcgagagccactgcacctggcccagacctaatctttgagggaactcagcatcatcatagaaggctgaaaccacaagatctattttttgtgccttcctaagagtgttgtgtgcatgcagcaatccagcgaaatggtgagttgcacagatacacctgggggatgccagcctaagatcagggccagggtggcacagcagcaccctgggagctggtggaggagggcacggctcactgacgccatccgacccagccccagcagctcgcaggccacactgctcctctccgcctcggtggccttgccagaatgctgggcctctctgatgcactggtactatctaagcaatcggcaactaacagtagtgaaagcgtagttcattttaggtttaagaattagaacaggctcaatgttgctctctaatcacaccctcactcccctgcactctaataagcttccgtcagtgtgaagaaaagagggcggagggagggcttactcgagggaactgtgaaacacactcccccaggagtgggtggagctcaggacacctctcaggcctggcacaggtgggcttttctttcggaggaaaattaagtagtagccagtcaacctatcagccaactgcgcatcaaggggccacagtctataggatgggaagccaaaatatctccaagcaagaagggtggtgcgccgctgcgcacatcccaaatacccgcttctctccaggcactgcccacccatgagggactttcccttttccaagtggcagagctccactcctggctgtcaaccactgtgaatgggacatctcctctcctcctcccttccaccctttcgggagagcatttgattaatatttttctacttttgttgccccaagttgaggagtgtttagagatggaaaataatacattacttccctctctgacaaccgccttaatccacaaagcccagaggtaaaaactcacaagctgtttcttctctgaaccgcagaaacaaacctggttgcagttggggcactgtggaccagagaaagatgcagtgtttcatcattacctacccatgataaatgctgtaggggttttttcttattcaactgcagatgattcacattagaagctgcctggtgaccagactaactttcctccctacttgggcaaaaagttgtcacctagccaacacatttcctgggggtagactgtgccttgtggattccatcagctttgctatttacttctcccttcaccctggcagttaacatttcaaccctgatggccacggccacctgttgctcctcctcccccctcagatctaaagtgcgtgtcacctttctaggttctgggtcacatcttctgggctggccaaggcctgggcgagagaaccctgtatcctggaactgcctgggcattggaggaggtgatgggttaataacaatcgttttgcaggcaggggaggcgagggggcaagaggaagtggaaacatgacgtgactagggacgctgccccaggctgctcgctgcccgctcctgacttctcccatctggtttccatctgacccaagcagctggccagatggttttcatttgcagatgaaaccccagcagttccattgccacaaaaactcctgaccgtagagtctctgtaaggctgataacgcacaaagtgcactgcggtgtctctgagcaggcctgaaaggtcatgcttcccaaagccggaaccaggacaacaggaacaaagtggggtcttgacacttgaaaattccgatgacagccagaagaggaaatgcactggcctggcgagatgcgagtcacggtcaggcatggagctgaggaacggggaagattttgccagtgaatcagaccttgtctctatgccatccactagcatccttaaggtgaggaaagaaccagcaggtctcagggtgaaccatggtatgtccactcagtggaacagtacgaaacagctaaacccaggttcgtaaagaaaatgtaggctggactggctgggggctgtggcccacacctgtaatctcggcactttgggaagctgagacgggcagatcacttgagatcaggagttcgagaccagcctggctgacacggcaaaactctgtctctactaaaaacacaaaaattagctgggcgtggtgcgtgcctacagtcccatctacttgagaggctgaggcatgagaaaccttgaacctaagaggcagaggttgcagtgagccaagatcatgccactgcactctagcctggttgacagagcaagagtctgtctcaaaaaaaaaaaaaaaaagagagagacagagagaaagaaagaaagagagcgagagaaagagaaagaaaaaaatataggctgggcacagtagctcacgcctgttatcccagcactttgaggggctgagtcaggagaatcgatttgagcccaggagtttgagatcagcctgggcaacataaggagactctgtctctacaaataattaaaaaattagccaggcatgatgttgcgcacccgtagtcccacttactcacaggaggctgaggtgggaggactgcttgagcccaggaggtgggggctgcagtgagcaggaattgtaccattgcactccaacctgggcaacagagcaagaccctgtctccaaaaaaaaaaaaaaaaaaaaaaaaagaaaagaaaagaaaagaagaaaaaatgtagtaatacaatacatggaaatagtgataatgcaggctgagtattagttttccttatctgaaatgctggggacctgaagtgttttggattttgaattttttccaattttgaaatacttgcattatacttactggttgagaatcccaaatcagaaaatccaaaatccatgtcccaaagaacatttcctttgagcctcatgtcagtgctcacaaagttttgggttttggagcattctgggttttaaattttcacattagggatactcagcctgtaagagtgtgtcaggcactgttttaggcatgtaaaatgtgtcaactcaatcttcatagcatgcctgtaagacagcttatgttattaatcctacttcatagatgaggggactgaggtagggagaggttaaggagcttaccaaatatcacacaggtaataagtggcagagctggaagcctggttccagagacccaggtgaatcccaaaaaagagaagctgggcacaaggccccagggaagcaaaaacctgaaaaactatcctttcacacttgtgcagggtcagttgatgttaggcttgtattgcaaaatttatacttctgaagaaggataaagcagcaagagggaaaaagtatctaaaatgcagacacatataccacatttgttttggaaaagacaagtcaggagcccacaaaaggttatgaaaaaccccagtgacaccaccaccaatgtttgtctttggaataatggaaagagatgtgtattacttgtaagaatgatctctgctattacatgactcattcctgcatgcaaggactgctctcatctggtgccaaggaaagactgctgaattatggaattgcaaacattatcactgactgttactcacaacactgcagggcaaactgatatgcgccaaatcagccatgttaaggggttgttattgcacctctcctcaggaccagctgttgctatttcgcattaagactttaaccatatcttagtccaagaactcatcaacctcagcagttgagttgcttggaaatgcccagggtccacacaagttccccaggggaacccaccatgggtctggggactggagtcatgggacaaaaaggggaatggtagaggcagagaacagaaacagggaacggaaacaacagataaaaggaaatcactgacacagatggcatgcaaaaggcctttcagagtggaaatggacaatcccgaaattggcaacatatgatgtgctctttattcctgctccccaccggcatgtggtagaaggatgcagaggaaaggacggtaatgggtaagataatatgaataccaccctacaggcacgtgtcatctaggagcctaccgagtgtcccaccttagtgatctgaccctcagacaaaactgagagggagacgccaccatccccaccctgcagatgggagacagaggctctggggagtggtccccagaaacatgtggctactcagagacaaggctaggaccagggggtgatcactttccacatggacagtgtggaaatatcagccaataatgtgtcctctaatctatttattatggcctccacctctctgatgactttaaagtgcctcaccctcaacatagctgaaaccgaactaggtttgccccaccgaaacctagcagttatcatgcagataacagctaacatttactgagcatttattatgtgccaataataatgctatgaagcaattttactgtttattattgtaatttactgtttattattgtaattattattttattatttctctccacccaagtaccaaccctcccccactttgtccaagagaccacagtgattgccctacacctgccccaacccatcctctctgcacatctgggtcagggcaagctttccaagacttacctggccagtcctcactgcccaccccctgcagtcctcttacctgatcatccctccatccctctccatcccatgtcccagcctgctcctgcccccgactcagctccttcctgccaggcttctgcatgtactattccttctgcctggactgccaccccctcagctcaagcctgctcccccgcaacggctctagggcagcatctccctccagatgccatgaccccgtagttgttgatcattgcccccactgggacataggctccaggggagcaaaggaagaggctgttcttggtcgcctctgtactgcccgagtccggcacagtggtcggctcatagccaatgaataaacattcccggaacaattctatgactctcaaattagcctgagcaccaaaaagaggagcagggtctgagttgtgggctgagctatcctggtgccaaggcaggccttccactgccacgtacacaccctgaaggcagagtcagcacgcccaaatcctgtggggcctgatggtgaccactcaagctcggacaaaccccaagtgtgatctcactggaatccatgtcaacgcccaagtcctcaactccagcagaaactccccatctgttcctctgctctcctctccaccacactgccctcctgccactggaccctcaccactcccctccaagccccaccttcggcagtcagaataatttctttcttttttttttttttttttgtctttttttgagatggagtctcactctgtcgcccaggctagaatgcagtggagcgctcttggctcactgcaacctctgcctcctgagttcaagcgattcacctgcctcagtctcccaaatggctgggattataggcacctgtcaccatgcccaactaattttttttatttttagtagacatacagtttcaccatgctggccaggctggtctcgaactcctgacctcaggtgatccacctgcctcagcctcccaaagcactgggattagaggcgtgagccaccgtgcctggctggcagtcagaataatttattttaacataaataaagtcatcgcccagattgacaccttccagcttcttgtgactgttagacttacaacctggcatacaggcccggtgtcaccgggcccctgtgctactgataactaacagcacgtcttttattctatttttttgttttgtttttttgagttggggtctcactttgtcgcctaggctggagtgcagtggcacaatctcggctcactgcagcctccacctcccaggttcaagcagttctcccacctcagcctcctgagtacctgggattacaggggcgcaccaccacgccagctaatttttgtatttttagtagagacggcgtttcaccatgttggccaggctggactcgaactcctgacctcaggtgatctacctgcctcggcctcccaaagtgctgtgactacaggcgtgagccactgcccctggccaccagcgcctctttctatgtctcaacctgggaagccttgtacccgtggccccttccttgtcttctcctcccacctggaaggcctctctctccttctaggtcttccctgtcacctgacttcacaacacatctcacaactcaaaatgactgtgtttgtatcacaatcacaatctgtcccgcccagaatagcaggggctttgtcttgttcaccatccctgtgaatatttgctgaatccaccccttttactatgtgaatagtgaacaattactgagcccttgctgggggctaggcagtgaaatgcacattagatgcattaactcatcccctggtagacatccctactgccattttacagatgaaaatgaggaacaaagaagctaaggactggggccacttgggactcacgcccaggcagccagctgcagcgtctgcaatttcaaccctcccctaagtgcgctgcctcctggagttgtagaaggctacagactcatcccccagagtggccagggctcctggagggcaggcatcacatcttaggtttctccaggctcaggccctccaacaggaggtcctgaataaaagctcaggaataactgcagttcaaggaagccttggctagaaaaccctacaataaaaggcaggcaagactggccatgagtagcgccatccctgcagtgctgataattcacacctgcactcacaggtaggctaaggcagtccctcaggtgggctgaagaatgaaatgctggccacgtaagatgtaaaccccaaagagcaagtttgtcccatcaggtcccctatgttaccccataatatctgcatcctgatctttaaaactcttttccagagaaagtcaagcaaatgatatttggagggctttcctgctgcttttattttggaaagttatataagagtcctaagagtcactcctgagcgcttagagtagtggcacatttatgcacattcctcacttggtccttacaacaaccctctgagtcacacacgatcatcccaaatgacaattgtggaaaccgaggctcagtgacctgagggacttgcctagggccacagagctgccaagcaggaaatctaggctgcctgagtgcaagctcgcagtctgtactgtaatgccaaaggcttcactaactcatttcagaaagcaattgtcacgatcttctctaaactattaatacttacaaatactcattcaaggagtagagcttagaggctgtgaggcaaaggcagaaccatttctgggtgacacatcagaaaattactgttccgttcatctaaatgatgtttaaaatgcccactgcagcatgaaagtgcctctgctgagaaactgcagacatcagcaggagccataaaggaaagataaactcttggtaaagggaaggaagaggggctgagtgggtgagttacagctgaattcacaggacaccggtcccgcaaagaggaagccaaattgcagtccaagcagccaggatgcggagggcccggagggcttggaaccctgcaggcagcctggctgtggagacagagcaggacaagctctgagacacccccaggagtggcagacagagacaattcatgcctcccgtcccgggagcaggcaagggttcctgggttaaggggaaacaaaggggtccatctaaaaaatatgaaaggcctggctgtgctgagtgtgggtgaataaggtggagtatggttaacaaaacgattccacatcagcaaatgctaacacagggctcctgggatcccatagagagagagtctatttccatttttatttcttaactcaaaaaataaaattaaactttactttctagaagaggacgatgagagaagatcgctgggtggccacgtgatggataagacatgcaggcctcccttgctggtccccactggcctcattaaggctgggactattatttctcaacacacatggtctgtcctgtcacacgctagtggtttccaacaagcgggatgcccacagcaagtgccctccaatccgtcacagtccctgccgcatcttgggtctcttgacctggcctatttactcttatctaccagccactgtgggcctttggatttgcatcctgcttgataaaaatcactgaggagctacaaagagatgagattggccctgacgccaattgtcactcatctcaggtccttccaaaagagctggcagactcagaggtccatggacactgccacatccagtaccacaggctacaacacatacacttcctttctaagccatgaataggtcacaatctcaagcaagttatatacacaggaaaaacaagggccagtttcctacattttataagattcttatatgcaaggctcttgtttatttgtttttcagaccaagtctcactctgttgcccagggtggagtgcagtggcacgatctcagctctgcaacctctgcctcctgggttcaagcggttctcctgcctcagcctcccaagtagctgggactacaggcgcgcaccatcatgtctggctaatttttgcatttttggtagagatggagttttgccatgttggccaggctggccttgaactcctggcctcaagtgatgtgcctgccttggcctcccaaagtgctgaaattacaggtgtgaaccaccaggcccggtccacaaggctcataattttaagggcaaccaacaatctgctgctatagtaaacagaacacattgaagagagaagcaagagctttgagaagtaaacaaaagaaattttaaaataatctgaatactaatgacacctctaagaagagggtcaggtgcaaatccaagccaggatcaggtattccattggaaactagttttttaaaaaaataaatcccacaagataatctctggtttcacacagagactggtatacaacaggaccatctttccagcgttagcctcaatatcccagtcttgggttcccttcaacgtaggtgttcttggttcatcgactgcctcacatggaatgcagaactatccccctacccatgcacgattcccccgtacagaaaaaaattcagagcaagaatactccagcccacagacccagcctgtctttaaggatcagaccatcccacaacgtgacatcctcgaacagactatttcactggggctgcccatggagtctatttgggaaaggcaaacagagcggccgatggcaggggctgctcagatcacaggaatcccaaacctaacaaaaacccaataatgttataaagggagaagggaagatgatgcttaaatctcaaacacaacttcagcaaaaggtattgttgcatgggtcatctgtattcctccaggacagaagatggtaagagcactaataaaggtcattatactcatttgagcagggcactcttgaagattttcatccaggaaatggaccagcattccaaactattacttagagattagctctgtgtgtgttggagggtagcctaaagggttagggttaaccccagaaaggcaggaagttccagaaaaaaggcagtcattctacccaagtcttgttggaactaaagcacagcgggaaaagcgagcaaaccaaaggggaattagagacactcacaaagggaggggccttgggattaatggactctctaatttttgaatttcctgaggtttacggctgattaggccccttagccatactgtaatgtgatcaaatttcaactgggttcacagcacagttgaaggtagaagatgacacagacatcaccagtgggccccagagactacagacaaggtccgcagtgctcgcttccgggcttgatcgcactaattaggcacctttaattccccaaacaatggcgcacaggctggctcagagggcactgtgtgatccaccgcatgcttgaggagctcttacaatactatgtactgataattctctaatttggtacaagcatatttaagcacatggctcaaaggtggagagaaatgacattgcaacccgcaaacacatatgcacaaaaatattcaactttgccaagtgaagacatacaagtgaaaaatgagggacgatgtactgctgactaaattagaaattaagggagaaaagcgcccagtgttaacaaagaagcaataacctgatgctcacactgcggacggtgttatgaatcggcctgacactttggaaagcaacttggcagaatttgtcaagagctgtaaaagtgttcatactgtggcacggtaacgttactcctgggaatccaaacacagaaaccacttcagaaggaccagtcactgtgacatcgcttataaggaaaaaaaagaaaaacaacaacaactggaaaaaacctaaagggcaacatcagggaagttacccccctgccatctgatgtttaaggagtaaacagccagtaagcaatgatggttgtaaggacttcctgataatgtgggaaaagtcttaggtcataataatttttaaaaaggaagatgaataattatatgtagcctatgaccacaactaatcaaaaacctcatgtatataagaaataaaaggagttgccaaaaaaaaaaaaaaaaacactaaactggtgcaagtgacttttttccttctgtgatctgagctttccacaatgatgctttattaagttgaactacatgaaattgccaacacacagccatttctgacctacacaagtggcactttcacatgggtcaacataatattttttgaaagttttaatacttttatgaaagtatttttatgaaagctttaatacttttatgaaagtatttatccaagttttgttttgttttgtttgtttgcttaattttgagacggagtttcactcctgttgcccaggctggagtgcagtggtgcgatctcagctcactgcaaccctccacctcccgggttcaagtgattctcctgcctcagcctcccaagtagctgggattacaggtgcctgccaccaagcctggctaattttttgtacttttagtagagacggggtttcgccatgttgggcaggctggtctttaactcctgacctcaggtgatccgctcgcctcagcctcccaaagtgctgggattacaggcgtgagccaccatgcccagccttatgcaaggtttaataactttagatgttcacagtatctgcccctgctctgcgctaccacccctcttcaatgtctaaggacagatctgtaaacacatgtgacacacaaatagagtggtctaaaagcagtcctcagaattctgtaatccaaaaaggagagaaatccttctaaggtgtgaagcaacggacagaaacaaaatgaccaaagtcagtttcaccacatttaagcccaattctgaaaaatgcaggcaggcttctcctttttaactactaggtggagagggcacctccatgtggaacattcgaagggcagaaacagctcaccaggtcaggaaagccagcaggcaaagtctgttggcaggagaccgttggcaggaaggtgtggtagggaaagtgccaccccacgggcctgaccctcccgcctgcctgcccttccaaaggcctcctccaccttcaaccaggtcccatttttccaggccagagtcttaaaggatgtttgcttccctttgctggcctgaggacaaggctaattttactcaacaaagtaaaaaggatggaaagaacacactgaaaagaacaggctgaacaaccacctgtatgggtagagccatttaaaaatcattcaaacacaggcacagaaaacacctcaacaaatgtctatcaaagtcttagcagtatctcaggggtagaatgaaaagtcgttaaagttgttaaagttctgtgttatttaaataaaataagcattacttttgcaggcagaaagacaattcggagattaaaatatttttaaagagagaaaataggagacctgctttgattgatttttttaaaaccttctaccacgccttgctcagcctctcagcccccacacctggggtagaatttcttcatccaaaaaacgggataggggctgggagaaagaaatgccagtacccggacagccactgtgggccgggcactgtgctgggagctttagccacatcgtccacccttccacttggttgaagaagagtaaaacagtcccccttacctgcagtttcactttctgcagtttcaattacccacagtcaacagtggtctgaaaatattaagtgaaaaactctagaaatgaacaattcagaagttcaaaatttcccacggctctgagtagcatgatgacatcctgctgtaccgccccagacgtaaatcatccctttatccagtgaatccactgtctacaccgcccaccccatagtcacgtagttgccttcttagtgatcacacagttgcagtccttgtgttcaagtcacccttatctgacttaataatggccccaaagcgcaagagtagtgatgctgtcaattccattatcccaaagagaagttgccaaatgcttcctttaagtgaaaaggtgaaagttcttgatctaataaggaacgaaaaaaaactgtatgctgaggttactaagatctacagtaagaacaaaccttctatctgtaaaattgtgaaggaaaaataaatgctagttttactgtcacacctcaaactgcaaaagttacagccacagtgtgtagtaagtgcttagttaagatggaaaaggcattaaatttgtgagtggaagacatgaacagtattggttttttgtttgtttgtttttttatgagacggagtctcgctctgtcgcccaggctacagcactgtggcgcgatctcagctcactgcaagctctgcctcccgggttcacaccattctcctgcctcagcctcccgagtagctgggactacaggtgcccgccaccgcgcccggctaattttttgtatttttagtagagacaggtttcaccgtgttagccaggatggtctcgatctcttgacctcgtgatccacctgcctcggcctcccaaagtgctaggattacaggcgtgagccactgtgcccaggctttttttttttttttttttttttgtatttttggtggagatgttgccccggctggtctcaagctcctgagctcaagcgatccacccacctcagcatcacagagtgcagggattacaggcatgagccaccaagttctgatcaacggtactaaccgcagtttcaggcatccactcggggtcttggcacacattccccacggataggggaggatggctgtatcactccttaagagcaacaggcagccagggaccccagctcaacacccaccgacacatgatgtctactgtgttctgaacatgcataagcatataatttgaactgcattgttagccttcaggaaaggggcaccaggagctgtgctggccaggtacctagatcatttactgttcaaaaccaacccaggagctgagctactgagctcagcctccctctctcaaggctgggaaaggaaagttcatcttcactcagatgcaagcttcaagtaggcagagcagctgtctcttattcacccctgggcgggggcgggggggggaggggcgggttccagcacagcacgtggctcatgggctgagcctccagaagtattgttagtggatgggagaatggatcttcatatgggcttagagaggtgaagggacttgcacaaggtcacccagctagtaagcagggggtggagcccactttcaggtccaaactggcaagcctcagcataggtcactgttgctttgcaaactggcaaccctcagcataggtcacacagagggacaactgaacgttgtaggaccaggctctgcctccttctctctcccccgacccacctgccactccttggagctcctggctgaggcggagcttcacccagcctgagctgagcatgggcatccagaggcactccagtcggggtctgtttcacagaagcaggcccttcgtgaatatgcatgaggggcatgagctggcttccacgcatgcttcctgctcacctcatcctaaatcctaaacccgcagggccattgcccccttgacttgagcactagggtaaaatctatttttgtaaaaacctgatggaacttttacttaaaataagagttttaagtgtttatggaaacgaaatctatcttttagaagccactgcataaatacttaactgaagaagagtttggaatggggcaagcctgagtaggaatccgaatgctatggatcaccagaaacatcataacaggcgaattacctaccctcactgagcctcagttttcttgtctctaaaactaggataataacacctagctcactggggtgaatgaagattaagtcattacatttaagtgagatgatgcattgacttaatgtcttgaatactgtctctggcacacagcaatgaataaatatgtgctattactactgattctattaatgatacaatcataaaaatgactgcacaagaagggacctgcagtctcggctactcaggaggctgaggaaggaggatcacctgagcccagggctttgaggctgcagtgagctgtgatcacacctgtgaatgagccactgcactccagcctgggcaagataccccatctctttaaaaaaaaaaaattaaggccaggcgcggtggctcatgcctgtaatactagcactttgggaggccgaggcaggtggatcacgaggtcaggagattgagaccatcctggctaacacggtgaaaccccgtctctactaaaaatacaaaaaaaaaaaattagccaggcgtggtggcgggcgcctgtagtcccagctactcaggaggctgaggcaggagaatggcgtgaacctgggaggcggagcttgcagtgagctgagatcgtgccactgcactctagcctgggcgacagagtgagactccgtctcaaaaaaaaaaaaaattaaaattaaaaaaagtcatctggtccaaaccctcaatacaggtggggaaactgaggcccaaggagggtaagcatgttagataactcctgatagtccaacagcatttactgcagtgtttaaaaaatagtaggcacgaagtaagcgcattgaataaataataaccacatatgaaacaacatattcacctattcacctaatgtgcttcaaaacagttaaaaacaggtccagttgaatggcattccctctggctcctatccagaagaattctttaaagaaaagttctcaatgggagtcaacattcatcagcacccgcactgttcgctaaggcagccactagccttcgataatttcaatttatcaaattgaattcactgatactgaaatttcagtccactaaaatgaaataaaaccaaatattcagttcctcaatcacactagccacatttcaagtgctcaagagctgtatgtggatagtgattatggaacagcccagatatagaacatttccatcatcacagaaagttccagtggacagcacagctgcaaagagaagatatcattaatgtgtaatttctgttctcatccagcagatttagtttcctaaatcctattgcaaggcagcaggaagggaaagacctcgttagccttgctttattatgcaaatctgcatattcctgtcaagtccaatctccctcagaaagttcaaatagagtattattaggtggctgcgcgggtctacagggcaatgtctggggtctgagggcaggtgagagtacacaggattttatgaaaatgtgttctgtgcaaacacctcacttgtgccgctcttctccacaccagcaaactgagcattctttaacacagttcggcaaccgctggccaagcctcacttacataagagtgccataaaagactgggtcggctgcttctgcaaaacacctgtggttttgcaaaaggatgtgatttcttagaagtcagtaaacaggctcatttcctttacagttaaattttggcatcagaataccaaaatactctatgaccccacctaagctcacataaccttactccccaccttaaatggttgggagagcaaaaggccctgtgagctggaactgcccagggtgccagccttgctgctgggccagtggccaccatgcccacctccaccactttcctttgaggccccaggaggctggtacacactccaggagccaggaagaccacttggcacccttagctcctgggacactagaacacatggccaagttataaagacttcatatgcatcttctcatctggaggtgaggccctttcaaagcacacagggtggagaaacgtggataatatttcaccctctatgttaaaaagaggagaaatgaaatatatttgtatttgcttgttatgcctaaagaaatgaggacagcaggccaggcacggtggcttatgcctgtaatcccaacattttggaaggtcaaggtgggcagatcacttgagaccaggagtttgagccgggccaacatggtgaacccctatctctactaaaaatacaaaaaaaaaaaaaaaaattagctggatgtggtggtgcacacctgtaatctcagctactcaggaggctgaggcaggagaattgctttaacctgggagacagaggttgtagtgagccaagatcatgccactgcactccagcctgggcaacagagcaagactctgtcgaaaaagggaagaaagaaaagagaaaagaaagagaggagcaaaggaggaaaggaagaaagaaaaccgaaaaagaaaaagtccacataaaagcttatctctgaagattttttttttttttttttttgagatggagtctcgctctgtcgcccaggctggagtgcagtggtgcaatctcggctcactgcaagctccacctcccgggttcacgccattctcctgcctcagcctcccgagtagctgggactacaggtgcccgccaccatgcccggctaattttttgtatttctagtagagacggggtttcaccgttgttagccaggatggtctcgatctcttgacctcgtgatccacccgcctcggcctcccaaaatgctgggattacaggtgtaagccaccgcacccggccctatctgtgaagatttataacagatttactctcaacatccaaaaactggaggcaacccaaatgttcatcaactgctgaatggtacgtccataccatggaatactatggaatgctctacagcaagaaaaggaaatattaatacatgcaacatgaatgaatcaaataaatcatgttacacgaaagaggtcaaacacaaaagactccatactatctgcttccatttatttacaattatagaaaaggcaaaaccgcggtgacaaagcagatcagtggttgtctagggatggggaacaaggctgtctaggagggggaaaagggccaaaggggcatgaagggactttttagggtgaggaaactgttctataactcgattgtggtggtggcaacatgattagtaccaaaactcaaactgtacacttaaagctggttaattttattacttgcaaataataccctgattaaaaacaaaaaaaagaagaccctagaaatcttagctgtggttggcaggggagagtggaagacactgggcatgtgagaagagaaggcagtgttttatgtgtgttgtggtctgaatgctggtaccccctcaaaattcatatgctgaaacataatccccaatgccagagttaagaggtgaggcctttaagaggtgattagatcatgagggccccaccttcatgaatgacattaatgcccctataagaggcccaggggagctggccagccccttccaccatgtgaggcgctgtctatgatgcagagaacaagcctttgccaaacactgagtctgccaagaccttgcttacggacttcccagccttcagaactgtgagtaatcaatttctgttgtgtacaaattattcagtttaaggtatttgttccaggagcccaaacagactaagacaatgtatatatttttatttttgaaacctgtgactgaattgcctattccaaacttgagctctaattctttcaaagccaactgcagaggtgactctgtgcaatggctcaggtagaagtggtgtggtccattgctgggttcctgttggtcagggatataggcaccaaaagcttagagggtggggagaatgaaaacctctggatctaaccagagctgaatgtagaaaaccatctatctcctctcctcccagaagccagtgcctcctgtcctgggcctctgggctcatgtgataaagacaagagctaccatttattgggcacttactatgtcccaggtgctacgactcatttgacgtgcattaactcattaacagtgataagaccaacaacatgtacggagccctatatgtgctaggtatgacaggccttcttacctgcttgacctcatttaattagcctcaaatcgatcctatgacaaggaaccagtcccagagagttaagtgaagcccaaggctacacagctaaaagtgtaagggaacaaagatttaaacccaggcagtctggccccaggagcccagctaccatccatgaccaaggacaacccttttattgggacagaggcgacactaatcactgcacgcacttaggctgaggtgtggtgggtggaggatcagactcagaggtgaatctgtgctcctggcctactccaccagctccacagctccgccaggagggtctttcactcccacactggggaggcagagccagatgcatggagctattcaaggtcctgcctagctccaaagcccttactctttgcactagaccaggctgcttccttggctaataaacagtgagagctgaaacccaaacaaaaacaagcagcacacgtgaagacaaaatgttcctgagctgcaacgtttttcaatcttttgagctcatagatcacatgtctaggtcagagtcctgagcttcctcacggcgcaggtgatgtgagaggggctgagtaacctcgaggtaccactgaatggcatcctgcagtcactcaaaacgtgtgagcctggagggaccctggtgctcacatggtctgatatgcaaagaagaaaaagaggcatgggggatcgggaatagttcaacatcacccagcacatcagaggccaggatgcagtcccaagtcacgctccagactcctggtacagtgctcttttcacgcctgcagcatttcccatggcatgctgtgcaggccaatggggtttaagggaggttttagagagcatatggatgaatgcagtttaataattacctatatttaatattcataggaaaaatataactagcacatcaaacatgattttgtagatgtttctgcttacgaagaggctagatagcggtgttaggctcaggccaaagttttttgtttttgtttttgagagagggtgttgttctgtcacccaggctggaatgcaggagttattcataggaaaaatcctaacacacaagctccagggatcctcccgcctcagcctcccaagtagctgggactccagatgcaccatcacacccagcttttatttatttatttatttattttgtagagattgggtctcactatgttgcctaggctggtcccaagtgatcctcccaccttggcctcccgaagtgctgagatccaccatgcctggcaactacgggcactgtgcccagccctcaagccaattttaaggaaagcctcaaataaataataataaaagtagcatacaaatccagcaaacattgtgctggtagacagccacactgggctcattcctgcagtgcagcaggctaaagcaagaaggaataaaaggaaagataaagcaaacagaagggagaagggaggcaaagagaggaacagtcccctccagcggctcagctcttgcgctgaggagtgaggcccccacagcagaggacacggatgtgccacactcattctccctacaaacttatctagcctaagtcaccgctcttctcaccccaaacgtgctaaggtccaaaggtccaaacactgtgtatcagcccaatcacagggagcaaatggccctttaacacccgccctgagactactatcagaatggcctccctctatcccagtatgtgggacaggtatcagctcagatatttaatccattttcttgcctgagtgattcaggtgtccccattaaattctcttccatctgctgcatgcttcccagtgcagagaggccagagggcccccgaaagcctccccattcacaaaagcccaaatgaccagggctgttttggtttaaagcacaatttgggttcacataacacctcattatgcttccccgacatcgtttccacaccagcatcagatgctgggaactagagcttgaaaacactgcagggccgcagagctctcaagagctgtgcccattccacccctgcagggcctaagaatgcagccctcagccaggcgcagtggctcacgcctgtaatcccaacactttgagaggctgaggcaggaggatcccttgagctcaggagtccaaggctgctgtgagctatgattgagccactgcactccagcctgggtgacagagtgagaccccgcctcctaaaaaagggggctaggcactgacaatatgaactccaaactatgcatatagactaagacgctgaaacaatatattgaaaggttaacagtgctgctggcaagctaagattatgaattatttttgtttcttccctcttttctatattttcaaacttttccataataaacatactgcttttataacaaaacaaaaaaacacaataaacttttatttaatgatactatcaggttacaaagggctccctcctgatggggagaggggtcccttgccactggtgctcacactcaaccaagcgccatccactcccctccactagcctgtgggcctttcactagctcggggtccccaaggcctggaacataggaggcgctcagggaatgatgatacacaggggttgggggtggagtcgtgaaaaggaagtcaatgataaactctgaggtatcagctgtgcggcagggtggggcggagcagggcagggcagagcagggcagggcaggagagtgtactgaaatagaagagggtaaatcagagcctccttccacccaggacttccttctcagcatggccctgcctcccacccagctgctttgaaagctctcccacccctcactcttctggctcctctgagtttaaattagtcatttccccagcacccgccatgccctcctgggccactgagtcggcacacgccgtctctctgcctgccatgtctctgggcccacctctcctcctcctggcaaatgagccctctcacctccacttcaacaaaatcggtcccctgggacccgtgccttgaatctctcagcgagacgcctccttcaatgtacggctgcactcagacacagcccctgacagcaattatcttccattctacaagtctgtccgtctgtctgactggctcccaccaatggtctccatatagcgacggcaagtaccttttcatgcccacccccaagctgggcacacaatattaatcaatgtctctttgaatgaatggacagggagacgggtacgaaggccagcagtagtcaaaggaagcttggcggtgaagacgggatagggccaagccctgaaaggtaagacagaaagacacaggcaggagggaacaggcagggaagggggagccacaagctggtggtggccagaggattgtgggtgctctacagatgaacatcttttacggcagtagatgactatatgtttatttcagtgtgtactttctatatacagcaattgatattgttttccattcatggtaaggacaaagtttccttcctaaataatttaagttaaaaagtgaggaaacttaaagaaaaaattaataaataacagttctggcatagagattaatacagcaaaaaccatgagctaaccttagaacacatttttgcaggaagggagtcctctcaacttggccagaacagggagattgaggaagtgaagtgaagcctgctaggcagggaggatgagtcagctcagagggctctggggacaggcagtgaggcggcggccacggagagagcatttgtcagagcaaagtgaccggttcaagaaggtgcagagagaaaaaatactctacactctccctcctggggacttatctcaaggaaggaagatactcaaaaggaggaaaagaatacacacacacacacacacacacacacacacacacacacacacacgcccgcccactgcaagcaacagagagcacagtaaagggcttgcaaattgttcacttctgtaatgcccacaagcacccaggtcggggggtattccacagaaccacaagcccaggacagacggactactgtgcttcactcaacactagcacatcttccaaactacaacaccgtcttcacatgtcacatgttaatggctgcattccattccattgtggcttgagcacaagagtttgagaccagactgggcaacacggtgaaaccccgtctctacaaaaaatacaaaaattgctgggtgcggtagagcaaatctgcagtcccagctactcgggaggctgaggcaagaggactgcttgagcccgggaggtggaggctgcagtgtgctgtcaccacgccactgcactgtagcctgagcaaaagcatgagacgctgtcgccaaaaaataaaaaataaaaaatagtccattgcatagatgtgccaccatttttacctactgttggacaaccactttctccagtgtcttgttacgatgattcctgtccctatgtaccccataaacatgagctacagatcaaagggacctgggcttgaatctggacctttccttagatttcttcttgaactcaggccattggcattctgactgttcgacccaattgccacgaagctctctcacaatgtcctatttggaaaatgtggtctttccatgcatcactgaaaaaggatgttcaaagatgagctttgaaacaggcctaagtttatgtggcagaaaagactcacacaagagtgtagaatctagattctagagtgttagacataggacctgatcccagtgctccagtggtttactgtgggaccttggtcaagccccaaacccctgtgagcagtaaaattccatgacacagcagaggctgagggcaaaggcttttaaattcagagcagctgggttcaagacctgactctgccacttattggcaatttatataaagtctaaatctgtatcattctgaatttacataaaggcctaaattcataggatcccatgcttagaaggattctgggaaggaaacggaacggtgcatgcagaggaccaggtgaagtgcacaagaaccaatgccaccacctggcctgccttcctagctctgaggcctgctgaatgctaaggctgaggtgtgagctgcttgtacagtggcccccctttatcctcgggggataccttccaagacccccagtggatgcctgaaaccttggatagtaccaaaccctatatatactgttttttcctacacatgcatacctatgatgtttaattcataaaccaggcacagttattatcaataactgataacatcgaacaattctaacaacataccataataaaagctacgtgcatgtggtattctcttcaaaatactggactggggttgatggcgggtgactgaaattgcagaaatcgaaactatggaaaaaggggggatgattatacttgttccaaaacgaggcccatcacctaaggcttggaaatcactctttccccatttgtttccctttagattctgacatgtaatgaaattcaagtgggaattttatcagttaacccaatgcctcaaactgacactggagtaagtagtcaagcctcttgaagcactcggagcacagaccccaagggtgcagggctgaggatcccacactcacagtatttacatgtctatgttctgacaatcagtcacgtgatgggagggcccttcgttggaaccatggcaaccagttcttgtctgttacgtcgagaaatgcttcctcggctgggcgctgtggctcacacctgtaatcccagcactttgggaggtcaaggtgggcagatcacaaggtcaggagatcaagaccatcctggctaacacggtgaaaccccgtctctactaaaaataccaaaaaaaattagccaggcgtggtggcgggcgcctgtagtcccagctactcgggaggctgagacaggagaatggcgtgaaccaggaggcagagcttgcagtgagccgaaatcgctccactgcactccagcctgggagacaaagcgagactccgtctcaaaaaaaaaaaaaaaaaaaaaaaaaaaaaaaaaaaaaaaaaaagaaatgcttcctcaacaaccaatatgcatctcacagatagtatgtaaccaagataaaagtaggatccttgaggatattcccaggattctcctacgtgctctccatctggaatacagaaagctcagaaaccatgggccatcagcacacagggaaaaccagttctgtggcaggcaaaaggacaagggtattctagttagaaggttgataaacgcctccagataaagttattagaggaaggacagatgaaatcagtgtttaagaaaatgcgaggcctgtttcccaggaatattacctagtgcaaagtaggatgaaaaagtaagagaggttgtcatgaactgaggacatggagaccctactcatctcgaaggcagatgttgccatctacagcctagagctctaaaccctctgaggttagggatctctttcaacatctctgggtggctcaaacccttggggcatgaactaataacctgtcggttatgtaggcaggcagcagactgtggcctctgctcgtccctggccgcaggtgtaacacagccagggcaaggaaccagctggtcctgagtgtgaacaccagcttagccaatgacagctttatcctcatactatgctctattattccagagtctgcctggatgtgtgcagagaagaggaggagaaagggaagtgaggggcaggactatgcagtacccaaggactcaaaggtgattccagaccctgactaccgattagtagttactatgtagagaatgaggttccattttagatgaagagctgcaactactgcgctttcattcttcattttttttttttttttttttttttttgagctggagtcttgctctgtcacccaggctggagtgcagtggcacgatctcggctcactgcaagctccgcctcctgggttcacgccattctcctgcctcagcctcctgagtagctaggactacaggcgcccgccatcacacccggctaattttttgtacttttagtagagacgggatttcatcatgttagccaggatggtctggatctcctgacctcatgatccgcccgcctcggcctcccaaagtgctgggattacaggtgtgagccacagtgcccggcccattcttcctgcattttaagatgggttccaagtcattaaagcaaaactgagggagtcacctaagaaatactccactttcagctgcagaagtttaaaaaactctaaagaacatctgttgcaatcactaacataaagcactttcccctgtacatgaaaatgacatccttggatcagactccagggtgcctgcgagggacaagttttagaatctgaaaggaatggcttgaaaggccatctctgccccttcctagctgtgtgatgttttacaagtattttttaacttttcaaggcctccatatccacatctgcaaaatgggggcatgccaaggctatggtagtaattgcataaaataataactacaaggttaagcacagaggccagcctaatccaagtccccttgcatgataaaccccataagcagaagtgcaaaggcctgatcagcttaaaggagtggcccaagagcaagcaccctagagcctgaaagtcaggatctgtccttagtgtgatcactattgcttgcattttagatgtacagtatccttcagcacagtgatttttagatctggctgggcatggtggctcacacctgtaatcccagcactttgggaggccgaggcaggtggatcacctgaggtcaggagttcgagaccagcctgcccaacatggcaaaaccccatctctactaaaaatacaaaaatcagccgggcatagtggcacgtgcctgtaatcccagctacttgggaggctgaggcaggagaatcacttgaacccagaaggcggaagttgcagtgagctgagaccacgccattgcactccagcctaggcaaagagaatgaaattctgtcttaaaaaaaagagagagatttttagacccaatccaatggtgttaatagcatgacaaatgatggaattcctatggacaatcacaagcctgtattaaatgtccacatgggagaactaagctatagcattttatgtacattcttttttttttttgagacagggtctcactccatcacccagactggaaggcagtgatgtgatctcggctcactgcaacttctacctcccaggctcaaatgatcctcccacctcagcctcccaagcagctaggactacacgtgtgtgccaccacatttggctaatttttgtattttttgtagagacaggatttcaccctgttggccaggctggtctcgaactcctggctcaagcaatccacctgcctcagcctcccaaagtgctgggattacaggtgtgaactacctcaccgggccctatttacagtattcttacttaatcctctggactaccctggaagaggacaatagtatttccattttgctgctcaggaagttgaggctgagacatgaagtgactaggttcaagcccgcacagttcataagcagccacagtggggtgtggatctgggaggctcctttcgctatactaccccaggctgccttccaacaagccctatttttcttcctgcattcctttatcttgcccccttcttaaacctaaaccctgacacttcacatgccttagaatcaaacacctgcccttaaaatgaaatatcaaaccctgaagcagggcagcttgtaagtacggggcagtttaccaatgcaaacgggttagtagaagctgagagtgcctaggaagacctgccaccttcacaagaggagaaaatggaccagaaaataaacacagtacctgttgagggggtcgtgcgggtgacgaggagcatctaaaggcaccatactttggctgcctcaaaggctctgggtaccaaatgtaactggcatgcctgggtgggccacttacacccagagaaacaaaaaaattaagtcttccagaagagtgacttgtattatcacctgaaacaaaagcaccatttcaaacaacttgttcatggagaggcaggtgcatggtctgcgaggcccagaactgacaaggacctgcagggagctatggaggaggcgggagatcaggtgtccacactaagtccaagctcccaacacaaagcaaagggagtgtccacatgcgaagacccttccggctctaataacacactacgagtccatgtcactgataataacatcgtgttgtggttaatgttaataattatggttaacacttgcctggctttacacatattaactcatttaatcctcataaaatccatcagaaatatctacttttatgctcaccatttcttagacaaggagatggaggcacagagtgaagggaactgccctggtctatacatcttggacctgaagccaggctctctggctccagagtctgcccttcactgcccctggactaggaatcatgactgcctgggatcacatagaaactccaagaaagccaccagtgtgacttcaggccaagcgctcagcgcccaccatgtgcacagcgttcagtaaatgtcagctgctgttaggatcacggctcccaccacggccaaaccctgacaaggccagcaccactggggcagtcctgagcagcagaaccgctcaagagagcactgccccatctcgggggcagaccccgctcggctcctctgttctcgactgagagcctgacactgacaactgggtaggccctaggagaagccaggcttggccgagagctcaggcccagagatctggacatggctagtctcacagtggaattgcctggccccagtgtttagtctgtattaggttgaaccacatgaaaggctggttaattcaacccttttttacctaggaaaatggcaacttcatatggttcaacctaatggagggagggattcttacatttattaaggacctactggacattcagtcattcatctaacacctgtagagcaatggctgtgtcagggccagtgtgtaacactgcttcagcaccccaagactgagagccaggatttttcatcttccctcctaaggataagaaacaaacttaccaggcagaacaagggtaaccaactcgatctgcctgagctcaggtaactactaaaacaggccaattttggccaggcatggtggcttcacgcccataatctcagcattttagaaggtcaaggcgggaggatcccttgagcccacaagttcgagaccagcctgggcaacaaagtaagactctgtctctaaaaaataagtagatagatagatagatagatagatagatagatagatagatagatagatagatagataggcaggcaggcaggcactgtggcacatgcctgttatcccagctggcaggcactgtggcacatgcctgttatcccagctgcatgagaggctgaagggggaggactgcttgagccgaggaggctgaggctacagtgagccaagatggaaccatgcactccagcctgggcaacagaatgagaccctgtctcaatcaatcaatcaaacaggccaattttgtctttcctctcagaatccctgcatcttacactgtatatggtgaccagggctgggatggggcttcataggaaaaagccaaaggatcctgcaaggctttgtcacccaatagtccccatggagggctgtcgcaatgattaagatgtgctgctgccactcacgtcacaggcaggaagagccagggacactgacactactgcacaaagaaccgtcctgtccagtaggccaagccacacagtggccgacgctaggctaagactatctcgccctttcagctgagtggctatcttttggaaaacagattgcagttcacaaagttccatctccttgcatttcaacaagtggaaccaaaaaaacctcctaaacaaaacccagacctcttcagccactgtggctagacgtacaggggaacctctcggccccagtttcctcatctataaaataaacatccccatgggctggtgccagagaggcaggagaggggaattccatcagcatgcgctgagtgcggtggacctggacctccatggcaactgccattaactagctgggggcccttcagcaagttactacacctctctgagctccggtttccttatctgcaaaatgaggaaacagacctcacagggttggtgttgagagaattacagacaatgactgtgggcatccggtaaatactggcagaaggaaggggccactctgtgagtgaacactcaataccagcctacagactgaaggtatccttcatttcatggcatcccctgatgcctgtgccatgagtgcactcctcaagaccaagaatggactctgcttaaccacaccccagcccatcctctctgcctgaacaaggtctcaaatctcaggacaaccaggggtccacaccaccctgtgcccaaaagagatttcaggatagaaggtgtctggagggtatacactgaggacatgacaacagctcacattggaaattctcagcagaggaactaacagccaagcctggccgctgctcttttggagtctgagttcctcagtgtctcaagacttttcacaccagaaggatgtggtggattaaggctcctccttccagtttctgagcacaaaactgcaacgcagggagcccactcatgtgaaaccaacgacagcccatcagggtcaaagcctcacgacggagaagccttcagcagcaacactctacctgccaatcactgctgcaactgagaagggaaaagggcaccggtaccaccggaaaatgccactggctcaattctaattggaagctccagcagatagggtgcaatgcaaaagcatcttttcataactttttttgaaagaaagatggggtcttactatgttgcccaggttggccttgaactcctgggcccaagcgatcctcccacctcagcctcctgagtagctgggaccactgacacacaccacagcacctggtttaactttctattttaagttaaagtacttcacttggtaaatacgatgcctgaatccacttactagggctctgagacagcaagcccaaacactgttaaataagataccgagcctaactcaggagcatcatgctgagttcagcactagaagaggaagctgcacagagcaattgaagcagagggtggagaagtgcggggtctgagccagtggtaacaactgcttccaagctgcaatgtggtaagagctcttgagaccagaaaccctgggctgctgttttcagcagtctggtgtttaaacagaatgagccccttaagaccactctccttgggcaagggactctacatcttggagtctcagaagaaggaactagcacctgccttccaggctggttgggaagttaaatgaaacaccacctatcatccatccatgttaacagaataaccacaataataagagataacactcctactgcacttacaacgtgccaggcatcgtctacactttccacacataaactcagtcctcacaatcatcactacgtgccaggtgaatggcaaccaccagggttgttgccttacaagacacgtgacgacacaactgaaaacctaacactagaaagttgtaggcaaaggctcctgttcacaagcatccagagatgtcagaaacatgtggggtgaccataggaggaagcacggaaaaacgcaggcaagcagcctccctgcctgtctgacgctgtggacttccccaggctggttctgcactcactcctgagtctttcagaactttggacatacttgcttccacccgcttcctccatttaaccttaagactcagatggcatattctattaggtctacctgactgctcagtagacatccacggaatgaatgacccgatggaaaaaaatcactaaagggagcatagcgcagtgccaggactgccaggtgggcctcggtttcctcacctgcataatgagggtgacatgagaatctgcctcgtagggctggctggaatattaaaaagtcatcagtcaaaactagctcctggccaagtacagtggctcatgcctgtaatccccagcactttgggaggctgaggcaggcagatcatgaggccaggcgttcaagaccagcctggccaacatggtgaaaccctgtctctactaaaaatacaaaaaattagctaggcatggtggtacgcacctgtagtcccagctacttgggaggctgaggcaagagaattccctgagtctaggagacggaggttgcagggagtcgagatcgtgccactgtactccagcctaggtggcagagcgagactctgtctcaaacaaacaaacaaaaaaaaactagcttctgttattcctacagctgccatgcagagcccgccaccccaccatctccctcagcagactggtgtcttaggcaccagaacctaatgctgtgtgcatcaggctgaacttggtgccacctgcagtcacagagtcactggctggatggatcactgggctacccagactgaaatccccattcagttgttaacaggctctcaaggctttgcagacaccactatctaggatttagactgacctgaaatagctgtgtgtcaatgataaactgtccaatcagaacacctacatgggacagctctggggcagaccccctcagctccagaggtggtaaatcattccgtgtcactctgcctttatctccttccaccatcccttcctttccacacccacagctgcacagtggccaggaccctcataagctcacaagctgatgcttgtggaggcctctctcccatctctttcacctcccaggcctcctgcatgcacagccagagggctcttcctaaaataccaccgctctgccagcctcctcgaatttctacctgccctgtcaaaaatttcactggctccacactgtcccagatctaatgcaaactccttagcttagcaactcaggcactccacaactcactcctgagactgaggcaccccatgggctcgcatctactgcttgtgtgaccacaccccctgacctctgcttttgtgccagtccccttgaccataccccaccctgtcctctctgcctgagcacactcttcccaggcttcatgcccagcccccaagccgactgcaggctggagtggtctgcagggctgcgtggaggagggggaaatgcaagccaggcctgcagggatgggcagaccacagcacccatgggtccctggctaagtcttttctagtactacttcattcctgctgcacttggctttttggacgcatcttgcctccccctcccagattagaggacagggatgatggcttctatttgtgtcccttattctgtggtatgcagaataagacatgcaacaaccacagctactgtgtgccaagcactggagtaagtacattacaaatttcacccctactccccatctctataaaatgttatcctcatgcgacggaacaggaaaactgagaccaagggaattagccgcctcactgacagtcacatgctgagtggcagacaggactcaaatccagatgtgcccaactgcagagaccatgttctgtggagcaggcagccgcctctcagctctcactcagtgtttatgtagctggcgctaagtgccaggcggccagtgcaaggtgtggggtactcagagggaaccaaacagacaaggtccctgctctcacagagctcatatgctctgtccccagccctgtctctcttcttccaagcctggaagagggcaggaaccctccagtcacagggggttccactggcacaaacaaggaattcgggcctgacatatagcatgaggctctggcaacacatggtgcccagctcacagtgagcttgtctttaatggagaaaagagccccaggctctattaggtaagttgtgcgttcaaggcacaacccagagccagacaaactccaaagcagccatcggcaggcagtacggagtggagaaaaacggtttgctctggagtcagaaaacccaattcctccacttagtagctagacagggactaaccatacacccctttgcacacttttggaaaatggtgataataacaatagttaatgtttacatcactatgtgccagatgctactggatgcacttgacagatattacttaaccctcattacgaccttatgcagaggtactgttatcctaaagcagtctggctcctaactctattttcttgtactatgctgcctccagcctaaagttgaacctaccttgtcaggctgtggtgaggaccgttctaacagagtgcatagcatgtggctggtgctccataaccattaaacctccctttccttccactgaaacatgaatctgtgaaagcctaggtctggaaatagcatatggctctagctggtcccaatatgggtgatcttgcagttgcatcccctggaattccacaccgcaccctcactggtggatctgctgcaaggggaaatgggacaagatcctgtatttacggggccctctgctcactgtgttctggaaaacacagtgagtggggtccagcacatgacttgggctgacagggatccgaatcccaggcctgctgttcacaccggtcactcaagctctcaagcttcaggttccttgtgagtaaaatgggggctgggctataacctaagtcatgtttctgggtcacagcagatcctcgggtacccgggttggacaggctggacaaagctacccaggctggacttccaaggtactgtaaggtttcatttcggggccccagaaagccttggctgtgcagaggagcggactgcgtgcacgtgcaatccaattccacccaatggcagacacaagagaagacacaccccaaaaggcctgggagtggagcctggcacaagcccccagctttctcttcagtttcctgccatagctcatgcagatgtgcctgcaggtacactgaacaaggctctttcccccttaagctttaggtaacgatgacatccccacccctcaacaatgtgagccatgagggcagagatccttgtcttgcatcctcagcacataagcaccacagagtaggcacttaatacacaaaaagctgaattaacattatcctgtagctgcaggtaccccacaacatgcctcagtatttgcctaacaataagcatttcccagcctggagggagggcaggcttctaacgggcgaggcacctgccctgccaccatttccctgtggtcagtcatgtcctgttccccacctcatggaatgtaaaagtataggatgtctgagttataaataggagcatctgctttcaaagacacggcttatcatttccttaatctcaagccactgatcactgcctactttttataagcatgccaccaaaaagaggccaggtgggcttaaatgaacagggctgtatagacagacaagagggatgtgagttgaacaatgtgtcttatccacatcaagagacattaatgtcaactatgttgtttcaccttgtaacaataccaagttcccatcagctcctgccaggcaaaaccatctgtgagctggagcagcaattcctgagggggcctccctagtccccgttcctgctaaagcctcaccatcatcataactaagaataattcccaagtcagaaactgaagctgtgtaaggaacggtgctctgaaattgtacagcactcagacagtggtaagattattacctgctaagggaatgcaaataaattccatttgcctatgcattttaactgggaaggagaaactcatgccaacaaaaatcatggaattcattccaaagtcaaatgcattttagattctcaagtcactatttccctcaatggataacagagatctagctgtattctctaccatcaaatctactgaaaatgaaaaacatggtgatctgaattcatttacctacaatgcaacctcacaccaccacttctgtcctacgccaaccatctacaccggcttaatggtcagagtattcaaataggggataaacgtaacaataagcagtcagaaattacaaggctaagggatactaagaacaagtgactgagagaatgaatatgaaatccaagcaggtaagttcatggacacagacacatgccaaagagaacattccaagtggtttcttccaacgccaggtgctgttctaggccccacggatacagctgcggaaaacacaagacacaaatctctgccctccaagagctcattctggcccatgctaaatatgcctgtatcaccatacagctatttcactataaacatgatttcctatacaaaggatctaaaatacaatacatgggcaataaatactgctcctccccccttgccatgtttgaatatcccattttatgtttttcaaacggtatcattaaaccttctgacatacaagcagcttggtacaatgggaagaacagtttagagcctgccagatgggcttccactgaccaacagtggttcctccactggctgagcaacaccctgaataagtcactccacctcctgagcctcagctgcctcatctataaaatggggacagccccagaagggcttcctgtggatgaaaacagcttgtacaggtgaagcacaccacagtgactggcagacagttcctccaccctttccagccttttcagatgagagctgagtacaagactcctgagaagcttcaggtgtcatgtgctcctcctgggggactgaggcactttcccatcacctggcgagaatcgctgcttcctgccttatactttgtcctgagtgcacactcaggaaacttcagcccactttcaaagtcctcacccaccactgccctggagaagtcgttctccatcaaggcctggggccaggcccacctccccaaacaaggagttttcagccaaagttactggacaaatccgaaggccttaaaagtggcattgcccatgtttttaatcagcatacaggaaggcatcaaaagaaagcttaacccatctcaactactcaccctcgttcagcagcaacatcccttgactaaacaaggaaccatggtcctcaaaacactttgaggcccaaagtccacatacaaacatgctccaaaaatcccttgatcctgtcaggaagaagttctctggcccttccaacctaagtgctgggcctgtcctgcagaagggtcaagtggcaggagggcaggtctatctgtgggggcctatgtgaaaccccaggttcctcaaaagtctggatagcatctgccttctttaccaaaacaaacaccacgagcggagccagcactctccctaggcgttctgctcacctgatccgagggacttccataatcagcagttccaacccttgcaagctgacagttcagagggaaggggaggctgcgcctgcttgggtgcatcgtgtccaggccatatgctggatccagggcctggtggccccccaaggccacggcctcacaagggcgattgtgcgttcatccttgtcctgtgggccacccatcctcgcccctcggctcccactcaggcccgggcgccgtggaccccggcctgccctgcagaatgcttcgcacgcacagcacccacggcggcagcctcgagaagggcccgcagagcagcgcgctgccttctgggcacaccgatgcccgcccttccctcgctggctcctaggcggcctccctagaagcggcaactgagaaggcacagcaccgggaccaccccatccctgatggagagctcccctcgctccccaaaggctgcaaagaaggcgcgccccaggtacagggaaggggaccctgggtcgtgcaccaggcagggggcaggaccctga

SEQ ID NO: 183 - DNA, 146800 bp, Homo sapiens
gctaactgcgccccagtttctttttattgatttcttttcttttctttttttaagtatggaggctcaagtataagatgtagatttttttcttaagctttacaaaaaaacaaaataaaacaaaaacctccttttgcattccatagaaattgacagaaaagcacctggccggaagagcggaacggtcggcggcaccccccccagcccccaccccgcggcctccgtgggacgggagagtctgcgcaggacggcaccgagggccacctctgctcccagagctgtcccctgtccccacgacccccaaccccaagcaactcccaaacacacacggaataagatttccagtttttcttctctctttcacacaccacagttagttcataaaatttttttgttttacattttttacaccaatgtaccaaaaaggtgggagggaagggaggctggcagacagtggattttatgcctataaatggggggacagggaggaagacggggggcccgggtgaacaaaaaccacacggtctctatggaaatgtggagagaactgagagcgaggtgtggcagaagcaggctcggagccggaggagggtggctatcggctttattctcagggagagatggcgctgtgcggtcaatgatgcagctgttatgtgacctgtcggggagggaagggacgagggaagggagcagaaaacgagttttctaagaaaggaatctaacgagtgcacggcgtgtctggttagcatgaaacagaggtttagcattgctgctttctcttcaaagcctccaccaggtcattcttcagagcttcttgttttgatttgtctgcaaaagtctgcacagacctgcaagggaggaaaggcgttatcagcagattgaacagggactggtgaggcggtggaggcctgggggccaccatgccagtgcctggctgatttgctgcatggacccgcttcctggggtgaggctctgggtcactgggctgggcatctgcccctctcagaaaggggcaaaggggtacatggccgagacctgcaccctctgcaccttgccaggccctgtgggggtggcatatggcttacatggacaggtgctcatctctgcccctggccaccggtgacccggccatagtccctagaaccctaagttcactcctctgtgtgtaggtccctatgtcaccctaagccacaaggtggcttctgggcttccaaacacaatggaacaaagcccctctgcttcagaacagctaccctgggttgctggctggggactcaggccaggggctaagaggggaggactccggggccatgcgggttcctctataaaagcttctcccttgcccaggccctgcccagcagaagagcctcattcctcatcccacaagtgcaaggtgcagcgttatcccacccttgggagtgggtaagaaccagtgtctctgcgtgtctgagcacactgtgtttatggcccacgcagcaggtgctttcaggcctctgctgtgaggcaccatccgctgttaacttggcccagaaaacccctcagcccggattgcaaagggcggcacaggacagccaagtgcccctgggatccctgctgtcaaattctggatttgtggggaaacgttcagggcgaccgcattcacgtatgtgtggggacgctcatcaacaaagccagaaacaatgaaggcttatggagatttcacagtttacaaaacgcctttcacatatattatctcatttaattttcacgggcatcctggggaagtctcaactatcaacccggccggatgtggtggctcaagcctgtaatcccagcactttgggaggccaaggcaggaggatcatttaaggccaggagttcaagaccagcctgggcaacatagtgagaccccatctctacaacgacaacaacaaaaagcgaagtcaaggcttaaaaaagaaaaaagctatcaacccaatttacagatgaggaaactgaggctcagaggaatgcccccctagcaattctttaatcattttgtcaaatttacccaacatattggttaggcaaagacttcctaaatgtaggttttataacagtttagaagcagtggaaagagtgggtagagggctgctcaagaagagtgctacggagagtgcactcagccggactctcacgtttgattcacaccagccatgggaaggaagaatcagaaaaatcaatccccagaagcaaaaatgggcaaatggaagtgaagcagggcccaggagaagcaacagcacccagactgagttctggctaccgaatccctacaagtcacaggaagagccctcaaaatactcagcaggtgccataagacaagacctggaagcaagctgcatacaactgaaaaaactcccaggagaaacgcagacatttggttcatgctggggaaatacacgtttctgagtatcttcccaggactgtccctggctctgcggcggccaaaggcatcagcccccacggcccccaggctccaaatctcagccgattccccaggggcttcttgccaagctcacagcgggaggtcaacatggccagcgggagatgcggcgggcaaagcagcagcgcacaggacctctagcctgggtggtcactggctcttctgggaaggaagagccaagcccgccaggtcttggctggatcacacgaaggagaaagttccagagctagaatcatgttagacacaggaagttagaagtgaaatggtggaaggcggaaggagcagggggcttatttaagggacaatgcttgggaaggtcacggccaagcaacctcgaatcagcgcttggagacagtgctcgactctgtgggagggaggagtcatcttgagcagacctggctgccagggtttctacgccaggacgcccccagtgggcggccagggaactgcaccatcacggtgtatcttaaaaagagttttttctcaatgccatgatggaaatgcctgatggccacactgtgaggctgacccgagtcgtgggccttaagttggcacacacagaccagactggtgcacttaagtcccacggcctcggaaaagcagctccacctggttttctaagtgcctgaccccacctccaccttggaaagtctgctgcaccccttctggggtgggccttcagtgcgcagcccctggacctgggctctgcagccccagttggcagggttccaaatgccttctttttacaaacaagtttccctcctactctccagggatgctgcctccttccctacatctggatctgtcacaagctcaagtcatggttcttggccattaccaacaagcaagactattttcctttccattagcgaaacctgtttaaaggaacagctgcagctcgttaggggcggaaggttatgctggttgtggccgagtcggcactgggcgtccaggcagctccagcagagcatctgggccagccagggtggagtccagccctgactctgccctccaaccccagagactcagagatcagagagtgaggtcaccccttccaagccagctagccctggacaggcaatgtgccgctgagcagcggggaggcttatgtggcttctgggatccctgcaccagcatcagaggctcctctgaagcatgggggggtggacggcaggcagatccctgccctggggacagtcaggccggtgcacacaagtggctgctgctggagaggcagcatccgtcccttggcctgggcttcttcagaagcaaaagccaaaaaatcagccgtcttccccacacccagcctccacccagagtggaaagcacacacacgtgataggtgccgtgttacatggggccgaggctacacgggaatgtggctgtgcaccgaccgggagcacacgtgggggttagtggtggtttaaatggccgcggagcagcagccggaccggcagggtctcggcgggttggtgagtcctgttttagtggggagggtctcgcggctctcaggcagggtacctggatcggcttaattatcaggctggatgtagatctggcgctgggtcagcacttgagagagctccctctgcaactgcttaaacttttggttgtcagggatagcatcaatagatctacagagagtgttcaagatgagtggagtgggagggaagagaacgacgagaagccaggaacgcagggggccacagctgaggaggaaattcagggagacccacgaggcggaaggggggatgccgtggcggctctggggtgtggagtggtatcgccgctgcagaggtccacgctggcggtggtcgtggtattcaggggctcgccaccaccacccgcaggctcttcggcttctctcccccacttcccagccactgcctggggactgtgcaggttggctgggcgggaaagtgtgtttggtgtatcgggcagtggctgccagtggcaggcctaacgccagggaccactgggctctaaccctgtcacaggtcacgaagaccaagcctcccccaggtgggcaggggatcagaagacaagggtccaaagaggactcctcctctgttttaaaactgtaaagcaggtgactgaaatctgtcgcccaccccagtccacgagctggggcagccccgggactgcagcctgcctctcctctgggctgggctgtgagagctacaccacggcagtgggtgagagggctggccgctaaaggcatagcacagcccgactcacacggtgctgctggactgcagagcgtgttctagattcatcatctcagccgaccgtgcctcctcgactggacaagggcctctgcgaggagtgccagaggccatgcagctcgggatgacagagcttaggggagatcccggcctcctgactctcctgactccaaggccagtgctccctccacagccgtttactgcccccagctgggctctggcctcatgtcagaggcctgcctcctgctctgtccgccgtggacctggagggtccagagagcgcccggcttttgtttgggctgacactgcagagctgagggcacgaggtgggaaggatggtgcaggacactggccactggcagcagagccctggcagaggacgtcagagaggctggggccccctgagaacgcccaggctgagggccctgcctgcatgtggcgtcagggaggctgggggcctgagaaggcccggactgagggccctgcctgcacgttgcgctctgctgtctcggagagcaggccagccagaggcagccgggctgcccggaatgtggtgtcatggctcccctaggcccaggctggagggtggggagatttttgagcggggactgacaaactgcagggctgaggaggctccgggggcaagggcaccaatggctgttagggtgaacatgccccagaaaacaaatggtgcagatagggaccgacagctgctacggagagtgcagatgacacatcaggactttactttccaaaatcaacataatgatcatcccagaagaggggcactgcagcctaccaatgaggacaccgaggcccaagaccacacagctagtaactggcagagccagggttcaaatccctctgtctgcttctaaagcttgtgctttctggtacattacctcagcccattgacgatatcctttgtttttccaaagtagatctcgttcagcgtacttctgattttattttccatgtcctggaagggaggtcggtcagcgcagtggcaaaaggtcaggaaccctgaggcccacgccctccctccacctgccagccctgcagtccccagtgtggccactggagggtggcacacgcctgctctggggcatcagtgagcgcgctccaggctgccaagaccccacctgccatctgtgctcccggcaccttcccatccacagtccacaggcagggaggaagccagtacccagggattggcggccagctctgcccatgcctgggagctgctctaaaccacatcaccaccccttgggctccccactaattttgtgaacaattctgtgaaacccgagagcacctccctgccttcccaaacaacgtggtgacaggagggccaaggcagccgcaactgaagccacaccagggcccactggcattcctgggatctgcttcctctcccagcgcagggccctgttcacacccaggcgatcaggggagacaagacctagtgcgccccagagccagcgcctgagcagtcttctgggagcccaggtctgggggtggagcaggaggtggccctgaagctggagcctgctggcatccaaatcagaggctccaaaaatatgaggccagggcaaaatccaagaagcgctctgccggctgcggtggagctgagagaaagcagcagagaaggaggccagcacagcggctccggggctgcagtgtcactgctgtgggtcactgcaggagccagccagagcccaggtcactcacctctaccaggcgcccgatgttggctatgtgtggggagcagtcactcacagtttcatccttctccatctgcaaaagacagaaacattccaagtcagagaaagccagagatttctgagaacggcagacagcccaccccacctccacggtctgcaaagagcctactgttcccaccgtggagccagctgcaggtatgacaaggccagttttgcagcctgggaactgaagcacaaaccgacttcagtttcagaccataaagagcccagagggcagaagcccagagtcccacttccaagggagaagattttgctgctgcccatggtagagcaggcagatgcccagagccacagcagcagcccttggcaggcaccagctcacccgagccaactggagaagactcactcggtttgtcttcaggcctctactggcaggcccaggcccacgctgggccatccaccccaggttcagggcctgacactgcaggggaagcttctgtgctgctgctgcgccctggcgctcccaaatggtggctttggggtgccatctgctgcagtctcgcagggagggacagacaacctctgacggagacttcaggccagagggattcagtggctcaccctagtcatgcaggtggcaatggcagagcctgggtcaaacccttcctcgcaccagggcctgttcgttctactctgcgaggagagtttgagcaagagagtctcaatatagactctgaggttatgaggggggcagcagcactcaagccccatctcctcttcccaagcccaggaagagctggctctgacccaatcatctcaactcggaggagggaggaaatggaggcaggttagggtagaaggaattcggcactttcccccgaattttttcttatctgaagccttatttccctgacaagaatataaattctttcaggagagatgtgcctgcctcataacgcacagggtacctggaagagtgctaggaacataaatgctcaacgttactacactgaaaacaggaatacgcagctacgatgactaatgttgttgaaataaaatgtggaagctgaaataaataatcaagaaagaggaagaaaagaacagcatcagaaagggtagagtagaaaccatgcaagaagtggccatcaaattataatacaaaaatgcagtactctaaggctaagcatttattgttgagattctaaatctgcttagacattatttataatttttgaagctttattaaaataaaataaaatttgtgagagaagctaaaaaaaaaaaaaaaaaaaaaaaaaagaaagggtagagttcaaaatgagaccaggcccacagaagaaaaaccagcaaaaggtgggttcctctctttggaaccaggagaacagggtggagtctggggggagatactgtctcagagggtacgggctctgttgcttctcacctatttctacatctcctcatcagggagactgactttcaggctgtgaaaggtggaaccaacctggttaagagcggggtgagcagagggcaggagagaaccaagccactttaaacgaccaggcttccagggtcgggcaaaaccgacctgtgattgaaatccttgacactgggggcggcagcactgacccgacttttgtctttttttttttttttttttttttgagacggagtttcgctcttgtcgcccaggctggagtgcaatggtgcaatcttggctcactgcaacctctgcctcctgggttcaagtgattctcctgcctcagcctccccagtagctgggattacaggtgcccaccaccacgtccggcttttttttatttttatttttattttttatttttagtagagacagggttttgccatgttggccaggctggtcttgaacttctgacctcaggtgatccacctgcctcagcctcccgaagtgctgggattacaagtatgagccactgcacctggccgacccaacttttgtcaaaaaaggaagaatggcctctgcaaggaaacgctagctcgaaactgatccagacaacaatttttgatgggatcgttaaaatcatctgctggcacattttaaactcagagatcatgaggagccagccaggctcactgtgaacaagccctgcacgagagcacttcttttcctgttttggtggggatgctgggctggaagaaaacacaactacttaaatagggtcgcatccttctggcaagttcccatctaccatcctgcacctgtggctgagaggaagggcaggatggagcctctgccgataggggtagggacctggccacatttccacagccccccacccactcccctccacacctggtcagggtcagctcgctggcaacaccgacccaccaaaaatagaaccatttgtgcactgcatacactatgtggcaccctgtagcagtctctgcctgcccttggtcaacttgtttgtccaggacttaagtaaaggcccagctgagagaacgaccagcttcctatcgacagtgtcaagggttgagatggtcacagggttaatacggaacccggaaacctgggctagctacagaacgagagcagcaacttggaatggagccaggcggcagccacctttttccatctcagcttcctaggaaccctgttttaaacccaaggaaaccgaagcttaaagaagcaagaatcatacagcactgttagattccgacgcctttgctcctcctacttcaccacgccagttaaatgtaccagggcaaatgcaagccagatatttaggctcaagggtgcatttcatgcagtacaaaatggggaactgctgacttgcaaacagttcctatgaagagacttgtggtttttagataatttcaagtttgacaaggatgagatgtcgctactaggaaagcttttgtgcaactttaaggtgcacagatgacactattccttgtgcccagataaggggcagcattcccaccccatcgcgtgatgaagacactgcagctgccagtttccattgcttgcttgggaaggcagtggttaccctctgttctgtcctggcccagctacatctgcagggctggattcagtttagggcacttttttttttttaattttcttttaaaagacaaggaggtcttgctatgttgcccaggctagacaggaactcctgcaatcctcccacacagctgtaactacaggtgtgtgccactgtaccctgctaaggcactgggttttaaaagccttgaatgagttagcattcatctgcttaaaaggtctgaacaccctgacaccaagaaatgggagagaactagggctatccaggcctggcggtggtgggtggggagggatgtgtgtgtgctaggggagacacaagagattctggcagggctctgaaggcctgctgtctgccaggggaacagacccaacctatgtcgctgtagatggcagaggggggaccgagcagtgagagaacatcacggctcactgggctggactcggtctgttctgatagagctgtccctgacaggcatctgctcacaaagcaatgtggtctgggagaccgacgggtctgagaaaacgggtggcatctgacaaggggggggggcggtctaggtgagggcaacagtccagaacctgctgcctcccaagtcataacagtaaatatctgcagaaaaaagacatctggttctggcaaggctgttttactgaggactagtggaaaagagggagagaaatgctagaaagaccggcttctctgctcccatctgtcttggcatgctctggcaagtcatcctgaggaatctcgaccctcagaccccagggggtctccataaaacaggagtagtgagagtgcccatgagcttgagagtcacagttctcatttcaggtctaataaacacaccaacctcggcagcactggagcgtctgctggaacatcatctttatctgccactagcaaaaccctggtgccaagacgacggggtgggctgtctgctcaacaggagctggggagcaccctcaggagggagggggctccatccacccagcttcaaaaagaacttttgcatgctggcccccggggactgtgtgttctcccagacgtgaaggtggttactgtgcctaggctcagggctgggtggagtcagctcggcaggcagggaagcctgggggttggatggaaatgaatgaggtccttccagcaaatcagagtctctcctcctccccggctccatgtggacggcagattcccggccaccctagggaagggatgagggttttgagctcactgtgggccccattttaaatgggcaccaacagcccaaagagaggccgcggccatcggcaaaggtcctgggtcacctgggcaagtccagtcacatcagcaatttggcctcttggttaccatctttgtgtttcagaatcaagagccatcttaaaacaaacaggcgaaaccccttggccaacaaaggtaggagaggtcgggtggaggagagggctgggtcttgcagtgtgcgacactgtccccaggagcagactgatcccctagaacacaggccccctcagcccatggcagggaagctgagcccacgtaaatggccacgcagcggctggggagggaaggagaaaggtgcttggggagtgaggggcacagggctcggtgcacccggccgtatttccacagcccccttgcccgcccctgctcactcccctccacacctggtcagggtcggctcggtggcaataccaacccaccaaaaacagaaccatttgtgcactgcatatattattacatccttataaaagtggctgccggaaggaaaacattttcatgtgttgtggctgcagatgttccacgaggtggttccaatggcgtctgaagccggagcctggcccgtgtgtccccagcaggcgcctctcctcctccccatggccctaacacaggcaagtgtttggaagctggcagcctttcccccagaggggatgtattacacctcccactgccacgtggcatcttctagcgcgacccgcagggcgtggccctaaggcatgggccccactcaccggcgctgaggccccgcagctcctgtgctgcagcccgagaggaaagggcctgggcttgtctaggcctccatgtctttgccttcacctcgcactaaataaacaaatgtacacaaaaggcctagagcgggacttgccagaatggcagctctcaccgattgtcaaagcacagctccatccccagcactcttctggcctctggcatcctcctggtcaccacactgtgctgtgggttggaggtcaggacccggcgtgcagccaggccagaagatggtggtcagacggcttcccagggaaagttacggttgcccagtttaggaaaattttgaatctagaattgtacatattcaaaaagcctctccttgcaagatatatggtagtagcagtaattgtttttatttttatttttgagacagggtctggctgtgttgcccaggctggagcacagtgttgtcaccacggctcactgcaacctcggcctcccaggttcaggccatcctcccacctcagcctcctgaatagctgggactacaggcacactgctgcctcacctggctaatttttgtattttttgtagagagatggggtcttactttgttgcccaggctggtctcaaactctcgagctcaagtgatctgcctgccttggcctcccagtgttgggattacaggcatgagccatcgcgcctggcaaaagttattatttattgagcataaaactgtgtgtaaaacagttttttgtttctactctacaatgatctttcctttttttttttttgagatggagtcttgctctgtcgcccaggctggagtgcaatggcgcgatcttggctcactgcaacctctgcctcccgggttcaagtgattctcctgcctcagcctcctgagtagctgagattacaggtgcatgccaccacacccagctgatttttgtatttttagtacagatggggtttcaccgtgttggtcaggctgatctcgaactcctgacctcgtgatccacctgccttggcctcccaaagtgctgggattacaggcatgagccactgcacccgatctttccattttttttttttaataaaatttgtttattatgttttttagagacagggtcttgctctgctgcccaggctggaatgcaatggtgcaatcatagctcactataacctcaaactcctgggctcaagtgatcctcccatctcagactcccaagaagctaggaccacagatgccaccctacccagataactttttgttttgttgggaggggtgaaggggtggggggcagtgcaactgttgcccaggttggtcttgaacccctggccaaacaatcttcttgcctcagcctctcaaagtgctggaactattatctttcaaaatgggcattatcaacactgagtttcaaagaggtggaggtctgtctaggtcacacagctggaaagttcctgagctaggatctgaatcaaggtctgggtgattctgaaacctgcttccttttatgagatctctctgctggctcaatttcacatacatcctttaccagaaaactgaaggacaaaccacaatccagggctcagaaaacctgagcagggtccatccctgcctcagccgcctcctgccagggatctccggtcccttcgtctcctgtttccgcccttcacagcacgggatggttgtggggagcctgtctcaggccagctttccttctcagccaggcactggtcactccaccccaggtcatctggcaaaaacccagacgccccttgaagctgcgctgctcaagcatctccacccctgaacccaggcaaccccacaggacacgaggagcgggtgtgcagctgcagccaggcctccccagcgagcgtgcactcctggaactgccaagctgggcccggcccaccctctgttccctgcatctggaagggcaatgggcttcttccctgtgacaaaaatatactgcctggcctaactgccaaacgcaagtcaaagaggatgttcctgctaggatacacaggcaagtgcctctactggggatttactgcctgaagatatattgggggtgtctctgctgagtggggagagactgctcactagccaatgacctgcctgatctccccactcaacaaaacattccaccttcatttctaaatatttagaagctgagaaaatatcaaacgaacatctgcagggcccttccccggatgggaaaccttggatctctttccagagatttacaatctcgcctctttcccacgtctctgctgtcacataggagaagtgacctctcagtacaacttccttttcaacattttggaacttggggcttgcaaccttttttcgcttgctctacaaccctcccatggggggccacgtggcagtgtaccagagggtaccttctgcccgcctttcctcacacacatccacaagcctgggcaggaaggtatgatccggccggcctgcggctcaccttcactccgacagcctcactgctgcgggaatttgccagaatactttagctgtttaccttgtcttccagttgacgtccctgagaaacatcttttggtggttggaggtgggagaagtaaaagccgaaaatgatggaggcagggctaggtggaggcagcatcgcctggtctggctgtgttctggctggctggcaggccacgtgcccaggagagtggcgctctgccccggccactggcctaccaccagccgcctacactggggcacgagtgggcacagggcatagcctgatgtgcccacggaagggacccctgcgaggtgccagcaagccaaagctggcggccttctccagatgggccgtgggaaacaggaagacaagggtgcgcccggggccacacacagggaagggcagctgccgctgctgccggggtgaggcaggctgggccacaggaccctgggaaagctgaggacccatggggccttgctgagggtgctgatgctggctgggatggctcttggggctagggcctggcactgtgggcctggggagacagctccaaaaccaagcagccttccttcctgacacacgtggggcaagggcatgtgagcgtgggtgacctggatgaggccaggtttccagaggaaaaacccaggcccaggttgctgtaaggactgtgtaaggaggaactcgagtgaggggctctcatctgacccccacctcacatcttggtcgtccagcccctgaccacgccacgccagaatgccccccagcctgcccctcttcccctgcccttctgtttctgcccttgccacctcatgcctcagactgacactagcttcttcactgacctctctgctgcagggctgtcccctctgaccctcccagggctgcctgatccaggcccttgtcatctctctccttgatgactgtaacagcttccccctgaccacccatcccccaagccgactggcagagccaccttctgaaaacacagatccaatcagatcattggactccctagaaacctcaaagccctcctgacagcctctagtagtgaacacaccccagtggccaagtggcttccagcaggagatcatcctgaaagacaaaggcacacctgcgggaggggcccagagggcagcgctgctcagcacacacctggggagccttgacgccgtgtgcggctctgcagggttgatcctgcttgcggggcctgcttgctcctgaggctacaggtccactgcagctgctcatgccggctgctgagacagagtcctgtctacactgagctgactgctccatgcacttccatctgactatttagcagtcaccgaatggcaggcacagaggacgaattaagaccaaaacagttgtggcatggtagaaagtagcatatttttttctcaccaggcaaatctgggttcacatcccagctttgcttcttactggttaaattatatgggcaaattatttaagtttgaacttcagtttcctcacctgttaaatgagaataacttgaccttggttacaatctaatccaaggggacagcctgcaaaccatgcatgttcatgctcactgagctgctcacttctcccagaacccttcgcctcccatccaaacaagcacaggcgtttttccaaggctcctctgggacccgtagccaagctctgcaaccctcacttcccctgtttgctcagaagctgtgcatcattaacttagatttgtctacctcattgcaatccctcccccttctgtagttacttacattggaacccagccccagctttaatgcacctcaaatgaatgatgtggtgatcggccgttagaatgatggcagagcattaatttcctcattaaagcccccagagcaaaaggcaacgcaaacaaagtccgaagccctggccaaggtgtgctgaggacaggcactcatcaggcctgggtttagcttggcaggagacactgctcacggcaagccggaaccagactctggccatgggctgacagctctgatttaaactattaggagggctgaggattaaatatttgtccaggtcactgtaaaccgggtggaattatcaacagcctggagtggtaagtgatacaggaagcagtctctggatacagattcaggattttccacccactccccaggtggcaggatgtgggagagtcaggctgcaggggagctggctgcctgggggtttggctgttcctccctagccaatggcccctggaagataggagtccacttccacgcaaaaaggctaagtgccccctgtgtgcactagtgagtagtcctgggatgggactgtgacatccctgcccagaggccaaaaagaggaccgcaacatcccttctggcctccagcccctctgacacaggagaggcagtggagcttctataggtggagggagggtcccaggtatgacggctgacattcaccttgcgccactattttttcaatgcatgtagatgttgttgtaactagtagaatgcaaattcacttaaaagatttactacactgggccgggtgtggtggcttatgcctgtaatcccaacactttgggagaccgaggtgggcggatcacttgaggtcaggagttcaagaccagcctggccaacatggtgaaatcccatctctactaaaaatacaaaaaatgagctgggcgtggtggtgcacgcttgtaatcccagctactcgggaggctgaggcaggagaatcgcttgaacccgggaggcagagattgcagtgaaccgagatcacaccactgtactccagcttgggtgacagagcgagactccgtctcaaaaaaaaaaaaaaaaaattttactgcatcgatcctttcggtcatattttttctatccacagctattgagagcataattatcttaccgaaagagatctctgatgttaaaaggaattctcacagtggacagtcagggactgctggaactgagaacggaagggcatccttgcagaaagtggcgccccgctgaggctctcaaggctgtgccgtttctgccaataccgacttctccgaaggcaaagaggggtccttgtgaaacccagttgtgcttggtctatgctttctcttccccctttacgccaagcatcttgtggcactgcactggcacaggtttaaggccttctcttgggatgggaatgtaaagggtcctgaacatggacctttatacaaggttcttaaacccacccagatgcttatgggagcatctaaggtagaagggcgggcaagtttgctcaggggaggcagtaccttccagtccaagtccaagtttgccttagacagaacctgggaacaacatcgtggagaagggttgctagtgatacccaaacaaaagatggataagagagaggtatccagtagggcacttctgaaatttcaatgtgcacacattacctgggcaattttgtgaaaacagagatcctgatatgctaggtctgggtgggacctgatatttctgcctttctgacaagctctttggtgatgctgatgctggtccttggactactctgagggcagcaaggtgcagacactctgagctcaggtaagctgctcccagagagctggcctgactgatgggctgggcatggccacagagacggcaaacagggccaagcaccacttctcacagcacaacatgagctgaagcatggggatgtgcggggccctgaggggtaaggaggagccacagccagcacccggcctccctcagcaggaggccagcagagtgccagcagctgtgggcaaccttgcacagcccagagagcttttatttgaaaatgcaaagccctacttagatggtggatttatagctggctgaacatgcttaccctaaatggggcacctgctcactcatctctgcaggtcagcactgaggccagcacctgtgggcactggcaagtggctatgagcgggtaactctacctgtctggtaaggctgcctccgaggttcatggtgccagagccagatttgttggtctgcagccacagcatcaccgtggaggtcaacttgtaatgggcggtgcgaccgctggatttctcctggaaggacaagacagagatctgttgagctgagggagagcctgaagtggcccctggaattcagggtcatcctaacatctcccttcctaggtcattatcacaatattaccttttttttttttaaattggagacaaagtctcgctctgtcacccaggctggagtgcagtggtgcgatctcaagtcactgcagcctccacctcccaggttcaagcgattctcctgcctcagcctcccaagtagctgggattatgggcgcccgccaccacgcctggctaatgttttttgtgtttttggtagagatgcggtttcgccatattggccaggctggtcttgaactcctgacctccggtgatctgcccacctcagcctcccaaactgctgggattacaggcccgagccaccgtacctggcctcacaatattgtctttcttaaaaaatctcaactggtttttaaagggacatttgtaattatgtatttcttctgggaacttaatcatcaatgactactgcagacttatctttatccaaatggctttgaggcatttctcagaattaggggttcagagatcacagcatccccctactgcatctgttagagagcagcgcggcactggttggtgtgccatctgtacttagtggcccgggccaccagctgctgggaggcagtacctgcacttctaccacgtggatggaatcccagcagcctttgatcttctttgatccatctccagccttctttatgaggatcactccagcaaagccatgatccagatcccagaggtagacagatgagacgccaccttcaaaatacctgcaggaaacaggccaatgtgcctgttagatgctaaaggacagatcatcagcctgggtcccaggctgctgctcagcaaagattctgggattcagggccctccctgcgacagttatgggagccgatccttgggtgtgttctgatcgttctgtggctgggggagggggtgcagcattcctgggggtgtagtaggtttaggcgtcataaagatgaatctgaggttggactctgccacctcctctatctgtgtggtctttggcttactgaacctctctgggcgtcacactcctcccagataaagaatgcagcacgactgacatccagtgacaatccatgcaggccatgactactggagtcaccacggttgttcgatatttctgtcttttgggatattttacagggcagatgagaaaatacagcaacaaactccctacaccctgatccctcctgagcctggcagaccagggctccagttggtctttcggagcaacctcctacaaagcgctagccggaaatgaagggctcagcttgagacagtgcttcctcctcaaatccgacgcaatgcaaaaacatcttttctttttttctgtttttgagatgaagcctcaccatctcccaggctggagtgcagtggcaccatctcggctcactgcaacctccgcctcccaggttcaaacgattctcctgcctcaacctcctgagtagctgggatcacaggtgtgcaccactgcacttggctaatttctgtatttttagtagagatggggttttgccatgttggccaggctggtctcaaaaccctgacctcaagtgatccacccgcctcagcctcccaaagtgctgggattacaggcatgagccactgcgcctggcccagaaacatttctaattataatcaaatggaagagggatttctaattacgatcaaatggaagagggaacgaaaaggttagatgagaaatgggaatcagtctgggatcccaaacccaacagacccaggtcaactactgtggctcactgggactgccgtgagcagaggtgaggggtggagtcagctgatgggaaccgcaaatgctgttgataaccaacaaaaactatgcgaaatctcatttcttgtggcgaaagtctgtagcctctccgaccccaattaagccccaaagagagaaatctcatctctcgtggtgagcacatctttatcagaaagtctggggcctctctgacacctattaagccccaaagccacggtgtggcaggtgcattctgggagcaccctgccctcagccctggacagctgggaaggtgggccgcagagtgcactgggtgggtacaggcttgggagtcagacagacccaatgacagctctagcacgcccagctatgagttatgctcatgcatgcatgtgtccaacaactatttactaagggaccagcggtgtgaatatgggcctcagggacttaatctactttctacggctgttgagagacaaaaacaattaggaaaagtagacacctgccaaacggttaatgtaaaattaagtactagaaattaacatgtatctgtagattatgtctcaccaaagctattatataacaaaaaatacacatttacagaatgtgggtgatgggtatacaagaattctctgtactcttttttttttttttttttttttgcaattttacagtaagtcataccattccaaactaaaaagcttttgtgaaaaatcagtacacgaatacaccggagtgtaatgtaactaagagaccaccagaccaagaaagcaaggcatcctcccaggagaatgagggtgccctggctggtctgccctcactccaacccgcagacctgcggagcatccagggggccgatactcaggtgggctacccttggccccctgcccagggctccctcaggcaggctgcggccagcccctgcggcaggaccacatcctgtcccattcccctctccggcactacccactatgattaagctctcaaaccgagtacaccatggtgtgtccacgggtgagtctacaggagggcagatgagggcagggctgtctggctaaccaagtgtcactcagggaacacctgtcggatggaggtgtcaggtgtcagatgctgagcccatcgctggtcaaactgcgcagggtggggaagggtctggctctggccaggtgcagcacaggcatcctttcctacgagaggaaaaggaccactggatgaacagacacacctgtgaggcccagagctcactgctggcagaggtgatgtccaggaaaccggccaacactggcactcagagatcccactccagaagatcatttcctttattccggtctgctccaaagtccccattcttggggcgaggcgaggtaagcagatgagtgttttggtccagggcccaaaaccccatctgcctccatagagccctcctggtctggaccgggcccacacagagttggagagatcaggccattctgcaatgttcctggaacacctggagagggatggactgcccctgctggacctgagggttagcagggctcagatgactggcagcatgggctccgtgagcctttctggcttgttctcctggattcttgcaagttaacttacgaggcacatcaatactaccaacggaagagcaactcataacagacctgctaatacccttcctgttggcaacagatggcttggttctagcacaccgttttccctttcagtcggcttacagggagagcagccccacatcaaaagagggggaagaaaaacaaacaaaaaaaccctactttgctggcaaaaaggatgggccaataatccgttctttccttcagcccttctggaaagaaggcttgcagcccaggggcatttcatccttccactccttcacagatccatgcagagctgcggtgctgtgcctgcccaaggcttgctctcctctgtgtgctgggacactggggagatgcaggtcaggatgccctggaggggaaccaggagaaatcccgatggcctgacagcccttgtcgacaccctccggtgaccagttcaaaagcaccaggtggcccacggctgcttcccctcagtcccatccctgagcgtttcatttcttccagaaaaataaaacaaccgcattaaagttttatagggtggaactggccgtttccactccaatgtcccaccctgtggcctggctcccactacgggcagcttctccttggcgggccacggtgaccaggtctaaagtttcaaatgctggagccaggggaggtaaaaatgcaagctcaattgtcactccttgtggggttactattcttttacccacaattttaaaacttactgcaggaacattattgttttttaaaaaaggaaatctgaaaattagcccacaatgccataaatcaacttatcccataaatctgatttttccaaattcccttccagtccagatgcatgacttttatataactgtaagcacagcaagagtaccatgctgaatttggctttttacacttggcacagaatcattagcatttttccatggagccgcatgatctccataatcatttttaacagcaaggatagtattcagtcgggtagtatcctaatttaccatcaatctgacttttaataaagaaacaacggcgacagagttagaggcggcgtggtcaatctctcacttcgaatctgttccctctctgaatcggggtgttccaactgaggtgagtcagacgtgctgagacctggcctctgcaggtacagctcaaacactacaataattcaagaatggacttgcattccattcaccaaaagggatctccagggactggagcagccacaagtctcaacctgacattccgagacaaagggagcagaggactgcatggttagaaaggcctgtttcagaattgcccagaagcaccagcctctcctgcgagtgccatcagggcgctccggcaccttcaggagggaggtgactgcagggcgcacagacagcgcccccgctacatggtttatggctttgctctgcgcgtgaagcattaattaaagggggaccacaacacgtttttgaaaatttatttcttacctactgtactttgatcataatgatatgaaacaaggaaaaaataatttttatgtggtttgcatttatgagtttttacataaaggcttttgtgggtattttaagaatgtgctaaaacgttgtctgaaaccacataaagccatctgaggagtcgcccgccagaattaacagcacatacatggaagcagtttaactggtctttgtatatttaatgagtcaaatagtattaatattgtttaaatgctaacatgctatttcaataaggtggctctaccatcgccagcgactcactctcaggccttgtacttccatgtgagtgaatgatcaaatgtggccaagcgctgagagcaggctgcagaggaattaatccgccctgccctggcccctgcccatgcctgataatttcaaaatctcccaactctgcagggagggaggaatgggcccaggactcactaccacagctcagctgatttgggctcaagaggaaaatcccagagagtccctgcagtgaggtctctggtcaaggaggtagaagggggaaatttttattatatttttttgagacagagtctctctgtcgcccaggctggagtgctttattttatttttttgagacagagtctcgctctgtcgcccaggctggagtgcagtggcatgacctcagctcactgcgacctccacttcccgggttcaagtgattctcctgcttcagcttcccaagtagctgggattccaggggtctgccaacatgcctggataattattgtatttttagtagagactgggtctcaccatgttgcccaggctggtctctaactcctggcctcggtctccactcagtgttgggattacaggcgtgagccaccacgtctggtcaagaacctcttttaaacatgcaggcctaggaccaggcgcagtggctcacacctgtaatcctagcactttgggaggctgaggtgggaggactgcttgagcccaggagttcgaggccagcctctataaaaaaaagaaaaaagaaagaaaaaaaaaaccgtggaggcccaaagagaaatgcatgagcttttcctaggcttctttcctaaatggaaagccagacagcacgggcagcacagggctgaaatcaatccccacagtcaagaggctgaatgacatgctcaaatcagagctccccagtggccaggacaacacagggactagcttgcaaagactgcagagaagtcaacttggacaagtgttgaaccatgaagtgggggggcctcagaagctccaggaagatgaggagggggtgaaatgacagaccaacttgggaatgactgggagcaaagtgctggagtcacctgtttgcttgcgtccactgaagagctaactctttcaactgagtgccatcagttttaccaacggtcccggcgccttttaagactttcctaacacagattaacatcttgttttgttttttgagacagggtcttgctttgatgcccaggctggagtgtggtggtgcgatcaccgctcactgcagcctcgacttcctgggttcaagtgatcctccttccccagcctcccaagcagctgggaccacaggcatgcaccaccatgcatggctaattaaaaaaaaaatttttttttttttttttttagagacagggtcttgctatgttgcccaggctggtctcaagccgtttatcagcacagccaattacaattaaacatctggttgggtttttgtctatcgtcaccttggtccctaaacgtggatcagctaaaagcctaatgtgtcagtaattctcttcttctcagagttttaggtcgtttctccctgaaaatcactcttccagttgaataatgtcatagtcacggatatagattctatgtccgtaacttttcaaccacaggacttctggggggaaggagaaaaaagggaaaacataatacttcacactcaaaatgacctaattcacaaaagtaaaaagaaaagaaaatgtttcagctccaaaagctttatggagtgtctgaagctgaggtgtgcgtggggtggaaacgtgctcggggaatctgagctgtaactatgaatgacccaattcccaggcctggccaacacggggctgcaaatctaacagggaaaacgggaggggaagaaggggctttgaagctgctctttactccttcctttcacatcacctcctgggagaagagctggattcgtggctcgaatacaaaggctcccaacagataatgagtacatgccacatgccacaagaaccaaggccaggacagacctgctgggagcagggctttccagcatgagccaagaaacagactctgtggttctagggttcactgagacatgtccttctggctattagtgggctgggccacactcacaggacttggacctctggcctgagatacctgtgacgctgaggcacaggcagcagccaagttaggggcattattaaggtgagctccataggtgctggaacagggctttctcttgcagtcaacttcactgaataaagccaagggaaaggcaatatttggcaccaacacagtgcaaaagacttttttcttatttgtaaaatcaaagagctggatcagaggccagcgtagagggtcctcccagttctgacattccaggatttggtggttgcatcagggcctgtatgaggcagactgagcaccacagggcaggttcctaacatcttagtctctgtcaaactgctgcttacacacctccagtgacagtgaactcattacattcctgaggcaaacatttctgttctgaacaactgagacagttctctctggacttgagtgaagacttctcactactgccttccagaatcacaaaaaaacaaggacttcatgccctttccttgcatagtcctttcaaacatttaaaactggcttacaccaagatttctcttttctggccttctcctccttgtaattcctcatacgactcaataccttgtttatccttctgaacatactccagcttgtcaatgtccttcataaaagaacagaaaacaatgccccaactaagtgttaaccaatgcatagcagggaccagcacatctcttggcaaacaggctactcctccctccagcactcaagaccaaattagctttcattagcaatcacacctaatccatgctacacatactgaacttgcagtcatctcaaatggagtattttttctttttttttttctctctttttttgagacagggtctcgttctcttgcccaggttggagtgcaatggcatgaccatggctcattgcagcctcgacattctgggctcaagtgatcctcccacctcagcctcctgagtagctgggactacaggtgcatgccaccacacctgggtaattttaaatttttttgtagagacagggtctcgctatgctcaggcaggtcttgaactcctgggctcaagtaatcttcccacctcggcctcccaaagtgctgggattataggcataagtcaccgtgtacagctgaatattttttcttatgtgttgccatgaaaatacctctcacatcctggacttgagaacttggtagactggacccaagaatatcactttccactcaaatctgtgacagatcactctcgtagacatggcttcaacatttcaacgtctcttttgggatcccgaagctgttgtgatctgtattctatccaagccactcttcccccgaagtctttatgcacaggaatatacgtgaaagcaggagactgtgcaaatgaggatgtcactgagttccagatcgcgtggatttccagaaagagcacgggcagccctagtgaaggcttctgtggagaaactgatggtccaccaggaaggagggctctggtctgggcacttttttcatgttggagtcagtataaagatggaaaccaggccgggcatggtggctcacgcctgtaatcccagcatttagggaggccgagacgggcagatcacctgaggtcaggagttcgagaccagcctgacccacatggagaagccccgtctctattaaaaaaacacacaaaattagtcgggcgtggtggtgcatgcctgtaatcccagcgacttgggaggctgaggcaggagaatcgcttgaacccgggaggcagaggttgcggtgagccgagatcatgccattgcactccagcctgagtaacaagagtgaaactccgtctcaaaaagaaaaaaagaaaaagaaaagatggaaacgcccacagccttgatgaggcagaagtagaagggaacacaggaggtggggctggctggaatgccggctgaagagctcaggctaaaaaatttgaagtgttgatgtaactgaaaaaagcagaattcctctatgatctggtgctaagctaggaacctgggccctcaaacagctccaacatgtaagattccacgagtctttcttctcctaccctatgttctcccgtcacatgtatggtgtgttctgcttctgggatctcaccaaggagtagcagcaagacttgggacaaataagtggtcttaggtcaggcatggtggctcacgcctataatcccagcactttgggaggccaaggtggggggatcacttgactccaggagttcaagaccagcctgggcaacatagtgagaccgtgtcttaaaatatatatatatatatatatatatataaataaaataaatggtcatgagggacactttttgctgtactggtgcttggtcatgacaaagacaaggtcatacaggcatgagttcaaacaaactcctggccgggtgcggtggctcatgcctataatcccggcactttgggaagccgaggccggcagatcacctgaggtcaggagttcgaaaccagcctggccagcatggtgaatcccatttctactaaaaatacaaaaattagccaggcatggtggcaggtgcttgtaatcccagttactcaggaggctgagacaggagaattgcttgaacccgggaggcagaggttatagtgccttgagatggcgccactgcactccagcctgagcaaaaagagcgagactccatctcaaaagaaacaacaacaacaaacaaacagaaactcccaagctccatgactgattttatggcaaagaggaagagaataaaacccagaggcagagccattccccggcagctgaggttctggccctaaaacaatgcctttttgttccctcctagggtaaaaaagaaactaaaatccccagctatcagcagtagtttgtttttctgatcatccttaacatccttacaacaaaacaggcacctggtcttcacaggtgggaacaatccaactccacctcaggaaaaagagaaaactgtccattctgctcagaggggcatccaaaacctggctcccttcctcgtggtgtagaccaacgttcctttttgctctgctggctgccatctagccaacttcaaaaagaagctgagcgcatcccctgtccaatggatgggcgtgggtgctgcccagtgggcacaatgttgcaaagtccagagagctgcagacggcacacgaggggctggagagtgtgggttctcttccttacactggttataccagcctgcactcaagatgcatctggcaaacaagcatgaggagatataaggaagatcacaagaaaaaaatgaacgggcaagcacttgccatggcacctggcagagcaagcactcaacaagtggtggctgctggttttcatcaggctcttactttctgaacagaggggaggagaaggcaacctcgacgtgttgtgagctgccctggaagtgtccgtcagaaacacaaagtgccgcttactgggagcggttccgtacccactggcacaggctccacacaaaatggagaaagatcaatgcttggctttgggcgggccatgtccagagctgatgctgaaactcaaccacccttgtttgtgtgttgagaccagctgttttcaccatggtttagggaacacggcccagaggctgcccatggacacgggacaggtattcagcggaaattccttccagtacacacaggtgcaacaatcccccgagtcaacataccaatcagcttaggcatgtgcgactttaatgccagctgcacttagaaggcacatctggactgtggctgccgcgctttagtgtctcgcttttacgaggcttttatttttttacttaaagaaataatgaaggcctctctggaaacaatggtgccgctgcaggggccggctatctggctctgggatctggttttgggatctggccaaactgtccacacttggcaccactgcgactgtcttctgccctctggactacttgtgaaaacactgctggccccatggagctacctcatgagccgtcaacagtcagggctttctgggcttccaagtcatcactctcatccaaagctgccattgttgagaactcattctgtgtcaggggctttgcatatcttttttttacagttaagaaaactgtaacccagagagataaggaacgtgcccaagtcacaggctgagaagcagggatctgggagtagatgtcaggcttggctggccccagtgcccatattctgccccatgccaggctgcctggccatcctgagacgtgccagctgtggtgggatggagcgcaggcggacagaacagggtcagccagtaggttagatgcccgtatgaagccacaccactgaacacacagctgccccaaagaggagaaagtcaggccaagtgcagtggctcatgcctgtaatccccagcactttgggaggccaagatgggaggatcacttgaggccaggagtttgagaccagcctgggcaacagagtgagagcccccgtctccattttttttcttggaaaaaaaaaaaaaaaaaaacggtggagagagtccgagttaaaaaaggaacccgctgggtgaccaggaatccgggacatgccccgagcaccctgtactggggattttggagggttctctgcctcactgaggcagctggggctgctggctgggtcactgcaagaatgccttttttttttttttttttaattagacatggggtctctctctgtcacccaggcagaagtgtggtggtgggaccatagttcactgcagcctccaccttctgggctcaagtgatgctcccacctcagcccccagacactgagattacaggtgtgagccactgtgccccaccgcacctattcttgatacttgcacaaagcagttttccatcacagaagcctcggaaacatctcagtgaggggagtgcagggtctctggcaggatgggggagcttgaccaagggagggagctggtccctgcttccagcagcagagtttcactccaacatgtgcaacggcccaaaccaaagagtgactgtgtgccatctggttagaggaacccaagaattctagaggcatcagagtccctgatgctgacgtggggatcatgttcataagcaaacttgttttctgcacactcctgttttccatttaactttctttcagcagatgaaaatcagactgcacatgccaagcaaccagacactggcctgcagccttgggatgccagatgaaagggaaccccaggacagggggcaacatgcaagcctgtctagatccactctttagggacttgataactgtagcagacacccccactaggagcagtggtcacgaaagagctgaaacgcactgcgagagcaggaagcaggctcagctgtacccctccaaagctgtgaggtttctccagacctttctctctgctctgtgaaaacaacacaatagaggtgggcttgggtttccccattaagtgcttctggcactttctcacaagccccaggcagtggcaagccggtgtcccacagcaggcagggcgggttctcagaggccctgtgcgcacatggctgaagacacaaacatgttcaaacccaagtgctaattacactgtggacatgccagaagccagagacggcctggctccaccctgctgtcccgagtgcaagatgagtggcaagcggtgcccgtcacgggatccctctggaggcctttacatctggggaaaggtcctacctctaggcaaggaaatgagaacacagacctcgctgaagggacagggagtgaagggggatgtccccaaccaaaccgtccctgcagctccaggatgttcttaagcattctccgttactccccttactctgcccacctcccagtggggctctgagtccgcaggcctggccgtttccagcggtggaaaaagcccccggggcacctggaactgcagagttcactcagccagagcaaaggaagcagccctccactctagctgagctgtcaggcccttcctgctcctggcctctccaatccagcctccacactacttccgaggaacttctttggatgcacatcagagctgtcctacccttggaaccttccagacctttcccaaggctcccagaatgacacccagagcccgcaccccacaggcctgtgcgcctctccccactgccctgtcctgttccggcctccactcactgcccacgaccactgggaatcccttcagggcgtggcccaggcggttcccactgctcagggcactgtccttgtcctctcccatcacagtacagggctgtgcccgggatccccagaccacccgaggctccataattcgctacaaggactcacggaatgtggcacaaagttgccctcggggccaagggttattgaagggaacagagcaaaggaggctgagggagaaggcgctggggctggggtcctgagaaaccaggcaccagctttcaacgtcctgctccatgacgtcacacaggacgtgatacactcccccagggatgggcttgacggcatgtgtgaagtactgtctactggtgaagcaagccagggactcagtgcccagggctgtactactaagcaccctctacctagcacatggtgaaatttcagatgcccacaaggaaaggagaaggaaggccacactgtttgcacacagttcagacgtcggaagtcactcttatcagggagtggtaagagccctcctgaaacccaagttcccagctgccagccgcgggccaagctggcaagcatgcctccgagggacagcagtctcaggccagctctgttagccctttccactcaagggcaacccccctgtaaccgacccacagttccttcctcagagccttccctaacatccacaccctttgctcttccccaccgcaggacccagctctcattcctttgcagcgtttatcaaactgtgcaagtactgtgttcatctgctgacttgttcctgtgttgaaacatgggccccatgagggagggactgggcctgacacatttgccactgaccctgggcacatgacaccatccccggcaggttctcattaaggacctggtgaccgatcccaaggattctctctccagtcactgcagacgggcactaccagcatctctgttcagcctcactacaccctgatgatgtggattgagcaggaatcattaattccatttttgagacagagatttcctggaggccttgctgtgggaggtggtggaagagccccatcccgaaactacggccttctcgcatgatcacgaagcctgctaccccatcaggtccgccacccaaatggtcccgtatctgtgatcataaacgcacagaatgtaagatgcaggtacagaatgtaagatgcacgtacagatacctgctgcacaattagaagagccctgtcacccagcagcctggaaggtgctggctggacgcaaggcgtgagtgcagcaggggtctgacgcacagtgtgtcactgagtgacgcctcagcccacagcatgggtaaggaaacggaggctcagagaggttaactcactcgcccagtcagtcagcaagaaaagacaaagagagaatccagtccaaagctctttaaagccaaggtcctctccattccgtggctgggcctcagacgccatgggtgagggtcagaggcttttggtgggaggtggtggtgccttctgcctgggaagccccccagcacctcagctgcccgctcacacttctgcactctttccctggaaaatctccccctaccgcctgcagttcctccacactcacgtcccgaggaaggggtgccctgaggggtctggggctgggaacctgcagtttcaaggaccccggaaatcaggtgcaaacatttctcacatgtgaacatggacatcctgcccttcctgggccaatgttcctcaaacatcaaatggcgggaaggagcaggaacaactgcagttctgaaatggcccagagaggggacaggtgctggggagcccaggccggggggtggggcccatccacccagctcctggctgctccactcctggagaggcccttgggccctgggactgccatgaggacgccagccttgtttcactctataaacttcttccagacaaggagggctgattggaaaagctaattaaagcttttgaagattatctcagaactgaagcaaggaagaacacaaaataccctcccaccctgctcctccactccccagactctggccttcattaggctttgatttcaatcaattgcacacccactaaaattaacttataaggccaataaattgcaaccgcatgtttgaaggtattatctgctccaagccaagagccaaggacttcagagcattgggcgagatgtctggcgcagatgggagtaatcatctttggaagaaggcagtgccagccctttggtcagaacatctggtcccaggcagaacccggggccgacacaggccagggccagacttgatgtgaaagctggagcagggaaggtttcctatcttctccaggaacctgaaaaatcaaagtgttaatcttggggttcatggcagcccactggtcgctcacaccagcaagatgttcctctgacagctgctggtgcctgacctacagcaaagtctccacttctaagtctctcccaagaaagatcacttaggtcaaaagatgaggttttgtgactgatgagctagcctaggcttggacctaagaaagcagagtcggctctgctgagaaagagtgtcaaatgatcctccgagccagctgcccaggagtcggcccgctcggctgtcttcccctctgcctcagtgctcagttctcgtgacatcccctggatgagtcaggcccatcaattacaggcagaaaaccatcttggggcttggtagagagaatagcctagatgttggggaccaggtgggtgggctggctgggaggggaagtgatgaaaatgaaggtgacttgcgagcagataataccctcacctggccccagcacaccagcaaaatgtgcttgtcatctcctaagcatttgcgcaaactggctcttttcatctaaaaacaaggctgtttgggtagtgacagttactctcctagggaaagtactactatgatctctttctgcccctgaggatggcagagaagggaatcatcagcatggaagggacctggacgtgagaatgccgcagggacccagcagaggcagggcaagccaggagctagtggacttcagagggagccgtgaggacacacggctcagccccctgcacccctactcgccttttgcccaccttaaggagtcacgctcccaactgctagccctttcaatccacaggggagaggggctgccacatctccaaggagttacaagccagaaaggcctgctggtcaacccgtcccctggcccagctccatcattctgacattgattccatgtgcttatgattaaatccaactccctacaaagtcagagcctttacagagccagggatcaaagcccagagcctgaagacagaatctacgtctttccctcaggatccagtgaagaagatttttctctccggtggcagagggagcctctggggagacggtaagttctgctatctgaggaggctggtgtggcccgtgggctgcctggatcatgctctaggtctctggaccctcaagcctatctctttaccaatgtctcctttcacatattttttattttttagttttcttttttttttttccagagacaaggactcactctgtcacccaggctgagtgtatgatggcatgactatagctcactgtaaccttgaactcctgggctcaagcaatcctcctacctcagctgagtagctaggcctatgtgtgtgtgtgcctctatgcctgactaatgtttatattttattttttggaggtacagggtcttgctatgtcgcccaggctggtctcgagctcccggcctcaagcaatcctcctgcctcagcctcccaaagcaccactaatcttttcaagcagggcctcaaggagtaaggacaaagctaatgggttaatgggtggggggcaggcacctcgttcctgactgtggcacacacacggccagtgcctgtgggtgctacgtcagccgacaacaaacatgcccacagacagcaagtccagtcttctggcatgagccagcagggtacggcgggggcaggaacaggggcaagacagggtatccaaggcctctttattccttttcttgggtcaaatctctgtgtgagcaaagtccagtgtgaccttctcagcataaagagactttttaggccataaaacaagcggctccctggaggctggctgcagcacagtgtccccacgggaggattctgagctccaacgtggcaggagcctggcagctctcagtcattcgatggggttggtggtcatgaggctggagctcaagccaaacatagtcctgattgcgattcatcaggatccaacaattcagaagcacctggaatcgtgaattaaagaccctgtcaacacagtctgctcttccaacccccaaccaccaggggcgcaggccaagctctagcttgaagtgtgtggtctgaaagtggcagctgcacctgtgcagccctcctgggcacaagggcgagcccagcctgctctcaaggggtggcttctccggccactccccttttctcctggcagggtgggtctggctgaggctctggccatctctcacaggccggggacaccagccactttcctggcccctcaggcagcagctcagggtgaccaagccagcagacgggagcattgggtggaggtctcctctcagaatgacccttgcctgaacccatctgccaacctgaacagaagataggtgggagagctgtggccttgctcaggggacaacaaacaagtctttctgtgagaaagtgtttgtatggggaagggctagataaaagatgaagagaaagggatggcctactgcctctccaccccatggaacagcctggtccctagaaaaccgagtgtgaccctggccaatgcccctcaggagacaaggccacccagctgactcccctctgctccaaagccacggggaaaagagcttgcattccagggcctgctgtggtcacttatgtggccaccaacagcctcgcggggcactctgggaatgggaacttctggagatgagcaatgtaccacaatgtaccaagatgtttttaaaaaagaaaaaaaagagacttgttctcataatttttagactataaatgggttggttcgtcacatgtggttcagctgggaaaacgttcctcgcatgtggtcccaggagagagagctcttcagcacactccgatggcactgggtgagtcaaaattcatgcctctggtatcccggatggcagctccaactgctgtccctttggtggtctgcggtccctgtcacccaggaagagcctggccccactgcccctgcacatgcaaggtaaggaagggcctcctgcctctcctgcggggccactctcctccttcctcccgaggtgctgggaacagaacggcaccagcctggatcccactacacactgttgcagaccctcggggtctgggttatccagttcgacccccaactgggggcaggatgctgtcgtcacccctctttcaactcccccgagtcagtttaccttcagagaggagtgtgtaggcaagtcaaaggcacacagaaatcaaaagccaccttacaaatacacatttcccagggaagggaaaggcttcaccagaggcagcgtgaagagtgaggccttagctatgactcccggctcctgtggttttctagctgtgttaaccagcttgagtacttatctgagcctcagcttcatcagctgccaaatggaataactcccacttgtcctatagtcactgtaaggattcagtgattattctgaagagttttaatgatagtagggaaattctcatgataacaggccataaaagcccctgcagaaccatacaccatgtatcattacatatgtgaacgatgagatgggaagggagaacaagggaagcagaagtccaagatgaaactgggctcttccccaaggctggccctaaatggcgaagtaaggcaacacatctgattcactttattaagggagtaacaacatgaacacttaagtctcataaagaatcagaatcacccccacctccatatctcaacatgcagcccagtaataagccagagtacagcctcctcatagaacagaaggggtgaggccaggcaacttcctcaggcttaggggatgacacgcatggcacgttagctccccaagctgggggaaaatctagcaaacactttcaagggggaactttccacttccaccttcaaacttagctgaaagggcaggctgtattcctggagtatcctgagatggctcccaagaagcttacatataaaaggggccaattttgcccaaatctctttcaaattgacttccaatttaaaagaggctgagggtgtgcacttgctggttgacagctgtgtgtgcacattaaggggcaccagtctcagggccttagacaggtgagtttgcccctgcctcagagaccctggcacaaccagcccccctgcctggctggcttcctcaatgtcagacctcagtcaagtgtctcctcaagaggcctcatgggccactctacataacaagtcagctgctccctgttatcactagcagcaatgacttgttcactggtccactgtttgtttttccacaatggagtgtggtgagggcaggggcctcatctaccacgtacgaggtgcatccctggtactcagcaagcacccggctcatgggaggcactcaaatgtctgctgagtaaataaatcgatgttggactctggagctgggtaaggatggtttgatatcccagttccaccacttactagctctgtgaacctgggtaagttatatcacctttctgatctgtcagctcgtttgtaagagggggataaccctctctcatgggttcttgtgaagaccgaatgagacagagaatacctggaggcccacttgcatggccactggtaactgttatcatcaccatcgttattttattaccagtattatcactttaatattaaaccaattctacttgggcattcttgtttaatagctggattggcttcttaccaaatgggcaggtaaaagaagatagtaaaaaacaattacaagtaaactaccatagagcaatgagtcagcttttcagtatcactggggaaggaactattctacaataggacaaagttctagatgtaagaacctttaaaagactgaagcctattttaactgtgaaaatcaacaatttgtgggaatttcagataaatatgggttcaaattctagcttttcacctccatgtcctgtggtcttgtgtgagtcatttaacctcttggaaccttggtctcatttgtaaaaggaggaacaaaaccatcttccccagaggttcttgttaaggagtaaagataatgtatataaaatattcgtatataatagaactacagactgggggccaagccccacccacctcaaagctcaagaggtgaattttacattttaaaggttcaacagaaaacaaaccaagaagcagcaacagagaccttatgtggcctgcaaagcctaaaacgtttaggatctggttcttgacagaaaaaagtctgccaacttgaattagtattgcctattttacagttttgctgtattttcagtatagagcttaattataaatgagattctgttgattatggctaactttctctggagcccttccttgtaagcctgaacaattaagtgacatgttggtgctgtggtgctgggaggcaggattagacggagcaggaagaaatctcaacagatctagcaaaacgctttttaaggaaggtgccgaggccacaaacaactcaggattcaggaagatgtttgctgctctgctcctgctctgtaaggactgcacttatcttggcctgagagcagctggaggcagaggcccctgagctccaggtcagaagtgagcgtgtggtatggcaaaaaaatccatacgggcctttggagataaacaggtctgactttaattcctggctctaccccttgctgtggacaaatactttaatctgtgtcttaatttcttaatctgagaaacgaggactaaactagctatgtttgtgaggatttgagatgctatgtagaaatacctggcactgtttcttatacacagtaggcactgtaccagtggcacctgctgttattatgaatcacgatgcaggggaacagcacatagtgaagtctggtagcattctatgaccgagtcatctcataaccaacccaaccaccaaacgagtgccctgcatcctgctatgggaggctcccaattttagttaggtgagccaggtaacagattcaagggagaatgcttggccgggtaacagattcaagggagaatgcttggccaggtaacagattccagatagaacactgccacttaggatttacctctcaaaactcacaagcgctaaagtgcaacaggagaaaatgactcacaggtctcgatactggtcaaaggcattgttggcttccacctccagctttctcagccgagctgacggcatggccccatcctccaagggagggtcatacttgttactccatggtgacctggagggaaggaaggaaaagtatataccatgaatcgttccatgaagacacggccagcgagcagggagcctgagccctggctatctgaaatctcggaggcaaagccgctaactccagcaaagatttttctgggtcctggcaacaaacagggctttctggaggtttggagaacaagggctctgatgcgggcagactggggcacacgcccgtgctccacctctcactggctgtgaatgctcagcaagtgtcccaactccctgagcctcacttttctcctgcgtaaaatgcggctgctacttgctccgcacacagggtcgtcatgagaaatgagacaagcagatcaagcgcccagcccagagcttgccagactgtcagtgttcaacaaatgctagttctttcttacccgctttctcagttttgtgttcaccacctatttttttttctttcttttttttttttttttaagacagagtctagctctgtcgcccaggctggagtgcagtggcgtgatcttggctcaccacaacctccgcctcctgggttcaggcgattctcgtgcctcagcctcctgagtagctggaattgcaggtgcaagccaccaggcccagctaatttttgtatttttagtagaggcggagtttggccgtgtcggccaggctggtctcaaactcctggcctcaagtaatctccctgcctcagcctcccaaagtgctgggattataggtgtgagccaccgcgcctggccatgtgttcaccaccttatagttcaacagatgcccctctctcctccctgatttgctggaggctctacataaactttaagaccttcttacatagtaagcgttaagaagagagctgtcagttacagaggcgggcaagagatacagctccacagggaaatgctgattacattagaaaacctgagcaatcaggttctccacgtgaacacaggatagcttttccaacatccaagagctatgcacacatatgaagactgctaagtaatgagaaccagtctttttgcagcccaaaagacttgctgtatttcttgaaatgtattttgccacatcaggaaagcatttaatcacactgagaactggaaagggggttataagggaaagatctactcattaattcctgcaggtggggttcagagggccgagtgttcagagaaagtagcagaattaaaaaggtgagagaggaatgaaaagacagagaagacaacatggaattcagaaaaagtccttcacactcttggtctaaacgcctcgctgtttccactgtcagagacccacaatgccttttccgcatcccctcctgaccacatcattgtgatgtggaatgcatgttaaggaaaaaaaaagtatgctcatcatcttccaaaccccagttttaaagaattctgcacgcagacatctttcttcttggtaagtgatgctccaccaggcacctacgtcagtagatcatggagtatggaaccagaataagctgggcggcctcttccaccagccacccgcaggcagctttctcagaggctggttcacaaacggtatgtaggggaagagttgctgtgcttggtgtccccaaagagtctccaggcaggaattacactcctgatcacctcaaagcagaaggagccttggaaatccttgtttccaagctgaccactttctgctgctcaccgcagttttggtagagactttgcaagaatggggtgagacaccccctgctgccccatgagcagcagccagctttcatggtcacactgggccatcgcacaccatgggaagcaaactgtcaacaagctgggaccccagatggctgggaagacaggcgtgccgcccacaatcgatgcctcagttctcctgagaagccaagcgcgggctgacctgtcagttcttgtagcctgtcgctcctccctctgaaacggggctgcccaacagaacttcctgagacgatggagatgttctaaatctgtgctgtccaaaacaagtcactagccatgtgtagctacttgcatacttacaatgtgaccggtatgaccaagagactcaattcttaattttatttaatgggaatcaatttgaatgcagatagctcactctagaacctcagctaggaggcggcaagagccttttctgtcatcttctcttcgggttgctcagcacctagaacagtgcctggcactcaactacacgctcattaaaaaaaaaaatgtttttaagaatgaatttggccaggcgcggtagctcacacctgcaatcccagcaccttgggaggccgaggcgggaggatcacaaggtcaggagtttgagacaagcctggccaacatggtgaaaccccatctctactaaacatacaaaaaattagctgggtgtggtggcatgcacctgtaatcccagctactcaggaggctgaggcaggagaatcacttgaacccagaaggcggaggctgcagtgagctgagatcgcgccactgcactccagcctgggtgacagagcaagactccatctcggggaaacaaacaaaaaaaaatgaatgaattcttcttgtccaatcacagttgtaaataaataaaataaaaaagcatgaattcttgcacccccgcccccccaccacaacagaaccaaccactccctcctccctctcacacagatgttgatcctcatgcctgtcatatccttgcccttcttccctcaccctcgactgcaagaggtctttgacagcagagagcctgtgctgcctgcccttgtccccagtacccagccctgagttagtgccaagcagatgctgctggtggaccgaagcctcacagcccgggagaggaagaaaggggaattctgctggtgttccacttctccaaaccaagagatggagcagctttctggctttttcatgctggtcacgggcatggcgcccaggtgctgtccttcttgggagcatcttgctctgtcgcccaggctggagtgcagtgatgtgaacatggtccactgtacaggaccataggcatgtaccaccatgcccagctaattttttttttttttttttttttttttgagacagagtctcactctgttgcccaggttggagtgcagtggcatgatctcagctcactgcaacctgtgtctcctgggttcaagcagattctcctgcctcagcctcacctaagcactaaaaaacaaaaacaccaaatcaacaaaagcctctcatcagatctcagagacaaagatccaggtgaaaagatgctgtcgccatgatttatctataaacaaggcttggttcttctgctggccgggggagtggataagaatctgagggtgtggagctgaattccctccttcccctgggtggccctttgagactctgcagcacactcatacgcaggaccgttcccacagttcgatgacagccatcgccttcctgtaggctgggaagacccgacccaagtggcgttcatttcaaggcaccctgattagacacaagagcccatctttcgggcagactgggggcctgcaatttgcaagaagcctgtaactcacatttctactggctcacagacgatagcatttcaagctgttagtcctgaagccagggtaattgtagctgagggaaatatcataacattaaccagaatattcttagtggaaggggcactcagaacacacttaagagcttaaatggaggccatttgaaaaaagacagatggacaggaatgcctagatttcaaaagtcaggactttcatttccctccgagaaggctttttgtttcagctaacaggtttcaaacggtgctgctggcaacggtcacaccataaggatcttatttaagcaaaccatcaaacacagtcaggatggaaatctgtggacagaatcagaagaccttgaagtttcatatcgagaagaggagaaagaaagacatactttctgcctccacaccccaggctcctctctaaaggcctgagatcccccagagctggtggtagggcctcaggaatgcaggtgggggacaaaggggtgacctggaagggctgcaggtaccaagtctcccgcagagcctggcctagccacggacctagacatgatcccgtccttccaccagctcctgcagaacagctgccttacacagtcaactggagtttttaggtggaaataataaatataataatgatgttgattaagcaagaccagttcaaggaacacctcctccaggaagcgttccctgaactgcatgccgggcgagaatacttctccctgcctgctccctggtctgtcagaccactcaccatcttcactggacttctctctctaagggctggtccacccacttcatcagtggctccctggctgggcaatgtggctcacacctgtaatcctagcaatttgggaagctgaagtgggaggactgcttgaacctaggagttcgaggccagcctgggcaacaaaatgaggcccccatctctacaaaaaaaaaaaaaaaaggagagagaaaaagtcaaaaaaattagctggggctgggcgcagtggctcatgcctataatcctgacattttgggaagccaaggcaggaggatcatttgaggtcaggagttcaagaccagcctggccaacgtggtgaaaccctgtctgcactgaaaatacaaagactagctgggagcgatggcgtacacccgtaatcccagctacttgggaggctgaggcaggagaatctgcttgaacccaggagacagaggttgcagtgagctgagatcgtgccactgcactccaacctggacaacagagtgagactctgtctcaaaaaaaaaaaaaaaaaaaattagctgggcatggtgatacatgcctatggtcttgtgcagggggccatgttcgcatcactgcactacagcctgggcgacagagcaagatgctcccaaggacagcacctggacgccatgctgtgaccagcagttccaggcacagaatgagcccttcaaggatgaatttgatcggcctcagggctgtatcaccatctatatgctgggacatctgcagccacatccccagcctaaacctctctcctggaactccacatggtacatccacagcctacctggtatctccactttgatctaatgggcctctcaagcttaaagtgtccctatgcctgctcctccccgagtcctcctcacctcaatcaacagtggctcaggtccgaagccttgtaatcacccttcacaccccacctcctcttcttccatccccacctacctgcagaggccgctggctctacttttaaaagtgacctcaaatctcaccacttctcaccatttcaactctagtctgtggtctgaaggagggcaaaatataatctctacctaatttccatttaaagccaggaaagggacatgattataaaactgttgtctagtctcttataagtcagtattaaactttttaagtatatgacaatgtctgtgccattcaacatttcacgtgtgttacttcttttatccccccaataaataaccctgtgctaacttttattaccctcagcctggccttcaagaccctgccagacctgccctggccatgcctcctccctcatctccgcccccactgccctcccctcactgccttctccacctctggccttctgccagctccatcctggtgagctcatcacccagggcctcagcacccagcaggctcttccccagacctggaccttttcatcctccagttcccacttgtgggagagccttccctgcctgcccgtcctctccctccctcccactgtcctctttattttcttcaggaagcattctgttgagtaaagaaacactactatttccgttttacagatgacaaaactaaaagaccagcgacaataagtgatttgtcaaagtcccattgacacagggagctgtgctggtttgaagcccacactggctgactcctgatcatttttcctgctttgacttcccagaagccttgccccatctccaaagagagcatcagggtgaagcttcaagacaaccctggttctgtggtctccaaataaacctaaagcaggctgtgttcctctaccattctccaaggcagtgactactgcaattcatcatggaaacactgggccagtttaaggattcccactcttaaaaaatagaggtataactcctacatgcccttaaaacccagctcagacatcacctccttcaggaagtcctcctggagttgaccatggcctcttctgtgctaccgtcccaccctgaacagactttgcactggctgtatgaatcacatcatacagttaccagttacccaatgtgtctcctatgctagacctggtgatcagacacccagggcagggactaatgtcaacttagttatttacagccttgggcgaggtgacggaaagagagaggagagttgtgtatctgacagagctgcgttcgtagatcccttaccacagagaccctcccagccctcaggatccccatcatatgcgcaccctgtacactgccctccgcaggactgaatgcaattataatagaacagttgtttttgaacaacatccctctcccgttagactggaagatccatgaaggcagggggcctttggtccgctgctctatctctcatgcttgtgggtggcactcttcaaacgtctgctgcatgattggaataacagatggaacgatgagaagaatggggaggacaagagaagaaaggagaggagggcagggaacaaacggaaggaaagctgaatgggctgccagctgcccaagtccaaggtccccgtgctctgcagcaggtacctacggcagcccgcgtgtgcctgctgtgcctgctgcatccccggggcatgagctcacctataggagtccccatctctgttgtagtcacacaaaaggtaatcctttcccaccaccttgtctctggcaattttcagtggctggtcaacagaagacaggagatcctcacatagactggggacctggcagagagaaaggacaaggtcgaaacagaggttaaaacagcacaccaaactcaggtggctaacaatactgcagccatattgtggtcagtacctttaacatctggccctgggcactgagacaaaattatgggcctgttcttttcttttccacatgtgtctgacaccaactgtgtccctctataaagaaacccattcttgaattacagtggagcgtgatttctaatacagtcttccttccaaaaactgtgtgcagctttaattacctggtcaccagggtggcctagtaaatttaagtgtgtatgtgcttggtattggtctctggtgggcaaagtacaagctgaagtcccgagaagaaggtaaacatttcaaatacacaggaatctaaagaactcggagtagaaaaactcgtccgtgccgggaactcccacaggctcctatgctgggtggagtctccagtactttccaggcccctagccaagtgttaccagttggcttgtagagtcaactctatctgctgcaaagagagcttcaccccggctcccccacagcacagagccccagtgggctcacctccggctggcctgccagggggccgcctcaccaagaaagatgaccccgcggtcgggggctggcaggactcaaactctgggccaatgttgcgactctgacacaaggctctgcaagtaaccaggccactggcctcctcctcccaactcaaacatcaatttctaccaaaatatcccagaaagggatggcagcactttcagaaatggattccttcaggcctgagtcacttccacgctatattttcaatgtgctgacttatttgtttcatgggcctgggtttatgggggctccaccatatcgtttaccaggaaagtgcctgccagttgcaccaataacccttcccagtggaaaaattccatcgtatggcaaagacaccagcagagcagctcagcagacgggctgacagcgacagtggttcctgtgttcttccagaaggcccttgccaccatccaagagacaggcagggacagggagtcccaccaccacagggaccacccagcctccacgggctcctctgctgcccctccagggtgctttagaactcagcttggaaagcaacgcccagcacaactaaaggactgtaaccctgcctcataactcacagaaattctggccttggtgagatgatctgtttcttatacaggggacagtacccaaagagatagacatacaccaccaacccctgtgtacaatgtgctgggcttacaggtgtgagcccccaggcctggcctgtacctgtgcttgttttcagaattctttctccatgtgtatctgccctttcctaacaaacataataaaaatgggggctactttcaaagttggttttggtgataatatcatgcaccttaccatttccatgtgcctgccatgcaccacgcactatggtagagcatattgttgacttgaaagctcacacgcattctgcaaagtgggtatgcaaagccccattttacagattagagttgaggccgggagccataaagttacccaagggccacacaagaagcaagcagtggagacagaaaacaaaaccagggccagatgagtccaaagtccctactcctcctactctaactttggtttaatgtccagctaaggggaaggacagtgcatgctaaaggcaccctctggtggcaaacagccctctcctagccccagccctgcttagctgtggccacagagcccttcaactggaaggaagtcctggctgaggaaggaaggtctaacagcttccacccgaggccatctgggacctgaaagaggccttgctgtgctgccacagccaatgaagccacctcacctaacacatcatgcctgtccctaagcatctctgtttataatgctgggatgctgccttggcttatctgttgggcctcaacttttgcctggaacccattctctctggttggagtcctgacaccatcagctcaatttttcctcaattacagtagagactgagcaaacagggtctgaagttagacctcctgactccgctgcgtacaagtagccttatggcctgggtaagtcattttacttctctactaagacttggtttccgtacctgtaaaatggggataataaaaccaacccatctgggtgcccatgcccatgtgattttgaggacccacatgacacaatgcattccgtgttcagggcagagcctggcacagggaaatgcacgtatgttactgcctgacacgttcaggttcctttcccttcctttagacaatatcatctgtcacctgttactctcagatggcaacaatagcctggatcatacctgaattcactgtgctgcttcagacacagggtacaaacgtacctgtgaggatccggtgcttcaccccagttccacctggagccagctgtttcccttctcctgccaggcacactgcttgcagctaagtcccctcaacgtaggaaagctcacaagaaaatagggtttggtataaaagaggcttgactctactcctatccaagagattcatctatgaatcgaaagcatctgagtaatctcttcctagcacttaacaccaggtggagtattttttcattgatcagttatctgtatccctcactagaatgtaagttttactggggcaaggacttcgatcttactcactgcaggattctcagtgcctgtggctgtgcctgacacacagcaaatgcttaatatatttgggaggaaggaaagaaaggagggaaagagggaggaaaggaggagttttacaacacggagcctcccaaactccaatcaactttactttaaaattaataaattggcaggtaataggaatctttagcaaaagcacttgtccagaactaaatctgaatggatgctgatgacaagtttcctgtgtggttccaacccagcactctcagatatgaaccatggtatggtgggaaagcactgaacaaagagaaccggagctgtcatgaaagccctggcattttttattaacatatgacctcaaggagccacagcattggtggaaagagtgagaactaagagacctgggttctagcctctgctctgctgtgagctggccacggaaccttaggcaaagcccaagactgttcatttgtcaaacacagtagatgagctgcacggagacagaccacccttgaagatctgtgatgggacttctgaaagccagtatgccaggtactaaccaaccccagaaaaacatacatttaaactggaactcaaaaactggcactgcttgtcctacagtgaaaagcctctgggacttgatatggccaacggactccacccaagcaggcaccatttttgccttttggatcaactcttaagctgggccatagttttggccatatttccatcagcgctgtttcttttgatcaaagataatctgctctggaataataacattttcgttgtcatggggaatgagaaatgtggaataatacatggtgtgcccacagacttggaccacagcagctgcccaaaggtgcattagtcacgacctggcaccatcactgatcccgtctcatacccacgccgtccctccacctctgcccgaaactcctcaaacaaccacacggtcccattcaccactccctgaacatgcacgtgcattcccccacttaaacatcttccccattgagggttgctggataaaacagagggaggccagttcagtctgaatttcagatacacaatgaataacattttagtatgactacttcctaaaggttacatgggtcgtgtgttttttttttctcaatgagatggagtccagctctgtcacccaggctggagtgcagtggcgcgatctcggctcactgcaagctccgcctcccaggttcatgccattctcctgcctcagcctcccgagtagctgggattacaggtgtgtgccaccacgcccagctaatttttctatttttagtaaagatggggtttcaccacgttagccaggatggtctctatctcctaacctcatgatccacccacctcggccacccaaagtgctaggattacaggtgtgagccactgcgcctggccaggccatgtatttttatttgctaaatctgacagccaatccccactgctctcttaaatcttactgatccttcagggcctggcccaaactccaacttctttatcaagatgtcaaattcttcagaattcctgcagtaacactaatatcaactgaatcctaaatgctttggggatggctgttctaatactgccaatgactttcaccttactccttcctcaccacttagcatttttcattgtgaattgactccacacctacagaggccaagacaggccctccagcctcagcgcagcatcacgcccgctgcagcagggatcagtcaatgcatgctgattccatgtaagtggatattaatcctgtggtctgaggccatattacagaaccagaatgaaggcagtgtatctctgtaatctaaccagtccctacactcatctgaaccccggcccccgccccctactcatgtcgagtgcttagagcagtggaagaaatcacattaagtgtcacagaccatgggtttgtacagtgatttaaatgaaacgacaggtccaaacaaagccgagagttcactttggggtgcatgtggcactggctctgtcgcctccaaagccagggagggcctctgaggaggaggagcggtgctgacacgcggcagccggatggtttctgtctaaaccacccatctgaactgcctaacggccttggagggaaggttcagataacaccaaaggtgtcagaccaatccaggctgttggggggatttaaacataattcccagtgacttggaataataaacactacactggtcaggacagtgcctgccgtctttctggtgggagttcagggctccaccagttcctctgctgccacaggagtgtgcccaccccagggagcaggagccacaagtccttcaccaccgatacttttgccgggctcggtggtacccaggaggccactggaaagacgggtggggagtgggtaaagtgaactagggcagggaaaagaaaaaaccccagaaggtagaaggtaagggagagactaggatgccattggcaacggcctcaggtgacacctgaataataatccgtggaaggaccaggtgatcgtaatagccctgccctgcgtggcaggcactatgctagcagctctccctgcccttccctatgatcctgacaatggctcttcacacagacacgcactccagtccttgttttaaagaaggggaaacagggccttagagaaataacttgaccggagccacgcagctacgggccaatgtctgaggaaggacatgcagttatatacagcacagctaggttcaaaaagaaactgcttttcccaaactgaacactttttttttttcttaaatcatccaacccaacagctgatcacacgaagagatacaaatcagaagtttccggccacaagtgaggttcgtgtttgtgccgccatatggttctactttgcctcttcctcttctccattagttattaatgttgaaaaaaattgttcaaccagaaaaagaaacttgagatgaacccttaaaaaaagcacaaaagccagagcagctcagacccacggagtctaacccacggcgcccttgtctttaagaagtgcacccttgtacctcggttttttaaaaaatggccaaatgaacacattccatcttttgatctgcctgttggccgagagcccaccaccagcaagataggaatcaaaaacagattctgcgtacttgggtgcactcagaggaaactgccacgccagaatgctgcagctgccgacgtccagcagagggctctgtgacaatttgttccttttatttttccagaaggcccaaaactttcttaaaaagataaaagagcatttcaagtggcacatacactcgtgtcagaaacaaaatatacagtgtggcattctgtaaaaacaccaacctcgaaaccgaacaggttcaaatcctcggtcagtcacttgctggctgagtgtaaccttcctaagtctctggaactgggggttacaacatccatgtcaaggagaaattcacactgttccataaaccccgaatgcccgctccaggcccgtgtcaggtgcaagggctcagcacgggaagagatggacatgggcggccctgctctgacagcaaagtccagccacagaggcatctccaagaggcaagggtaggccaggcatggtggctcacgcctgtaaccagcactttgggaggctgaggagggtggatcacttgagttcaggagttcaagaccagcctggccaatgtggcaaaaccccatctctactaaaaatatacaaaaattagccaggtgtggtggtgcatgcctataatcccagctactcaggaggccgaagcaggagaatcacttgaatctgggagatagaggttgccgtgagccaagactgtgtcactgcactgtagcctgtgcgacacagagagactctgtctcaaggtaaaaaaaaaaaaaaaaaaagaggcaggaagcgaacctgcaggagacgacagaagggggttgctgtgggggcaagtcagcagtctaggaggtggcacagagatgacatgtgaataatgaccaaggagccggccctccaagactgcagggaaaaataacaggggcatcccaagaagagggaagagctggcatgaggctctgctgcagaggccactgaggcaagtgcaagaacagagaggagcaaagcgcggctggagtgagacccagtgaggcagcacgcagcacctcctgggtcactccaagtgtgagggcaggccctggcacactgcttttcttaagaattaaaaaaaaaaaaaaaaaaaggccagctgcggtggctcgcttgagatcaagagttcgagaccagcctgggcaacagggcaagactccgtccctactaaaataataataataaaaatagccaggcatggtggcatgttcctgtagtcccagctactcaggaggctagggtgggaggattgtttgaacccgggaagtcgaggctgcagtgagccgtgtttgcaccacagtactccagcctgggtgacagagtaagaacctgactcaagaaaaaaagtgtttacttatgtataataggtaatacattcacataggtcagaattcaaaaaggtacaagagcacatgctgggaaaggcctcccagtgagggcctgcaagctggctgtcctcgcctagggagatggcctccaggtcaggatcccttcagtggggctcccttcaccggtctgtccagatggacacatggcctccaccagcctatgagagatgcaggaatccccaccccaccaccactacttagtgtagagaaaacacaagcctgctccccaactccccaagggcagcttcgttacagggaccccagtttgtcattaggaacactgagccacggaagcacagcttcatgtagccgaggctggagcttccgacccattttgcctaatggctctctgagcatggccacctctgcaatgagaaggcacctgcacaggcggcagcttcgcgccgggcctgaaagtcacacccgggtggccaagcttgtttttggacgggaagcagctgtgctcccagagactcaggcaagtggtacccctgagtaaccagagggggaccccaggggctcccgctcaccccaggaagcatcaaaacatatctccttaggataatagccacgtgagctagggtatggcgcacctattcggaggcaggattgagggcaccccccaacctgtggatgagaaaacccaggcacggggaagctgctggccccggctgtcccagccaacacgaggtggagaggaatgagaatctcaatttgagactgacccagctcttccaaagaccaggccccaccgggtcaacaaggcgagctgcccccatccccagtcaggctcaggggacaggggaggaaaaaagaatagaattgggggaattatgggactgtgaggaccaaagctttttcccccaagtgcccggtcacggcagacccaaggtgcctggggtcgcctgggaagggctgcagggctgggctctcctgcccctcaccacagcccacagcccacagcagatccgacatgtgacctttccactctgggcctcggggactcctggcgtgtgggcaggggctcagtgcctactgcccagcagagcctagtgagaaactggccccccgcctgccagggccacacacaagaggacacttccaggtccagcctctctcctctttaagaagtcacttggcgctgagggccatatttttttgttttgttttgtttttgagacgaagtctcgctctgttgcccaggctggagtgcagtggcgcgatctcggctcactgcaacctctgcctcccaggttcaagtgattctcctgcctcagcctcatgagtagctgggattataagtgtgcaccaccatgcccagctaatttttatatgtttatagagatggggtttcaccatgttggccaggttggtctcaggtgatccgtcctccttgccctctcaaagtgctgggattacaggcatgagccaccgcgcctggccaagggccatattctttaagtgcaagcacagcctgctttcttcctgtgaaggctgtaagttgtaagatgcaccagtaattataacatcgctaagtgtacacattaagtgtaagaagcaatttcccaattttggcaacattaaaacgcaagcgatggctgggcacagtggctcacgcctgtaatcccagcactctgggaggctgaggtgggcggatcacctgaggtcaggagtttgagaccaacctggccaacatagtgaaacgctgtttctactaaaaatacaaaaattagccgggcgtggtggcgcaggcctgtaatcagctacttgggaggctgaggcagaattgcttgaatccaggaggcggaggttgcagtgagcagagatcgcgccacagcacttcagcctgggtgacagagcaagactctgtctcaaaatacaaaacaaaacaaaacaaacaaacaaaaaaagtgagcaagccacgcaacatagatttgagataatggtacatacagcacatctggcggagtaacacagatgtttctgacttaagatttttttgattctgcgatagtattcagtagaagctgtagtttgaattttgatcttttcctgggctagcgatgcacggtctgatcctccctcatgacgcagggagacagcagctcccacagctccccacaagccctgtgatcaaaaaggtgagcgatgacactctacagccaccgcgcgccaggtgctttcaccaaactgtaggtgtgttctgagcacatttagggtcagccagcctaagccacgacgcttggcaggttagggggattaaaagcattttctacttccagtggatttttcgtcacgtaaccccttcgagggtgcagcagcatctgtacctgctcatatgaggcacatgactcaaggcgggggttgtggttggttacctagggtttaatacaactgaggctggccgagagggccaacattaggaagccatttttgaccaacaaatgatttattctacttagaaatgagtcttccacatgccattaacaacaaagagctttttcaggaaacggtaagtcccctccatctctttcttttctcagacaggtgccctgaccatccagagataaataataaacaaaagcaggcctcctgggctcgctttcagccattcatactccaaaccccaaagctttgccctctggaatctcacagcctggaaggggccacaacggtttcctaaagaaagggtcaggaaggggcagaacaaagaagacaaatggaaaggagaaatgaaaatcactacatttgggtcaaccacaggcacacacaaggctcctgttgtccacatgtaaccttaagcttccctgaaggggatgaaccaggccctcggagcctaattaaatgaaccatttcctggccaggcacacaacccatcacctgtgtgcagagaagccagggtctctctaagctcccggctgcttttaattaaggactcgtccctgagagatgaagcacaacatacaaaaccaccttcgagtcaccagaatggaagtcatcttggacttagtgctgagaactgcctgcagccggccagccagccggcaggagaagctgccgcctacagccaggcgatggcctcaggctaaggagcacagggaggctcccctgactcaggcttgccccacacccagcatcctgcatgtctatccagaccacctttcttccccgtgttccacctaagtcatccttcagggtctgattcggccacgcctgcctcttccactgcaacctcccaaagccgcgacggcagaggccgttgccccgcctctactcctgcaccctgtgcaggatgcggtcttgagcctcacaggtttgtgacatgcatgtgtctccccagggcagtgatgagctgtctggacggcctcatgcccggcttgatgctggcaggacttctgaagcgttggtgggatggtgtgggatggtggaaaactagggccacttgggtcaggttctgatcttttgaagcccaagcctgccttggtgggaagcaagttctcagcactcttcagcacctcccttaaaggagggactattcttcggtgagtgggagacagaccgaaacttgacgtggatggcatttcatcttcctgactgccagccctgagttggatgaaggtgtgcacccactgggcgtgggctgccgcctgctgtggagctgccgctgcccctcgtaccctacacaggctcctcctaaagccagacccgcagccttcccagcatgaaggcaagcacggggtagctgctgttctcttcccggacggtcctcagtcctcggtccagctttctcagtccacatttttattaaggattattggccagacgcagtggctcatgcctgtaatcccagcactttgggaggccgaggcaggaggatcacttgaggccaggagttcgagaccagcctgaccaacacggtgaaaccccacctctaataaaaatacaaaaaaaaaaaaaaaaagaaattaggcactgtggcgagcacctgtaatcccagctactcaggagactaagggaggagaatcgcttgaacctgggaggcggagggtgcagtgagccgagatggcgccactacactccagcctgggtgacagagaggactctgtctcaaaaaattaaaaaaaaaaagattatcgtattggcttgtattcttctgtcacctgaaatctttttgggaaaagaccaggtaaaaatacacaaacataactcatatataagttgatttttctccaaagacactgtaatttcacagaggatctctgtcctctcgtttaagtgaaaagatacatagtgaaaccaaatttttgttctcgtcaacattttaatgaaacattattcaagggcctgctgtaggtcataattcccaagaacctatggacaacattaagtgaggacttactgaactatcaaagttatgattggaataacagcaaagatgtttaggtcttaccatttaaaaggcatgtaacacacatcctcattttatcatcacagcaaccctgcagaaggcaggggtgttattatcccacattactgtttacaggtgaaaaaaagaggcacaggtaggttaagcaacttggctatggtcacacagcaggtaattcaatgaaagccatgcgatcccaccctaaggccgtgcggactctagaatgacacctggtgagtaacctagcaggcaaaataattcagctgaaagagtcaccagctggatggtggcagagagaagtacttggcaagattggtttttcacacaaggtcaacgcgaacggaacctctcataccagccacctactagggtacagcatcaagacctaatttcagggagggaaatgggaaatgcatccatttcatcatcactggatactaagggttaggcctggcctcaggctttataaaccacatgtgtgccaaatgtccacgtctaaacctagagtttagggtgaaaactatgaatgggctaccatggaagttacaaaataagaatgcagggggaagcctgagggcgcgcgccacccgaatgcgggaggagccagatggggcagcataggaagggctgttctttaccactgatctggggggctcatgatcgcccagagggacagaccaacagcatcggggtctgtgggttgatattcatctgcacgtcgacactggtggggatgccagggaaatctcacatgttctgtttagcagaaacgagacacctgaggcagaaagtgacaataaggagtcacacggccaggcaaccatgggcaatggcaacgcaggggatactttagaatctgaaagcctgtgaaacaccctcaagtccgagaggatctgctccatgatgaggaactccgtgacctccagggcccacacacggaggtgagccacagtcatcctgccacacctgctcagtctcccgatgagccaggcgaggtgctgagccctgtactcctcgccccaggggtcctgatagccccttgggaggcgaatgacctttgaagccacagcagaggctgaccagctcagagcacggagccactgagtcagagggcggaggtctggcttcctccaacagattctccaaaaatcctcacgatcacaagcttctaaacctccatgacctaccatgattccagtaatacttctgtttcccttcaagtgggagtgtttgtgccatgtttacgtgtctgagtgggggagcgggtgctaaggcagactcaacaagtcgggttgcttcgctgttctcagcacaaaagtcacccaggctgtctggccacaatgtttcacactggattccttccactggagggatgtctcatcaggttttgctgtaatttcactgagtcacccatagaaacgaccaagcaggggagactggaggggacatctccagggggccacatctgagctgagttacagaaagtgaggcagggctggcagttagggcaggtcgcaaagcagcccaaggactaaggtgcagacagagagcatctctgtctgtcaaaggcagacagcgtgggatgccgaatgctgatagctgcacaactctttttttttttttttgtcacccaggctgcagtgcaatggagcgatctcgagtaccgcaacctccgcctcccaggttcaagcaagtctcctgcctcagcctcccgagtagctgggactacaggtgcttgccaccatgcttggctaatttttttattttttagtagagacagggtttcaccatgttggtcaggctggtcttgaactcctggactcaagtgatccgcctgtcttgccctcccgaagtgctgggattacaggcatgagccaccatgcccagctagctgcacaactcttgcgtgtgctaaaaaccattggaccgtacactttaaaagtgtaaatgttatgttatgtgaattatatctccagaaagctgttgttaagaaggtgaatcaagagaggatattttaggcagagagaaccacatggatccaagacatcacaggtagacatccaggaaaccaacagtttcagaatacgagtacgtcatgtgacccagagttaggttggtaaaaagtgaccctgggtgtcaggaaccatgggcagtgttgtctttctcctcactctcagtcgtagctgtttgactcttcactcttactacccagagcttttcctacatcaaaataaaccaaggtactgcagggacttgccactggcctggaagtcagagctggttctgccatgaaacggtgctacatggggcatgggccacagctccctggtctctgcaatggatggttctctgagagaggagcactttgagggctgtgagtacagagggaggagctcagggtgtcaagagtgggagaggaagtctgggcctaccaccttctacctggtttattcaagttctaagattttgcttaaaaaaagggctgtaccaattttccaaatgtttgaaaaccactagatgagataatcggtaaggttcattttagtgttgacatcctacgaagtttcatagttcaagacttgagagttactcaaaagtttgtgtcatccctcctaaaacaaacctttactaagcaaggtactctgaggctcaaaccaactgtggactgcccagctcttcggttcacagccttaggacacagatgcaagcagctgagtgagttattcacaagaaggggaagaaggaaaaggcttggaacccataatcttctcccctgaatgccatgttcaaatttaaactcttagggaatttctatatttgtatacagaatccaaattcccttctcttttctcttccaggagagattccgagcccaccccttgcctgcctccgagacctcaacaccatcctgcttactaaagggagcccagtttttcccgctacccatggcacaggtcttcgtcaatttcagtgtgcccttcatgaatctggcatgtggtcactggcagttaaagggggtgatgatggagaggagaaaccccaggctccaactacaaaaccctgcgggacacgcaggctcctctgggcttcccggcccacattcctggcctatttcaaacatcagggaagcagactgagcgtgccatgccctcctcaagtatttttaacctgtttccaaaaccagacatgttctaaggggggcgacccaggaattcctcatccagggccagtgcctgccaaccgcgagatgttggctttctaacagctctgaggagggagttgttgtctgccttttctggcacgtggggaagtgggatctctctccaattcacttttacgtctcacatttctcatcaaccagagggcaggatctaacttaaagtgagagtcttcagaccatcctcaatggaagctctccaaacactgttctccggcttccaacaacaacaggagtccataaggttccccaaatgaaggacctggatagatcttgtaggaaaaaaaatcctatgaggacaaggccaaggaacgggcctatatgcacttcacttgaattatgcctcctggctctaggtgacaagagccatctttttcaccactggagagctcagcctcctaccaccttgccccgatcctgacctggttcagattcctcgctaacatacttctctcaccttgtagcactgttgcacattgaacaggagggaaaagctcttttgttcattttccttagaatggaaccaaaatgatactccagtagctccatctaaaagctcaagtggcagctaacagcacggacaccaggggcatcccttgccagcttccaatgccatggtgagagacactcatcatggtttaaaaaaagaccagagagcattttcacaagcaattcctaagagacttaaatttcctacacataggcagaataaaaaccaaaaaggaaaaaaaaaaaacttcccccaaacaaaagtgagggctttcaaggagacttgctgagtgggcaaacattttggaaagatggaattttaaacacaaacacaaaagggcaaagatttgcagcagaagagctatgcacacagccgggaggactttaattagggaaagctttgcaaagcccagggagcatcagcatcggcaaatctccccttggtctccggaatggaaagaatgtggaaaccaatgggtgatcaaggagttcgaattttgcctgacactcttgctgggaatgaagcatgcagtcctgtcttttgccaccttttcagcagcctcaggtgagccttttaaaaaggtgaaaaacgaaggaccacctagcctgggagaagccagggtggatcctctccttcctagggtgcttcctgcagatggcacacagccaaagctcttctggtgttttaaggcagaaacagaattcaggggaggactaaacaacccctttagagctacgtgctgtgttttttgtttgcatttttccaagtccaggcatttttccaggtatttccaatgagactgaaatggcctacacataggctgacgacctataataacataagaaagtgatgttggccccctgctccacccagaggggacatctgcttatttggcttccaggtggtgggagcagtggttttccccaaacagctaatacccttcaattctttgctttctgtatcatgaagttcactggagtttggagcacagactctttaaaccagtaatttaactctacttttgaggataccctatgcccccagcagttatgagaagggttgccaaatcttaactcataagggtgacaggatcaggaacaaaggcctggactctccacccttctcctctgccaaaatctacgagttcaggaaaatggcaagccaggagtttactttaggttccctcaagagcagcagctgttcccaccagggctgcgaaggaatcaacaggaactgagagaacacctgaatggtctgattcagaaagtcccagctccctgtgaggtcaataaagaactttgtctcaacagaggcaacaaggccactgcctcctaggaaaggactgatgtgggcttttctagaggcaggcaggctcttggatcaacaggcttacaagggcacatttctcagttacgatcttaaaattgcagggaacctgctgatctctgtcccttacccatctagaaagtctgagtgggagctaacagctgatcctcagcaaaaccagagtgtgcgcccatcacctgctttctggtaagggacccatgtggcctgaatcaaaactcaaagctcactagacaccaattcacacgctctatctaatcaggcagaaacccagctgctcctgctcagtccctgcccagctagtaccttcccaccacccaccagctgtatctcaggctctgcccactctaagctttccctgggatttgcctgccaagggtgggccacggtgtcctctgtggtgctctgcagtgcccatgttcctcacatcagaagccttgcattctggctgggagcggtggctcacctctgtaatcccagcactttggaaggccgaggcgggtagatcacctgaggtcaggagttcgagaccagcatggccaacatggtgaaactccatctctactaaaaatacaaaaaattagctgggggtggtggcaggcacctgtaatcccagctacttgggaggctgaggcaggagaattgcttgaaccagggaggcagaggttgcagtgagccaagattgtgccatcacactccagcctgggcaacaagaacaaaactccatctctaaaacaaaacaaaaaaaaagaagccttgcattctatccatcctgggttatctggctcccaccgtggctatgagctctttaaagacacaactattctgttgtcactctgaccctggtgcttcagcttaggcagggccttgcattcatgggggctcaagtaggcatgcactcactgaatgtccgcttcaggcttgacagtggggatacaaaggtgaacaaaagaaaagatccctgccctccaagagccaaagctcctaggatggagcaagtccaagagacaggagaagcaaggggcatgctggggggcagggtgagggaagtgaggctccagcggagatgggaagatgagcagttagagggagcagagttggtgtggacatgtgtcccagtcaaggaaacggcatgtacaaagatgcaacaagacagggcacaggcctgggagtgtgcaagacaaggagacaggaggaaggggcagggccagatcaagagctcttccacctagatgtgttctccgggcttgatcccgacaatgtggagtcattaagggacattatccgaagtgcattttggcaagactactctgtatgcagagcaggcaggggatgacaggcaggaaggcctgtctacaggctattataacactccagtaatgcagggaggagcagtagcaataaacattcattgaactgctctaaaatgaggattgggacataccttcacccaacaggctggataaggtggatggcactctgtaaaaaagtgaccccgctttgggcaggtggaactacatctccactggccttcagcagcctgagctgcacccagtgccccttctgcctgcctccctcctggactccagccgcagttcctccctgtcacatgccctacttaacgcctgcagcatcaagactcaagaggttgaagtacaagaggtaacagtagtaggccgggcacggtggcatcacttgaggtcgggagtttgagactagcctggccaacatggtgaaatctcgtctctactaaatatacaaaaattagctggctatagtggtacacacctgtagtcccagctactcgggaggctgaagcaggagaatcgcttgaattgggcaggcagaagttgcagtgagccaagatcgtacaactgcactccagcctgggagacagactgagactccatctcaaaaaaaaaaaaaaaaaaaaaaaaaatatggctgggcgcagtggctcatgcctgtaatctcagcactttgggaggccgaggcaggcagatcacttgaggtcaggagtttgaaaccagcctggccaaattggtaaaaccgcatctctactaaaaatacaaaacttagccaggcacggtggtacaggccagtagttccagctattccagacgctgaggctggagaatcacttgaactcgggaggtggaggctgcagtgagacgagatcacgccactgtactccagcctgggtgacagagcaaaactccatgttaaaaaaaaaaaaaaaaaaaaagaggtaatgggaaaaatgctcgcttgtcattgcaagatctgagctcacctcacagtccctctcccacctggaagaaggcaggacatttcagagcccgatcaagcagcattcacccacctatctggccaaacagggaaacgcaggctgcttttgacaaggggcacgcaccctcctccttaaaaggacagctcagcaatcatgggaaagcagtggattccagccgctcctgtcagggattccaccaccttctttggatgatttgcaccaagtattttccctacatgacttcctttaatattcacaattgtcctcttttagagtgaggcaaatccagaattctctccattacacagatgaggaaactgaggcctggagtctggtagcttaccgagggtcacctagatattcaggatgcatgctcccagccccagctaactcatgactccgtgaccttaaagactctgtccatatactgccacctgccgggaccaccagcccttgagtcccaggggctgaggtctcctgagtcatagctcagctccaagaggcatccgtcccttctcatctctgggtctcagatcacacagcctagaatgtctaatgtggactcccctcagaatttggggatagcagggtttttggttcattatctcatatttatttgtggccatatcgacatgtggccaggcactgtgttagggtctggggatagaggtgagcatcatggcatcccgcaggtgctcggaagccagagggccctccagtgctaagagtacagttacagcacacagcagtgctttcagtgcgttagataaaacgtggagatttggctgcccctacaggcagcgtttgggactaggaaggtcaatgagacaggaaaacaatgcgggcgaagaagtattaagcctctttaaaacacctgatgtacatatctcctctactcccaactgatgttcaacacatagctagaaagaggcaaaaaaaaaaaaaaaaaaaaaaaatccccttgtatgaaggataatcctttcagcctggggcaaatctcctgaagagttttgttctgaactaggagtgttgttttagcttccagtcaatagtaattaagagtcccaatatattccagaaagagggagagggagattaacgatcattaaatctcttctgcatttggctccaaatctcttttcggaggggccggctgtcagatgatccctccaaagcgtccatctgacagcactcccgccgccaccatctggaacatcaattcgagagctcgcctgaaggtttcaattacataaaaggcaatgggcccattaggacccgagagtctggagcttcacaagcgctgctcacaccccctctcctgtacacaaagcctctagaatttggttggcagtcatttgcaaagggactcattttggtgggggcatggggctggccagccccttggcaaggcctctctcaggcaggctctgtgcgtgctatgactgacagggtctctaatgaaccttaattgtgagctcgacaggcccaggaaggcagccacagatgtggcaaagggcaaccgcaaaccgtctgattagtgaataagaagtgtccggcccagtgagggccaatgacccaaaaaaggaggagggcgggactattcctcccccacgcatcccttctaaagctctgaagcttctttatgtaagcaatgcaaagcctctgggtgcactggaacccaacgcacccctccccccggcactactgcttggcagctggcagctgggatgttggggtcttgtgcttgttaccacggatgcttccgtctccatcagcagtgcacctttaaccacaggaggccagaacagaacgccctttcaacgtgggaagggggaagctacccactacggagactgagtaacttcttgccggtgctaagaattgtgaagacagctgcattcagagtcagccatcctctggtgacctgcagtgacaaggagaaagctactcctggggcagctttgggcacaaacagcgtgacggagaagacaggctttgcagacgggtagatcccaactctgctccttactaattagctgtgaggcttggaccaactcatgaaacctcacttggtttcctcatctgtaaaatgggcataaaagatcaaccttgtggtgtgcagtttaaataagcaaagggtctggaacagtacctggcacacgatagtcatctcttaaaacccgggagaacagcagagtattttgcgcaagtttgacatgacctcagaactccatgcagacagctactacaagccaggtactatgctagaagctttacaccccccatctctcattcttgaagttagtgtcatgcccatctcacagatgaggaaactgaggctcagtggtcacacagctaagacgtggtaaagacaagagctgaacaggattgtgcctttcgatttcaaggcactccactatcaacttcaatgctcctaaccaagcatttcaggcatcctcagactaacagcctagaaacacctaaccaagaattttgtagaatttgaattcccaaatacaccaaaacaggcttctctggcctggcatataaaggtgtggtagggggcactaaatggccaatctgtttccaaggaagtctgcaaaacaaatgaggactccacttccagccttggtctgcttcttggctagtggcacctcacaagcattttctgcatcagggtcatgaataggtagcagcaggtgagctgctaaaatagcctccccaccagaaagcagtcccaggagaggcccagagatacagaacagaggcccatcactgggaggttgtgtaggaccctcacacatagactggggggctctcaagctggggaaaagggtacctggggggagactagagatgtaggttcaagaaggggacaagagattcagaggaaagaggagcaagaggtgagcagtgctgataaggaagagggtaaatggcaaggaagctgggaaaccgacagaaaggatcctgaggacccaggtttcacaggtgacctggcacctctggaaggctgaggattgaggggtctgatgacctgggaggctgcaaggctggcttgtccttggacactgagatcaacctaagactccttcctgccgccttagaccatccagccacgctcttgtctagctttctctcccagggcttccgaagactttcccaatgataaccggggtcagctcctcattcagggagcagaagcaggaagaaaagtgcctagcaagcaatcaggaagaggagggggagagaccctcaccagggcggactgtgcagctggtgtcagatgacccttatctctgcagaatggaaaccagccagccaaagtctggaggctcaccttctgacctccatgactcgcctttgggtggggggccgtggcattttcagcttcccattcagggatccttaccttgacaagttctcatgactatctacaaggcctcaatggagggcctcttaatctccttcctcagttaaataagccaagtccttgcaaacgtgcactgggttataaaatgccccactgtgggagccaaggctgggacttggttcacctgtgaaaactcagcccaaaaggctgcccagggcatcagggcacagcctctaggctggtggaacccaggagtgagccaatcggccctaggaagccaacaaaggcagtaaaggcaacagccagcatcaattaagtgcctgtcttccactcacatctgcagtttacacgcaccccaaatcctcacaaccgtctcatgaattcggctttcggaaactgtgggagatgaagtgccttgtccaaggtctcaaagctggaaggtgaccaggccaggattcaagtcctagtgagccttctcttctggctctagtgagccacccagggacaaagactgtgggctggagtatctgctggaggcccctgccggctctgttctctccacctatttaccagatggggcagctcataggcctgagagaaactgaggtctcttctgccagcaaaaggggagcctgaaagtggtgacatcaacagaagggtatccatggtgatgttcttttagttctaggcaacagacctccagttctgagagactgagagaccatcaggcctgcacttcgcagagtgggggcccgagacccaaagacctgcaattcccaaagcaaattagtggcagactcaaagccacagcccaggtctcctgacttccagtaagatttgccaaggcaccttcttaatggacatagtgcttccttttcatctacctttgtccctcctattgaagcagcaggaagtttcctgaagcagttctctatttgcacaaatagataaataattccaaaaaagctatgtttccttctaccccattttaccaaacacttatgaaaataaaaggtttggctaatatcacacttagggccattgtcaaaaaagggtgtagaatccaggccacttagtgtgtaggttatgatccttcccaggaaaacaatgtttcccaaagcacattccttgaacgtgagttgggataacaggttcagttctttttttattaactgtgggacttctcagagcctttaatatgccaacatgggtgatgatgctcttaatggataatggagtctgattatccagactctggatttctcccagtcaatcgctgccctttatccctcaagagactcaatgccaaggtgaggggatccacttcattagaaagtcacgaaatgtgcaggtcacagtccaacaagaaacgaatccacccaccaagcagaaggaacagtcatccatgaaggaggcttttccagccatcccatctcggtttattttgcacttctaactactagtgaggaccaaagtttcacatattaggcgtttgtgtttcttcctctgtgaattgcctatgtagccagctctttcttctaacaaagtattcctacttctcctattgatggaggcaatgccatgtggtagttaagagccccggagtcaggttgtctgggttcaaagcttagctccaccatcatacttggtgaccctggataaactgctggaggccctgcttcttcatctgtccaatggggacaactctaatagcctcagcaggtgttctcagatttaaagagagaagcgttttgccaaaaggtacaaatgcttttcagagtgtgttccttgctttttaattttgtgtaaacttctaagttaaatttgcatgcagtcaaagctatcatttcggcactggcttatgcaccttctaaaggcctcttccatctcaagatcaaatactgatgtttgctctctgggtctttcatgttcgtttaatagttaattcttcagtccatgagaaatacgcaatatgactacatgctgttgcaatagagttttagtgtgttttccttcaaaagtattagctgtttcaacacatttattgaacaattatttttctcccaaataggaataccacttgtgattgttctaagttcttccattactgagtctgtttctgagaattctgactgatttgcttccgccactcagcctggagctctgcagctgtcttcacgcactgcctgcttgcctcttaggtgactgcctttaaattaaatgtaccaaaatcagcctgtgctccagcataaatcagttagaacagataggatgccaggggagatggagggacaagagcccatttgtaacagcaaaaggagatgccacctagaaataagctcccttactgaaccatcccgttggttcttgcagtgcactgctttttccaaaatttttacatttgttttaactgaaagtatagtgatatactacttgtgtctgggcaggatgctttcaaaatagcactttccccccaaacacacacaatgcaaagtgtgtatgggtggggggtggtggggggctgcaataggaagctttgcctctgccccactgttccaactgagcccgggttccccacagcccagccggttgaagggagcggcggctcctctgctggtcaagctctggaggaacatcgcctgcccagagctccacaccagcagtggcaggaagagaagttcaagtccttttcccttaggtacttccatggtgaccattcttcccaggccctcattataaatttcctttacattttcacttttaaaagattatttagctttggcaggacatttaagaaatggcatactataatattttcatttgtaaggctgtaattcagtggaaaatactgactggaatcaagaggtgggcttgacacctcttccccgcaaccccacagcacgcatcacctatcaggtcagagactcactgccctcctccattcctcagtttcctcccactcacttcacagaatggctatgaagacagataaggtcctggatgaagcgtattaataatgagacccatctgtcagtacttgctgacatctgatggagatccattaaaagttacttattttggccaggcacagtggctcacacctataatcccagaactttgggaggccaaggtggaaggactgcttgagtgtggaaggactgcttgagttcagaagtttgagaccaacctgggcaacatggtgagacccccatctctattttctatgtttaatttaaaaagatgaaaaaaatttttttccatgtaattgaaaagtattttatagggaatgaaagagggaagagtcaaattgttaatctgagaccaaacaaaaaatactttctgttttgaaatttgtattctctgaaaaataaccaaagcttactgcgtggctatcttaaagatgatgggagagcatcaattttcaaaatagttggctttggagaaattcaagccccttcccctaatggaaaatcaaccattactgttctaggacagctcaggactggtggatacatcgttgcagtctcctggaatcagtctttgctccccaaggaacacacacacaaaataaagccaatggccctactaatctctttggttcatttcctttctcttgcactcctctctttcattcattccaccgtaattgtctggattgcctttacagaaggcaattaatcgcattcttaattggataaaatgaggaaccattacgctgcatgtaacagaactcatcagaatctgaaatcacttctggccaaatctatgagggagctggtcaggtaagagcaccccaggaagccccacttcctctttctaagcaaatcatgccatttcttcctggtgaagggctgcctggctgccacctggacacaaatcagaggctgcactactaggtggcaggtcctcaggttgataacaggccggggtcatgaagggccgccatcctccggagaggccaggatgggcaggaaacgccagcttggcacccaccgtccagagcatgcctcctgctctccctgcctcagtccccacagctgccgcccattcacagagcaaaaggctcacgtgaaaagactcaccacaattttccaaggaatggagtttattaaaatactgctggaggcttttggctggaatgttttttctccttgtaaaacgggaactatagcagtgttgtctataggaaagctcagaatacgctcagaaacatcagtcacaacagagactatgtaggggctggtgcatattaccagtgattccatccattccgcggctcctgctccagagataacattcggctcagaggagaaaacttccaggcagaccctaggatgggtaggagagaggaagccaagtttccccacccttaacataaacccacggggaactctggtggaaaaagcatttttttaatgttaaaatgtcttgcatgtgggcatgttatggattggaatacaatttattttttaatttttttcttacgagatggggtctagttatgttgcccaggctggtcttaaactctgggttcaagcgatccttccacctcagcctcccaagtagttgtaacttcagatgaatgccacatttccagagagaaaacaatttttaaataagacaaaacatacaatgctctccttgaggcaggcacctgtggattttcccctaaaaccccagaaatgtgtatttgctcttctttcttcctctattgacatgagtactttggggaaagaatgagaagcgccaaggcacaagtcactgagaaaccggttaaaaggtggcgagcaatggcttgcagaagtggacaaacatttactgatagctgggcacgaccattaaagagcctctaacacctttatgagtaagtaaaaacaaataagcacagctgccagttatcctgttcaacagatgtacagcgtgcaaagctgaccacagccaggtcctccttccagaaattaattccccataaaatgtcagctccatagagcgaggcttttcatctggttctccacgaaaaccccggcacctagaatagtgtctggtgcatggatggtgcatttaataaatgtttgcagaaagaataactcagttctgcagctcttgctactcatcctcagagcttattcactggtcaatgaccaatggcctgagagaatccaactagggtcattcttttcggggatcaagctgaagaatccttgcattttgacccgtggaggagaaggcaaggaataaaggctgcacttcttcccagaattaaacacagtgcctgacttccaggaggtgctcaataaatgtcgactgaatccattaccttttcacttacttcagctgagacccttttagaaaggcaaaaacttaaaaacaaaacagggtctcattctctcacccaaactggagtgtagtggggtgatcatagctcactgcagctttgacctcctgggctcaagtgatcctcccaccccagcttcctgggtaactgggaccacaggcgcatgccaccatgcccaaaacattttttaatttttagtagagatggagtctccctatgttgcccaggctggtctcaaactcctgagctcaagcaattctcccaccttggcctcccaaagtgctgggattataagtgtgagccaccaggcccagcttaagtgaagacattttaaatgttgtctttgaaataaaggacgaaaaatgctggtctgagattgtttgaatgacaaggctaaaggggaagctagggaagaagaaaatgtaagcctgcttactctattaacacagataaagcagatcctatctggccttcaagatccccaaaggcaggggtagtcgtcttgggtcccaggcccagtgcagcttcatcacctgggggacaaaactgagttttgcttcactccacacagctgtccctggaaaaatgatttccagatttcattgctttgactattaaagactgaaaactgagcagcactgcttagcagacatcagatattctgctaatcaatcgtattaatgaactattgactaatagtatcatccttaacgtcaccagtcaattacaaatgtgtgtgagctggctccatgggctgcttcacggagagcaggtttttggaaacgtaagcagcgggtgtccactcactcgttcactaaggctcgaatgtggacacgtcccccaagcactcagccttctcatctgtcaaatcacactccctgcagacatcatgctgccccgatgggggtggcgatgcgggggtgacagggataatttcaaagcatggctaccgctgaggctggcagtgtgaatacctgtgcccagctggctctatttctagagggctgctctggctacttaaaaagaagaatatgctgaaaacagttaacctatgaagttatcaactccccggtaaaaaatcaggatgtctcttccacctttacctcactggcctggatactttcccagccctgatgtcttccccttgatagagtaaagtctggggacacccaagagctgagccttaggacaactgtaagaaagaaagaagtgaaggaactaaaaacatgaagtgaccaatgtttgcaagcagagactttcttgcctagttaaacagattcacggctatttttggtttgctcttaaaaaggcaaaggatggaaggcctgctgggtgccaatatgcagaaacaaactccttcctcagctcagggctcaaaatacaccccagctgagacatttctgctcttgctgccagtgtgcagagtaaggccatagaagggccaagtttatgaagccaagggaacatcttcacatcatatgattcttggccctcatggatgtgtgggtatttttgaaacagcttaacaacggatttcagctggattcactctagcacaatgggattaatatgtaataaaatgatgttttggccatctgcaaaggaaggtcatttcccaccaatcagagcaggcctcataatcccaaggcagcaaaaactctctgatgctgggaagaaaaaagaaagctgacctggcatgataaattgggctgccttggcctggctgccaagcatccctcacatttctcttcaataccactctgtaatcagaccatggtggactggatccattcccccacagttccctggccctgacatcttaagcgaggccattcccttcatggggaatgctggcaaatcctaacattctcgtccatcttaaaactggagacttttcttgaaaacaacaatctcccccccttcattatcttgggcaggtgagcagggaggaatgactgctgtttgcatggagcagcagtgcattagctactttcaaaacatctgactgatcccagattacacgagacaaaggcctggatcctttgcctttagacaggtgcataatagtgtgaattttctgaaactaccgctttgggaagaaactaaaactgcatgtgaacttcaatgctacaacagtatactcagcacagaccaatccttacagaataaaagcatttcgtaagttcagttaaacaggaaaaaagaaaaactgtcattcccagagaacactggcagtgatgaaaataaaacattcaaagaagaaacctccaggatcagtcacaggatccagtacaaagccagcgcactgccccttatatgagcatcgcacgtagcgaggagttcaaagccaggccatcaatcagaaagtggcttctgaagcatgtcaatatagttttttttcagtagagatgggttttcgccatgttggccaggctggtctcgaactcctggcctcaagttatccacctgccttggcctcccaaagtgctgggattacaggcatgggccgccgcgcctggccaatgcatgtcaatatagttttaatgaggcatgcattaccagatcctaatttgttgaaaagtcatgctccatttccattttgacattcctcatacttcaattaaaaaattaatgagaacaccgtttccccaacccactctggacgatgggaatccactctggcctcttgttcagcctctgaggtagacaaggccccaggtggcctccacacagccggtgaagggagctggtgcctctcaggccgtcccgaggcagtggaggaaagagaaccactaatcataaatggcctggttccgagaagggtttttttgccccgtgtctagttcttgcttttaaattatgtgaatttaacattattctccataatatacctatgtgttaacattttagattactaatgaatttaattaacagtttctctcccaacaggcaaaactgacacagcacatagacacaccacatttactctgttgctttcagtgtgactaacccaaaggaacctggcaagcaggagaaaccagacctcccggcgctcccaagccacatccctatcctggcttcttccccatagagtctaaatcatctaaaggaggtgaggtggccatatgtaccttacaggggtgttgtatgactttgaagaaacaataaacaacacaaacagaagtccccagcttagtcctgggcacacggcaggtattcaacacgtcagctgtccacctcaacctcagcccacctccaccagctctagcatacattctacagaagacaaagttaaaaacagaaaagtaggattgcctgaggtcagcagttcgagaccagcctgggcaacatagggagaaccagtctctatgcaaaataaaacattttaaaaaattggccagatgtggtggtgggcgcctgttgtcttagctacttgcaaggctgaggcagaagatcatttgagcccaggagtttaggaggctgcattgagctttgattgcaccactacactctagcctgggtgacagagcaagaccctgtctcaaaaaaaaaaaaaaaaaaaaaaaaaaaagtatgctctgacagtaatctatagaatgtcacacagtacaccatatatcagtggtagatacggcctggcacttcaacctgtgtccaagtaccatcctgcaactaagcctcagaggtgatctctctcattatctggctatggcgaaagacagctcttgatactctccttcattcaccatcaatgctgcaatttccctgttgagcccagggaaaacccgcacgggcagcaagggagccagttgaccaggttttcataaaagcagctacatgcacatccctgaaagagagagtgatgagggagtcccggagaaaagacacagctgtagtaaaacacttcagttgccataagaacaaaatagcctattaaacaccaggaagggtccaatgagaaaaatttgctcatcatttcctacttctatgtttggcttatttctaaaatacagtaataactaaattggcaaactaaatttaaactcagccaagcatgctttcatgctgagtttagaggaaaaacaagcccctgcagctgaccaaattaaaggcagatcacaccttcaacttttgcccacctcttccacgtaggatcaatcatagatttctgaccaagaaaaatgcaaagccattaaagcacttcccagaccacattctgtagtcctacctcataggactgatgagagtttaaatatggctgcgcatgaggcactgcatacaagttcagccgtcagtgggctgatggtgaccattctcaccacatcaagtccaaggtctcctcactttcaaggatacctcctacctatccaactttatacttcagtatttctcaacaaaggacatctcctctaacccctccagcccacactgcccgaccgcccccagctcacatttcacatgctcaggcccaggttctacacaaaactggacccggccaatctaacgtgcagcccaatgtttaaaaatcaggatattctgctgggcactgtggctcacgcctgtaatcccagcactttgggaggccgagacaggcagatcacttgaggtcaagagtttgagacaagcttgaccaacatggtgaaatcccatctctaatgaaaacacaaaattagctgggcacggtcgtgggcgcctgtaatcccagctactggggaggctgaggcaggaggattgcttgaaccggggaggcggagattgcagagaaccaagatcaccccactgcactacagcccgggtgacagaatgagactctgtcaccaaaaaaaaaaaaaaaaaaaaaaaaaaaaaccaccacacacaaacaaaccaggaaattttacataaaaccccaaatatatggctcctctagaaaaatgtgaaaatgagcaacagaggcttccaacagggcaacaagcaccaggagtaacgagggcagctgctcttcccacaggggcctgtgcctccagatcccaccatgcccacttcaatgatcttcctcactcgctggctcctggccggggacccctgatcctgagcacacagtgggttcatttgcatcacaactatgttactacccccctgaaatgtcgactgtctggcaggaccctctctttttgatacctgccttctctccgcttacatcacaagcatgtgcagttgtctctctgagcagccagtgacctcaagaaacctctttcttcccacttcctgaattactatgaatgagatacagcaggttcccaactccctccacaggctccgctctgtgtcacacacttgcctctcagctgggagtttgcatccctataaatatacaaatagtcgcactacagacctttcgggctgctgtataaagttttctgtgaatgacatccgtgcctctcctagcagtcatatatttttcctagtaaaaatgttctgaatgcatacaatggaattaaataaatcactacagcatatgaacaagttcccaacccactctaaaaagatacctcactgatgagccatgcttggcaatggataattacatccaagaagacacaggacacagtggaaaaaacagaggaccagactcagggactcacgttccaaacccagcaccagaactcactgccaagtgatcagggtgattcggctggcctcttaggacctgattttatttctttccaatatttcctatggctttatagatgtttttgaatattttgagcactcttcaaataatatggtgctagtgaatttgaggcaacatcttgagaccaatcattctgagcataaaaatctatgaaaatgaatagaatatttaaaaactagatgtgacgggccctttaacaagccaacttttgcttgttataccttttcaaactagaaatgaagccacggaagcatcttacaggtagacgcttgtactgtgttggctggagaaactcacaccatagcagagactgacagcgtctggcctgcgtgcactgctgaatgcctgcgggatgggtatggcctcttcctcaccacgtctaaatgcaagcttctagaaactgaagacaaggcagctggggagggagcagactgtcattaactttagaactcctaacttgggcttcaacaacacagatggttctgaatgacagaccaccatatgaaatccatcttctctctgcctggaggaatctcatagtccagtggcatggtctgccagggagagaaaaggtttcctgtgttgtgaattctgcatggaaaaagctacacaaaagcaactaactcttagccgcagtctcaaatggaaccatatgaaggaggcacgtaccaggtcgatcaggtcgctgaggtttttctcgatttgctggggaggcaggcgcctcattaggtccaaggcacagtccagctgctgatcactctgtggagggagaaatacaagtgcgtcagtcatttttgccagaaggaatatcaaaaactccttttaaaaagcatgcttgcccaaggcattctaaaacccaaagagccacgcagtgggccctccgccaggtctctgtgtgccagcagcctggagcggggggcgactgtgcaggctgtttgctcccctttgacagcagtctctgtctcaagtgggggcatccaaaagaccctgaaagaagtggaagcaggctggagacgtcagaaagctccctcaccggctcccctgctcctgctcaacaggccctggtggctgcagatgtcgtgccccccagttggttccatggtgaacacactccagtagcggattacttttgccctttgttgtaacctgggtgtaaacatcaggtaacatccccaggccaggttccttgagaagctccaagggagggagaaaagccaggcaaagaacaagtggcaagatgcacacggggttaaaagtgcttcattcattcaatagaaacttaggacactaagacctgaaccacactacagtcaagagctcactccacccagcaaactggactgcaaatgcagtaaactatgtcactgcagaggcaaggactggaaagacaaccattactcttgtttatcaagcactcttttaaaaaatgtttttcattttttaaagatagggtcttgctgtgtcacccaggctggagtgtagtggcatgatcttggctccctacaacccccactttccaggctcaagtgatcctcccacctcagcctccaaagtagctgggaccacaggtgcatgccaccacacctggctaattttgtagttttttttgggggggagggggggaacatggggttttgccatattgcccagggtggtcttgaactcctgggctcaagcagtcgaactgccttggcctcccaaagtgccgggattacaagcatgagccatcgtgcccagcccaagcacctttttaaagctatgcatcctgtgcttcaccatactctcctcacagtacatatgctgcaaatatttactcagagccaccatgtgccagtcaccataaacatataaaaaataaataaataaagggagggggagaggaagggaacagagcggaggcaaggctggtaaaatgcaaagtaaattcaatgcacagtgggttctaacacagaaggctagacctcaggagatgagacaagaaataaagtgagaaaggtgggccaggtacaagggtgaagacctgtgtatgcaactcttagaagtacaggtgactccaagtaaggcagatggagtccccaacactacccaagcagccactatctgatttgtatctggaatctgctctgctcagaccaatttcaggatttttggaaggcctaaatcaacaagctacagtctcataaaatacacaaagtaatcctcaaaatgccacatttggccttaacgaaatataacttttgaatattaccgtttacactccaggtctgttaaccacaagtaggccgtggggcaaggacccacttcatagtcaccagagacataacacattattaaggagagtcaatttcatttttttaaaaaaagatattgacatggcatatacagccagctgttttaaaaaagaatgaaagaaaagaaaaagcctgtcccttgctcaagatggctatcagtgacagttcatcctggaacacacaacgaactggctcccctgcaaagagaaaagaaaaacaccacaccagaaattctaccacttgttttgctgaatgccagcaaccatgaattccctacttgtgccacgcatttctatgccaacatgtgtcagccaaggccacagtgatgggtttggcccactggcatgagaggaaattttaacaccacgtcttgggcagaacacacagataagctgattcgactctagagagacatattcaattcccaatactgccattcattaacttatggccttgggtgggtttcttaatctctagaagtctctatttatttatccataaaatgggaacacagtatcttccttagagagtgacaataatttagtaatgcatgtggaacatttaatacacagtagtatgtgtttaatgattggggatattgagtgcatacaaataaacatacagcttttaaatctttttaaaaattttaaatgattcccctgcccaacctccccgcccctcaacccagccctggatctctctctctctctcttgctccccttaaactagagctaatgttcaaactcaatacaaagctacgtattctcttggccaagcaagaatagaaaaccctaaatgattcaagtcaaactcgttaaaaggtataaactagtatttctcaactagggatgattttgcacacgtgcacacacatacacacacacctccaacaaccctgccaggagacatctggcaatgtatggagacatttttgtcacaactgggagagaagaaactactgacatctaatgggtaggggccagggatgcttctaaacatcccaaaacgcgatacacagcctccccacaacaaagaatcacccggcccaaacgttaatagagttaaggctgagaagccctgggcgaaaaataattggtttgggggctgcagattcccagaatctgattgacaataaagtccccctcaggaagactgcacatgcaggcaaacgttttatatataattctaatttaaagaccacacatacactttgggaggccaaggcgggcggatcatgaggtcaggagattgagaccatcctggctaacgtggtgaatccccgtctctactaaaaatacaaaaaaattagccgggcgtggtggcgggcgcctgtagttccagcaactcgggaggctgaggcaggagaatggcatgaacccgggaggcagagcttgcagtgagcccagatcactccagcctgggcgacagagcgagactccatctcaaaaacaacaacaacaacaacaacaacaacaacaaacccacacataacccctaaaaatttctggtcttcagaaagtatctcaactagatattagcaatcctccttataaatgaaaagcaaattaagatataagtaagcctgtctaatttgaaacggtgatccagacagaacacagaagggattaactagaaaactgagcagtgttatctaggaaaagacctaagttgaccagagaagctcaaggtgaaagacactgttttaacccttcttcggtgcctgttcacaagcccagttccaatatgctgatcacatccccaccccgcaaggggccggacagtcctctgtagacctgtatctagttgacagcactagaatactactacaaaaggatctgactcatattttgcattaatcccaattaatcttaattggaaatgtttcactacaaatttctaaggttaaggatgtttaactatcattcaatgaggaaatgactaaatgcttcccataagtgaagcaacatgggaaagcttaatgacagcttttaagacgttaaaattagagttaactggagccatttgcttgggagtcatcccaaaccctaaggggtccaaacaggaaacggtaccggagaatgaagcagatgtggatgaccttcagctacaagcaacaacgtaagtgacccaggaaatggaacgatggggacagagggagggggctagtcccaggggcctccctaggatgctgtcacttttatataaagctcaataacaagcaatagtgaacattctttttttttttttttttttttttttaaagataggctctcactctgtcgcccaggctggactgtagtggcacaagctcagctcactgcaacctctgtctcctgggctcaagctatcctcccatctcagcctcctaagtagcttggattacaggcacacaccaccatgcctggttaatttttgtttttcttgagacagggtctcactttgttacccaggctggagtatagtagcacaatgtcggctcactgtagcctccacctcccaggctcaagccatcctcccacctcagccctccaagtagctggggggccaccatgcctggctaattttttgtagtttggtagagatggggtttcaccatgctgcccaggatggtctcaaacgcttgacctcaagcgatccgcccacctcggcctcccaaagtgctgggattacaggcatgagccaccatgcccagccaatttttctattttttgtagagatggggttttgctatgttgcccaggctggtctcaaagtcctgagctcaagcgatccatctgcctcagcctcccaaagtgctgggtttgcaggcgtgagccactgcacctggccatgaacactcttattatttagacacgtgttttagactaatataacaaggcttttttttttctttaagccaagacaaaggtatgataaatacaacatttaagaagagtagaagagcagttctagggaagccatgaggggaagatgaaagctatactgtctaggtctcacatggaatggcaggttcaagggtattcatcatcaacgtgatgcttaagttatgattatcagatatctaaactttttttaaaggtaatagaaaaaactacaagtatgcagggagtggtggtgcgtgcctgtagttccggctactcgggaagctgaggcaggaggatcgttcaagcccaggagttctgggttgtagtgtgctatgcccatcaggtgtccgcactaagtttggcatcaatatggtgacttcctgggagcagggaaccaccaggttgcctaaggaggggtgaaccggcccaggacagaaacggagcaggtcaaaaaatacaaggaagagcaagtaaagagagggcttaggactcaggagtccagggtccaaggtatgccctgtcactagacgtctgtgtgctttggactgctcacttaacctcgtggcctgggatttggcccagatgaactctaagactccttctagatggagtgccctctatcctactgcgagagcagacatgcctaaccgccacacccttcaaaacaagaccatcatcctggatttggccgcttgcaggccagcaactgggctacagttcaacaactgtgcactgagtgccaaccctgggccaggccctgaatccggcccaacaaatgagacccagtcccaagcctcaaggaaccaattgtccataaaacagcaaataaccacaaggtcgtgtggtgtgtacaatgatgagacagagaaggtacaaagagacaaggcacagttcacaatacactgatttgtacttctttgtgtcaattattttcctaggacttccctccctcacatggctacaaaataaacagaaggccagtcaggggaagtaaactgtcacctggtggctaagagctctccacaggccagctccttcaaaactctgactggtccaggcacctccttcatacaatgagcttcaccagttccaccacccaatggtgtgttccaggtggaaaggtaaatagtaaaagaaggaccatttctccttatcctctggaattctctgtccattcaattaatcatctgatcattatgtgagtgtttcctaggtaacaagcactgtttctgatgctgagtggtgaacataaaagtctctgctcctcatggagcttatggtgcagtcaaaatcagtgtggaaaaaaaaaatcaaggaagagtccttgttaggatgtcaaataataaggaggggagttaccccattttaagctggcaaggctccaaggggtaggtttagggggttttttgtgttattttcttattttggtatataaactgagataagaaatatttcacctcctgttttcacatgatttaaagaaaaagcataaaattgcttaaatcaccctgcaataaataaaaccaccattaatacggactaaaacaatttttcagaataagaaatcagtcaaataaaaccccaccatctaaatatctgctacagtgttcagacatccgacggtattatgaaatcatctgcatacaggaaaacttggcctactaggcaaactccagggcaaagtctgatttggaaaccatcaagtgagatgtaaccagtacctacactccaagtttggtagagtaaacacaccatctacaacaatgtcaatgtcagagtacaggtgcccactaagtagggcagggagccccagaagatgtctcagaatggggccacaggagcaggttagccctggataagcaggtgtgcctttccaggcagcaggtgcagcaggctaaggagaggtgagccaggtgcgtggaggaggaggtggggaaccatggggcatggcctggggaggtgactggggccttgtcacaagagccagatcacacccaaactactcagggggcagctatgctggcccgaggagctaggctcagaatctcacttctccccgcagttttttgctcctgtccagtttataggtaaggcatctgtgccacattctttaaaatccacttttctgtgaaggttttggagcccctagagatttttccacaggggaatgacgactgctgttgtgacttagaaggcgaagcagattatattttccaaaaatgaccataacaagcagtcccatcccacatgctcctcttgcagcgtgactgtgacactcctcccacttgtggtggggcgggggggggctgtgtcccctccgccttggaaccggaggagcttttgtaactttttatcatcagagcccagcacaaatgatgccctatgacttgtgagcccacaagagacaacgcggcttctccctgcctgctaaacacacaggcctggagcccactcaactgccccgaggccaccctgtgcagaagacttcctgagactccatggacagagggaggcccactgagcccccaggtgctccaggctcccactgttccagcttcagctatctgactgcaatagtatgagaccccaagccagaaccacccagccaaggccctcctgaactcctgacccacagaaaccatcagagacaatgaaatgaattgttcctttaagtcactaggtttcgggatggttttgttagacagcaacagtaaatgacacagaaggatttgtctggtgaccttggggagacagcctgaccagagacgaaactggggacagaagagctagcagaggagcctctacagcaaccaggtctctggctggatggccagagaggaggagagccaaagactttaaggtcacaacagataggacgaggtcagttactggaaatgggaagaagcccaaggagcctgagatgactacgtttcctagctggggccaactgctagaggatggtgccacagcctcaccggagtgtgtacgttttgtgtgtgcttttaaaacccactgtttttaatttcaaagacaggcacaggcagtaactcaaattgctaatgcttgcaagcagaggtcctgcttggcctgctgtagtggctggttaaggcagatttgtgcttaacagcatctgtctgtacataaacaaccaaccaaagcttcaaggccttcagagtttgttcttaagttcatcaagaccttcactcgtttacattcccgagaggcttagcaaataacttcatagacagcacaaaggtaaactctgctggcgcccagaatgacttaccacaaatttatggagtctcacttaaccatggtttgtcttgtataatccgtgacccaataagcaactttgtttaaacgtcgaatctgttttctgccatgtggcccgggaacagtttgtgctgggggcgatttggagaaggaatcctgggccggcccagccgaccactcatctttaggtcactctggaaaactgcacattttggattaataaaaagaaaagtgcttcctccactgcctgagtgtcctctgggatgtgacaatagctgtgcaggagggagatgcctcaaccacaaacacacgaatactccttggatgactttctgttcccatgggaaaatccaataccctcgctgtcaagggaatcacagccacgacagaagtccacttggcggaccaagccttcttcaaccttttggggtctgctgtctaccatcatagccaagtcaatgtcatctttttaaattgaggtttttttgtttgttttgttttttaaaaaccatgcaacataaaagtaaccattctagtcctactctgaccatagagacaaacacaaaaccctgggagatggcagggcaacatgaaggaagaggctggctctgtggatgacccaccagccagaatgggtgacctgttgttatatgagaaataaactcctatctcatctgaggaataaaatgtaaccattttagggctggacatagtggctcacgcctgtaatcccagcactttgggaggtggaggcgggtggatcacttgaggtcaggagttcaagaccagcatggccaacatggtgaaaccccacctctactaaaaatacaaaaattagcagggcgtggtggcagatgcctgtaatcccagctacacgggaggctgaggcaggagaatcacttgaaactggaaggcgaaggttgcagtgagctgagatcatgccactgcactccagcctgggtgacagagtgagactgtcccacaccctccccccacctgccaaaaaaaaaaagaaaaagaaaaataagccattttaaagtgaacaattcagtggctatgttaaggtcatttggattaccgtgaaaacataactgctttatgtgtctctctcttttttcttttataaacaagtctctcctttaaaaaaattctgttgggatcacagaaattagatctggactgacatctcaatttcatctgagtcctgctccttcatttgacgatgcataatgaggtccagcgcaagttttgccaggttgcacagatagaggcaaaatccgcacctaaacctggatcttcttcgtgttttgaggcctggctctgccccgagcccttctcccccgtgagtctttcatccagggactgtgtaagtgactggcagacacaaccgaacagtgagatgagattctcaccctcaaggagctgtgacctaaggtagaggacagccagaaaaaaaaagcaggaaagaactacaccatcctcctacattcaacgcccagcatcccagctaccccattattttcgaggactggtcctcccagtgatttgtccaggtcatcaaggtatcaactttttaaaaaaattctagaagacagcaatctctctaaaatgtattacctgctctacatttttacacaatgcaaatgatcacaggacaatgcaatgaacacagctaaaccatttctcattagcctaaggacagtgtatgagtagccactcttggaacagcaccctgtgtctgctttttacatttatctgcttcttctgccaggctgtcagctacacttcctcaactaatatgttgcttctaatctgctatgaggttgagaacccagaaaattagaaatctgctctcatttcaaacaaaaaaaaaaaagaaactctgagagaaggaataaatcaggttgataacttggggtccagagtcacagcccacaaatagtttgtaagtaccttgacactatatgaagattacttcttccttttcttgaagaagttcaagactctaaaggcagagatacgatatactaataattcctactttcccatacaacctgcataagcaagtcaccacctcatcccttggaacctcagtcttctttaaaacctgggtccgacggtactgtctacctcacgggccactgggaatgaggtaccacgtctgggccataagggcaccgcccacagagcatcctccataaagggtaggaactctcccagagagtaaagcacatggcttatctgccaggacttttacataacattttttaggtgctagagggtcctttctgcctggatttttccctcacttgacacaggttttccattcaggctgccaggagtctctagaaaggtaggcggagtgttatgtcagtttccaagtcattaagcacccacaaaggagggcaggcttgcacagcactcactccacacaaccgcccctgccctgagtacgacggagcacatggcttccctaaagccacaaggagaagagaggcagggacagtgagagctgaaggaattccacatgtgtccatggaagatcaccttccctttgttttcctgcactctagtaactccctcatgcagcttgctttctgaagccctctgctccatttccccagcccaggacagcatcaagaaatatttccaccatctcatctatttgaaccttctccctatttactggtgctcccaaccccatctgaggccatcgaaaccagacaactgtggcagcactagcagagtccccaaactaccctgacaccctccctggcaaggaaaatttccacgcgcctctccctggcatatttattccagaggaaaacttagcaacctacacactacacacaggctctgtgtcaaactctacaacagccatcagttgatctttcccttacacatccctccaggaagtgaaatatccgaaatgagtcatactcaggagtcggagctatacttccactgtagtttttttggataaccaattcactgtttacactccaaaacctctaattgctgaacacagaacagttcctttgcagagatcaaagcttacctggtgaacctggcgaaatgacaaaaattctccaaaaggagttagccatccagagtgccagaggagggtggctgtacaagcacattttaattggcaaagcagagtcgctgcccagcaaggaagagtatgcaggggtttattctgctgctcttctatttcccctttaaggcatatatctcttacccctgcacccaccaactttagtcactcctagcacacagctggcggccgcccacccgcacccgcacctgcacccgcacctcagagagcttgctgatccctgagccgtgcactgaagcttccaagcagctctacctaaaggcaagcactgcctgctttttacaacatatacaatgggctaacctgatgcacagaaaaaccctgggtcacatgacaaccaacaaactcattgctcaggatggctctccgccacgtttctcaggcactgtgcttggctctgctggccaactgagtgagctggagcattttctcttgggtgtgcatacccctccacctgtccaactttaaaacacagaatcaacagggatgttacactaaaggggaccctagaaaccatataaacggtggaaaattgaggcctggactgacccataacaaatgagacatcacataatggcaaatgaaccatgaccagaaaacaaatctctttagtacacagtttagcgcttctgcttatacaggttgaacagccctaacccaaaaatccaaatcccaaactttttgagcgaagacatgaggctccaacgagcatatcagactttcggattaggaatggtcaaccagtaagttctgcaaatattcaaaatctgaaaagaatccaaagaagtctcaaatccaaaatgcttctggtcccaagcatttcggataagaaacctgtagtttaatcatcagtcaaaatttaagaatagagttgattttgggccgggcacggtggctcatgcctgtaatcccagcactttgggaggccaaggtgggtggagatcaggagatcaagaccatctggccgaggtcagcagatcaagaccatcctggctaacacggtgaaaccccgtctctactaaaaatacaaaaaatcagctgggcgtggtggcgggcgcctgtagtcccagctacttgggaggctgaggcaggagaatggcgtgaacccaggaggcggagcttgcagtgagccgagattgcaccactgcacaccagcctgggtgacagagtgagactccgtctcaaaaaataaaaaataaaaaataaaaaataaaaaaaaagaatacagttgattttatccaagaaaatactacttcgggctgcaagcaatggcttacacctgtaatcctagcactttgggaggcagaggtaggcagatcacttgaccccagtagttcaagaccagcctgggaaacacagcgagaccccgtctctacaaaaaactttttaaattagccaggtgtggtggtgcatgcctgtagtcccagctactcgggaggctggggcggaaagatcacctgaggttgaggctgcccagtctgcataacagaatgagatcctgtctcaaaaaaaaaaaaaaaaaaaaaaagaaaaaaaaagaaaatacgctttgactcttttgaataaaattctacattattagcattaacaatggcagtattaagaatatttatatattgtccagactgggcacactggctcacatttgtaatcccagcactttgggaggtcgaggtaggcagatcattgaggccaggagttcaagactagcctggagaacatggcaaaaccccatctccatccaaaatacaaaaattagccaggcgtggtggtgtatgcctgtagtcctagctacccaggaggctgaggtatgagaatcacttgaacctaggtggccgagtttgcagtgagctgagatagcaccaccgcactccagcctgggtgataaggtgagaccctctctcaaaaaaaatttgaaaaaaagaatacttatatattgtccagataattttatttttatttttaagtgaattgatctttattaagaatactaggtatccaaaaggcaaaccaatttcaaacgcaaaagggaaggaaactaacaactgctaagggtggcccggcatgggccaggcgctgcaccctgtgggtttcaggagagcctcacaacagctgcaggaggtggctcttgggtaccccagtttcacagataagtaaaatgaggccctgaagggttaggtgacttgccccagagcactgaatgacacagaaggacataacacaggtcccctcccatgcccaaacattctccaaagaatgttaaacactcccaatgaaataaaattaatttctaacgacttgtagggaacaacttgcaagctcacaaaatcagataggggcaatgagtctcttctcccgggatgaacaaattatggacaatgtcatctactaccaaattctgaaatctgtcaccgtggattacagacggtattctcacaaacactatccctggcaggtggatttgtcgaaaacaagaaagcctctcccacacagtttctctggttgacggtttcctggaccccttgagaagatctgcaaggcgccatcaccttgtgtctgatcattaatgtttcacagatgtctacagctgctgcctccacatgatcctggctggtttcatgtaacaagcgactaatccctgcactttgtcaactggcagttagacacataattatgggcaatcctgagacgtcttcaagggatgccgtacatgttgtccatttcccactcaatggcacgagaaattcaagaagcctttcacaaaagtggaagctgagtaaagcagggtgctcctgtcttccaaataacagttaaaagaaaaaacaattcagaaaaatgtcgaccacgtgttcactgacgaaggctaagaaaagtaaactccttttttcatagcagaagcagccaattcacataaaccaaacagatttataagatggcctagatgaaatctataatatttggacacaggtttactccaacaaaaccctgcacatggcttccaaagacatcggggagaagcttcagtccaacctgcaaacagcacaaacgggcatgtctggatgggaaagcaaaaaggtttaaaggatctggaaaaaacgaaggctccatcaatccaaatattttatctagaagggggtggtgctgcttttttgacttatgtccaaaaggaagcttgaggaaaagaacacagtgcttattgatccaacaaaccacttgggctatttcttccctgggctcttgggctccaatttcagatgcctgtgtgtgactcaatatggaagactctatcaaatctctatttgtccctgtcggccttccccatccagctcaagggtaactctattacagcaccacgctctacactgacaccatgggcccagcactgcagagcacaacagaattctgcaacaactggccctctggctcccctaaatagatcaccaaagttttaaacatattttagtgacagaaatgtacaatgcaacactctacccacccatgatacctttgcaaacttaacccaagacctgtcataacgttgccctcttccaattaatgtcaggacccactgggtagggagatgcctgaaacatgacatcctttgggcttcgattttccagaccaaagacagagtccttgaaggtctgcagctggcagaaagaccttggaagtaagacagacaagagttcaaagcccatactcgccatttcctagcaattaaggtctgaataattccttcacctctctgagcctcgattccttcatctgtttagcggcaataataatcaaacctatcttacagggttattttgagaacaatatcacaaaatatgtgtaaagaaagtagcatagttcctaaaacaacaaatattcaattaaataaaaaaaaaacaaaaacaggcattggctgggcatggtggctcacatctataatcctagcactttgggaagctgaggcaagaggacagcttgaggccaggagtttgagaccaacctgaccaacagagtaagccttttttttttttaagggttaaaaaaatacaaaacaggtattatcaccatcttcttatacagaacttcatttcagaaaacataagattataatgtttctagccaacgcagtggctcatgcctggaaccccagcactttgggaggccgaaatgggaggatcacttgagcctaggagttcaaaccagcttgggcaacacggtaaaaccccgtctctacaaaaaatacaaaaattaactgggcatgcctgtagtcccagctatttgggaggctgaggtgggaggacagattgagcctgggaggtcgtggctgcagtgagccacgattgtgccactgcactccagcctgggggacaaaacacccaaaaggcaggagagtgggtagccacagaacaaggggcctgataatcaagtcagtcaaaaagttttttttttcctttctgtctcaaaggaaaaaaaaaaacacactcattataatatggaattaaacatatacacgcacactctcacttatgtaagttaacattccctaaaggcatgagagtgggtagccccggaacatggggcctgaaaatcaaatcagtcaaggccgctcctttttggttcttttgggtaagccaaaatgatctttactagtggaaacattattcctccatcaacagacaagtttcctgagagctggtgaacatcttgccaacaagacatatttcgcaagctcaaaacctttctttccatccccaatcaaacgctgagtgttatgtctcaagaagaaagctggctgaggaaggagcttaacatccttccatgagcaaaaagaattaaagaaagggaagcaacaagttccagttccaaaatagctttttgataactaggaactaagcccagccctggacagtattactgactctcaccaccacctaaagcaggctctgccaaacacagcacaacaaccaactgctactaacaactttcactaagcaggtagtgcacggcaggcgctgacttagggcttaaaacacagctataatagtaatagctaaaacttattaagccattcttctaagtgctttatatgccaatatctcatgtaatcttaaaaatgaaccaaggagttaagtgccagtatcagtctcagatgcagaaactgaggtacggagagagtggtgagcttacacatttaaatggatggcagagctggggttcaaaggcaggtgcatctgaccccagaacctgtgtgcctactcaatactccacagagcccagcagctgggccacctgtgctaagaaccactgccatctctttgttttaaagtctccaaaagaagaggagcgggttatttagcacctacttttgcacagttgagtcacaagtgaggaaggcagcaccgctctctagttaaggatacaggttggaaagcaagattgtctgcattcaaatcctgactccaccgggtcccagctgtgtgaccttggacaagtcactaaactcttctgagcctcgagttcccccatctataaatgagggtagtaacacagtagtcaccccttatctgcagttttgttttttggcagtttcagttacctgtggtcaaccatggtctgaaaatactaagtggaaaattccacaaacaatttggaagttttaaatttcacgccgttctgcgtgatgaaatctcatgccttcccactccatcctgcctgggacatgaatcatctttttgtcccgcgtatccacactgtacaagctatgtacccgttagtcactcaggagccagctcggttctcagatccactgtcatggtgtcacagtgcttgcgttcaagttacccttattttgcttcataatggccctaaaacacaagagtagtgatgccagcaattcagatatgccgaagtgaagacaaaagggcttctttaagtgcaatttctcaatttaataaaggaagggaaaaactatatgcggagactaagatctatggtaagaatgagtcttctatctaaaattttgaaggaaaagaaatttgtgctagttttgctgtcacacctcaatgcaaagcatatagggttcgatattatctgtggtttcaggcatccaatgggggtcttggagtatatcccccatagctaaggagggacaactgctatacatacattatactgttattttaaggattatgtgggggtaatcctcattcagcatctggcacatacctgggacatagtcactgctccataaattctacatgttaagtcaacagaaaagaggaagaaacaagaaagtaaaagcatataatctaacaatttcacaacaaaggcctcgctggccttctgccaacctccagaaaacagtgctggactctgtgtacccgcagtgtggctgggactgcagacaccaggaagaccttgggacctgtggagcctggatggttcagttgtctgagccaaggagggctggattaggctcagtgatcgaagctgagcaagtttcagcacatacctctacaaagtggacgcccagggatggctgatatgatgattctttaggaagccaaatgctcagtttctcagaaaggtgttttcctgtttcatgacagataaaaaggtttctcatccagacaaataaatctgctgactgagagctttcattaaaagcaaacagtcttgcaataaggaaccgtaagctaggaaggccttccatgaatatatgaaatgtcacaagtcctcagcctgtgtctgagagtgagagagggagaaatttgagaaggtgctgaccagctcaaagactgggatatcataaccctaacaacatccagtcagtacattcctcacctacaaacgaaaatcacaggcaaggccacgcaccgctgagtcccaggagacacaccttcccaaataagtgtttgggtgggttgctgttaacttccaataaagcagataaatgtcatcaattgcttcctgtcttcaggtcttgtcaatacagaatgctaagtccgctagcctcgaaagcctgtgtaccttccacagtcttaaagacttgatgggaaactggaaaagcaatcaggaacagaacaccatgggcacgagactcattccaggtactgtcacagcaagatacccttctagtattccaaagctaggaacacacctccccttgctcccgccagcccagggaaaccgaataagctgtttaccagggaccccagcaaagcgagcctcaaaactcaccagtgggagaacttcatgacacaaagagaaaacattgttgctttcatttgccaatttttaaatacttagctcataagttctgtgaccaaaactaatagaaggctcgggaggagagctcggaaaagcagagggggttgttttcctaggctccttcctctaacacgaaggtggaaatcaattcgctttccccttctaacccttgaatccctggagaacgatcgtatttggatggcctacgaatgctcagctttccagtagtgccccagacgaggaatccatccatccaagtattgttcttacctcccactacctcctacgtcaggggaggggaccgggcacatggttccgaggtcatgctcctcacttagaggatcgtgggaatgcttacggaaacacttgtcacggcgctgccagctggaatcgctgcttaagaagaggctggaaaactagggagtgcgcgatcagagacgggaggctggggagagcagggaggcagatgttgtgtgttatcactgaaacaaacacaagccatccagttgtgcacttcagctacgtgcggcttagcgtacttcgataatgcctccagaaagtcagggaaaggaaatacagaggaagctgggcctctcttctaccacctcgaaactgtcctgctgccaaacagatctgggaaagcaggttttaatgagaaaattcaattaagaaataaacttaagtaaccccatagcatgctgagtgaagagaggagcctttctcaagtgtcttagtgccgaggagtggaccaaggggctctgaaaaatgaccaatgaggcttcccgccactcagaggaagccaagctcagaaaggccacgaagaccatcctcgcttaagcgcggggccagattccaaggccaggtctgctccgcctcatccatttcttgtgctgcttcccagtgagactcagcagaggacacacgaggccacatgaggtactcacatcaggatctcagctctctaacacagggaggggtgcaacgaaggcaaggacacaggtgctgtgcgtgactccccaccggggccggcgggcactgggtggctcagagatcattaggaacggtcgctccctccctttctcctggtttcccttctgtcctctgatagaggaaagtggcttagatcattctcacaggaagattaaatccagagcaagggaaagggataggaatccgtttccaatcaatgatggaaaccagattccctcatcagttgggattcattcttacatgttgtaaacatcacagagctccacccatggctacaagcgttcaggaggtatgaagcatggtggcacatcctgggtgagagctgcctgtggccaagaagcctcccggcttgggctggcccatctgagggacaggaagcaacacgtctcttggaagttatccccaaaactcccatctcagaaaggtgagataaagcacaagactgtcccactcttgtaaatgttctatatttacaggaataaagttttaaaaccatcttagacaactataacctccttcctgtagaacatacccatgtacatttgtactcatatgggaaaatatggtatcaattattaatagtaaagtatttgaattaaaggtcttttgttcttgaagaaccacgggatctcagtttcagtggccttggagtcccacttcccccgtatgaaatccctaaagcactaggtgttttgacccctgcttgatcttgactatggggaaaatgcaccatgtccccagtcagcctgtgtcacgcggtgctggctgtttggcagctctgccttacactgcagcctccagcacagagagtcctctgtccagaaccacctcaaggatgtgcaagttctctgccacatggcatccctcagacacctgaagtgagccatctcagcctccctccaagcagcttccctcccggctgacactcccagctctgctgtgtcctgcacatggcacgcttccgagaccactcgccctcggctgtcccctggggttcatgccactggatcactgggtgcttaataggcgccaaccatttcagaaaccacctcttattcccgtgagagcaacccctgcaagtattctgttttggttttgtttgtgctttttctttttgcaggaatcaaggccctaacatccagaacctcagcagtctctctggctgccatccacatcatctgcccagacacaaagagagcgggacaggaccacagcgtggccaggtgggggtgctaccggttttccctacagctgacgtaaaatacatatattactgcaaatctaataacctgcttagaaagcacttcaaggcagaaccattcaggaaataccttaatacaaaatacctttgtttttcttttctttttgtttttctgaagcagggtcttgcttgcataccaccatgtctggttaatttttgtactttttggagagacggggtttcaccatgttacccgggctggtcttaaactcctgggctcaagcgatccacctgtctcagccttccaaagtgctgggattacaggtgtgagccatgcacccggcccataaaatacacctttgtaatgaatatgtgagaaatagatactggaagagatgatgtaaaaacaattttttatttttatttaatctctcttatgcagattaagcatttcccctgaaatccaaccctcacagctcagtccaaacttttcctcaccgtgaaaaggtgaactccagaccagcctaaggccaaccgttctgaatggcaaccactagattcaaagcaaggtgctgtgatgttgctaggtgtttggtttgtgctcctatgaccagtgtggggggaagggacttgggcagacatccaagctgaggtcccctgggcagagtgactcagaattagtgtctggataggcatccgtgcacccaacgctactgacttactccagttcatcctgaagacagactattacagtaaaagccatgttttaaaaaagttatagctgctaggccgggcgcggtggctcacgcctgtaatcccagcactttgggaggccgaggagggcagatcacaaagtcaggagatcgagaccaccttggctaacatggtgaaaccccgtctctactaaaaatacaaacaattagccaggtgtggtggcgggtgcctgtggtcccagctactcgggagactgaggcaggagaatggcgtgaacccgggaggcggagcttgcagtgagctgagatcgtgccactgcactccagcctgggcgacagagtgagactccatctcaaaacaaaaaacaaaaaacaaaaaacaaaacagttatagctgctaaaaccttatgcagaaagtccacgaaatttgaaaatatacatcatataaacgtaagcaaggctgaaaacacgtgaatcccagttagctcaccctgcattcctgcccatgcagctcgtgacccagctacagccttgggtctgtactctccctgcagtcagaggatggggacaggtggcacactgctggcctgagcacaacaggagtccgtttgcttggggacatttcttggaaataaagtaagtataagggtgtactcaggaacactgcattttatctgggactcggctttgttgcccagcccagcacagggaaagaggagttttaaagtgtttcagaggaagaaagagaaaaccttgttggcctcaggggagtgaggtatagcacactcattcagcttcatttactgagtacctacctagtatacacagcagggcatgttcacccctttttttgcataacaacatacacccagggtggctccagtatactcagaactacggaactgaagaagcatcacatcacatctttcccaagtgatgctgggtggggtccccagtgtagaaggcagacagagaaaaaaaaaaaaaacagcagcaccaagcggctcaaaagctcaggagaggccgggcacagtggctcatgcctataatcccagcactttgggaggccgaggcgggcagatcacctaaggtcaggagttcgagaccagcctggcaaacatggcaaaaccccatctctaccaaaagtacaaaaattagctgggcgtggtggtggatgccttgtaatcccagctacttgggaggctgaagcaggagaattgcttgaaccggggaggcggaggttgcagtgcgctgagattgtgccactgcactccagcctgggcgacagagcaagactctgtctccaaaaaaaaaaaaaaaaaaagcacaggagaggtatccacagcccttaaaaagcatcagtgatagctccaaatgctgaaagatgaagggctctgtcatctttaaaccctgtttgtgatttccagtttcaatgagcctgttacattattactgtaatcctaaaaaaaaggctcacaaattttttaactgacaattttcaaaaaacaaaagtcagtgcttagtcctgttgtttacatcgggtacactattagaatctggctttcagaatggagagacccagactgctcatgacaattacaccagaggatctgattcaaactgattcgagctggggagtgggggggcgtggagtgagcaggagcagctgaaacaacgctgggcacggaggataactgctgaagttgagtgacagataattgggggctcattatatcacgtgcttgaaattctctgtaacaaaaagttctctgaatttaaatcaggcaacactaacttaaagttcccttacggtaaggcctggttgccacctactcctaggctcttgcaagctttaaggccagtatgagtcgaatgtttactggacattaggcagttttctcacactcacactcgcactcggtccaggaaagccctcccggggcagggggccaaacgaaaccctaaatgcagctttgtagcagcccagctgctctgaaggactgaaaaacacagggtcctcaaaaatcaccaaaaaaccctttggcttggacagcttttccttccctggcttcctgtaaagatgccgcaggctccctagaatctccaactccggtttgtttttaggaaagttccgttgctcctgccttcagcttggctgcctactccacgttacacaaatacacctcctctgtgcggcgcaaacaacctctacgccagtggtgctgaaggaggccttcgctacttgcatccatcctatcagcgtccagaggagtgaacacgtagatgtctatcactgacttcatacccttcccccaacaaaaaaaccttaaaatcataattacatccttctctacaatgacctttcttacttttataacaggattttaaaaatccattcctggccaggagtggtagttcacgcctgtaatcacagcactttgtgaggccaagctgggaggatggcttgagcccaggacttccgagaccagcctgggcaacatactgagatcccatctctacaaaaaaaaaaaatacaaaaaaattagccaggcatggtagcgcgtgcctgtagtcccagctactcgggaggctgaggcagaaggatcacctgagcctgggaggtcaaagcttcagtgagctatgatcacaccactgtactctagcctgggcaacagagaaagaccctatctcaaaaaaataaaaataaaagataaaaatccattcctttttttaaaataagacactgtataatattaatatagccacggcagcaccactggacttacggcctggctttagggagacctcagactgttgacgtcagtttctggtccacagctgccttggaaacctccctgagccaaaattaaaacaacagctttctctcagggtatgcttaagttattgttgttgttgttgttgttttaaaaagaaaaaaagacaacaggtttgatgtgacactcagtgtctccggtgtgccaggcactgtgtcaggtactttacaaacaaggaaagcaaggcacagagaggccaggtcacctgggcaaggccgcctggcagatgctgtgtgtggccgcagagtgaggcatgtcccagactcagccttcctcaccaagagggactcaaagccttctggggcactctgtgatgaaagctatgggctctctccccagggagtgcacacacacaaaagtctgaatgaaatatctggtgggttcatagtgcccctctgttccccaaacgtcccctctggttaaaaaaactctattcaggtgaaaccctgtctctactaaaaatacaaaaattagccgggcgtggcggagcacgcctgtaatcccagctactcagggggctgaggcaggagaattgcttgaacctgggaggcagaggttgcagggagcagagataatgccactgcactccagccggggcaacagagccagactccgtctcaaggaaaaaaaaaaattctattcagattttcatcaatgaagagcttcagcaggagtgtctcccatagaaagaggcaggtgtgtctctggcctcaatccctctctctcctgaggtgtacatggccccagggcttgcccctccatcagtctgcaacaccccccagccctgaggtctcagacacccagctgccacctccccaccctgtgacaacttgggcttgtatcttattaaaacactctagggtccaaccctcttaaaacaatgaaaacattttctcactcatataaacaaacaaacctttactgaaaactaatgacgaacacaaagggactatttacagaaaacagcgtgcctagccccatctagattataaacataactgcacactggctctaaggaccctgccatcttcccaggccctggcctggctgttctgccactccccacctcatgcctgaaactgacacaaaggaaccaatcctccagccaaagtaagcaattacaacgtgtagctgaaattcagagaggtgatctaaaaagcaattttgtaagatagctccaaattgggaagaaaacaaatttttgtattttatttttatttttgagatggaatctcactctgttgcccaggctggagtgaagtggcgcaatcctggctcactgcaacctccacctcccaggttcaagcgattctcttgcctcagcctcccaagcagctgggactacaggcgcctgccactacacccagctaatttttgtatttttagtagagacgggatctcaccacgttggccaggctggtattgaactcctaatctccagtgatctgcccgcctcggcctcccaaagtgctgggtttataggtgtaagccaccacgcctggcctttttaaaatttttttgacccacgagatctttgacacaaagatatccatttcagcattatttatgatagcaaaaagtgaaaacagccttcatgtccaacatgagtaaattaaggtacaactgtaagatgaagcactgtacgatcactaacaggaagtttgcaaaggtgttttaagcaagtgggaataagacttatgtgacccaataggaaaaagcaggatgcaaatttcagagccatattttaaaaatgtgctcagaagactcgaacaaaaacccaccaaaaaagcaaaagttgtttcatccatgagggggaattttgagtgacttttttttttttaattctctttatacattttggcattttccaagagtaaaacatgcactttccccgctttgccctttccttctgattataaatggaacataggctctctgtaggaaattcaaagcattacagaaagtgaaacatccccctgtgatctcaccacctagagactccccaaaggtaactgccaataataacttggttcccattcttccagatgttttccaacagggattacttttagaatcaaataatttctctaaaaaataatccgcatgattccatacatatgaaatggccagacagaaagtgaatggtgagctggggcaggagtgggcatgaagaataactgcaaatggatgcaggaggtgttctgggggtgatggaaatgttccaaaattggattgtggttatggatgcacaactctgtaaatttcctaaaaatgtacaaaaccgcactgtacacttaaagctggggaatcttatatgtaaatcagatctcaataaagcagctgaaaaaagaacaaaacaaccactagaggcagggagtgctgggctgtgcaggagggcagtccatggctttatgctctgccctcaagagcacatggtaagaccctgtagcaggaacagaggaagctggaggcctctcggcatcacctggacaaacagccctcggcagagaggctcaacagataacctgagagcggcagggtcagcgaggtcagttccagtctacacgggaggcaggaagagcgccagccctgaaaatgcattcctgaggctcaggctgcactgccaggctcgctttaaagccaggccaaaggaaaacagcactggccggggtgtccaaatactttaccaagttcaggatgcactgcgtgcaggaaaactgagaccatttttctctgtttcaacagaaacttgaaaaccacccctgacaacatgttagtccctggaagtactcaattacggtgaaaagccatcggcaaaagttaaagtgagtaatatgacagtgagccatgtaagaagtaaaggtgagtggaagattatgaactacataaaaggcacaatgatctgagtctagaaaggcaatctggaagcctgaaaaggtacaaatgggtgcaattctcttagaaagtaatgggcaagtaaatgtcaaaagcgtttaaaatattcataacctcctaggaatctaccctaatgaaaccactcaagctgatgaacaaagatgcccactgctctacccactgctccacggcaaaaaaaactggaaataatctcccccaacaacagggaagtgatcatctactgtgtaacccttacaattgcacagtgttaaaaacgtgggaaaatgttttatgtttaattagcgaaactgaatataaaaatttactatcaagtgagtaaaaaaatgcccaaatcctggaaatgatatataaaaacgttaacagtgtttttctttaggtggaaagattgattttttcccctcctttcatatgtatttagtgaactccaagttttttccatcacatgatttcagtctctaaaaatccgtgatccatcacgccaactggattttgtcaattttaccctctatggtttgtactgtgcaaaactaggcttcactttattttccaaacaaaaaatactattactgagtatgttttctcaaattaccaccccactgcccaaaaaatgacacctgccacactcaagattatggtggcccccaggaggtgtgcccatcccagccctcactgggtgcaagctctctctttcttctatcatccttctgcagagaaggattttgtaattgttgttgctttgttttaaagtgggaaagaaaaatattgacgaacttaaaactcgacatagacagagacattgggcagcaccagacctaatcttttttttttttttttttttttttgagatggagtctcactctattcaagcaattctcctgtctcagcctcctgagcagctgggattacaggcacgctccaccacatccagctaattttttttttttttttttttggatttttagtagagatggggtttcaccatgttggccaggctggtctcaaactcctgacctcgggtgatctgcccacctcggcctcctaaagtgctgggattataggcgagagccactgcacctggcccagacctaatctttgagggaactcagcatcatcatagaaggctgaaaccacaagatctattttttgtgccttcctaagagtgttgtgtgcatgcagcaatccagcgaaatggtgagttgcacagatacacctgggggatgccagcctaagatcagggccagggtggcacagcagcaccctgggagctggtggaggagggcacggctcactgacgccatccgacccagccccagcagctcgcaggccacactgctcctctccgcctcggtggccttgccagaatgctgggcctctctgatgcactggtactatctaagcaatcggcaactaacagtagtgaaagcgtagttcattttaggtttaagaattagaacaggctcaatgttgctctctaatcacaccctcactcccctgcactctaataagcttccgtcagtgtgaagaaaagagggcggagggagggcttactcgagggaactgtgaaacacactcccccaggagtgggtggagctcaggacacctctcaggcctggcacaggtgggcttttctttcggaggaaaattaagtagtagccagtcaacctatcagccaactgcgcatcaaggggccacagtctataggatgggaagccaaaatatctccaagcaagaagggtggtgcgccgctgcgcacatcccaaatacccgcttctctccaggcactgcccacccatgagggactttcccttttccaagtggcagagctccactcctggctgtcaaccactgtgaatgggacatctcctctcctcctcccttccaccctttcgggagagcatttgattaatatttttctacttttgttgccccaagttgaggagtgtttagagatggaaaataatacattacttccctctctgacaaccgccttaatccacaaagcccagaggtaaaaactcacaagctgtttcttctctgaaccgcagaaacaaacctggttgcagttggggcactgtggaccagagaaagatgcagtgtttcatcattacctacccatgataaatgctgtaggggttttttcttattcaactgcagatgattcacattagaagctgcctggtgaccagactaactttcctccctacttgggcaaaaagttgtcacctagccaacacatttcctgggggtagactgtgccttgtggattccatcagctttgctatttacttctcccttcaccctggcagttaacatttcaaccctgatggccacggccacctgttgctcctcctcccccctcagatctaaagtgcgtgtcacctttctaggttctgggtcacatcttctgggctggccaaggcctgggcgagagaaccctgtatcctggaactgcctgggcattggaggaggtgatgggttaataacaatcgttttgcaggcaggggaggcgagggggcaagaggaagtggaaacatgacgtgactagggacgctgccccaggctgctcgctgcccgctcctgacttctcccatctggtttccatctgacccaagcagctggccagatggttttcatttgcagatgaaaccccagcagttccattgccacaaaaactcctgaccgtagagtctctgtaaggctgataacgcacaaagtgcactgcggtgtctctgagcaggcctgaaaggtcatgcttcccaaagccggaaccaggacaacaggaacaaagtggggtcttgacacttgaaaattccgatgacagccagaagaggaaatgcactggcctggcgagatgcgagtcacggtcaggcatggagctgaggaacggggaagattttgccagtgaatcagaccttgtctctatgccatccactagcatccttaaggtgaggaaagaaccagcaggtctcagggtgaaccatggtatgtccactcagtggaacagtacgaaacagctaaacccaggttcgtaaagaaaatgtaggctggactggctgggggctgtggcccacacctgtaatctcggcactttgggaagctgagacgggcagatcacttgagatcaggagttcgagaccagcctggctgacacggcaaaactctgtctctactaaaaacacaaaaattagctgggcgtggtgcgtgcctacagtcccatctacttgagaggctgaggcatgagaaaccttgaacctaagaggcagaggttgcagtgagccaagatcatgccactgcactctagcctggttgacagagcaagagtctgtctcaaaaaaaaaaaaaaaaagagagagacagagagaaagaaagaaagagagcgagagaaagagaaagaaaaaaatataggctgggcacagtagctcacgcctgttatcccagcactttgaggggctgagtcaggagaatcgatttgagcccaggagtttgagatcagcctgggcaacataaggagactctgtctctacaaataattaaaaaattagccaggcatgatgttgcgcacccgtagtcccacttactcacaggaggctgaggtgggaggactgcttgagcccaggaggtgggggctgcagtgagcaggaattgtaccattgcactccaacctgggcaacagagcaagaccctgtctccaaaaaaaaaaaaaaaaaaaaaaaaagaaaagaaaagaaaagaagaaaaaatgtagtaatacaatacatggaaatagtgataatgcaggctgagtattagttttccttatctgaaatgctggggacctgaagtgttttggattttgaattttttccaattttgaaatacttgcattatacttactggttgagaatcccaaatcagaaaatccaaaatccatgtcccaaagaacatttcctttgagcctcatgtcagtgctcacaaagttttgggttttggagcattctgggttttaaattttcacattagggatactcagcctgtaagagtgtgtcaggcactgttttaggcatgtaaaatgtgtcaactcaatcttcatagcatgcctgtaagacagcttatgttattaatcctacttcatagatgaggggactgaggtagggagaggttaaggagcttaccaaatatcacacaggtaataagtggcagagctggaagcctggttccagagacccaggtgaatcccaaaaaagagaagctgggcacaaggccccagggaagcaaaaacctgaaaaactatcctttcacacttgtgcagggtcagttgatgttaggcttgtattgcaaaatttatacttctgaagaaggataaagcagcaagagggaaaaagtatctaaaatgcagacacatataccacatttgttttggaaaagacaagtcaggagcccacaaaaggttatgaaaaaccccagtgacaccaccaccaatgtttgtctttggaataatggaaagagatgtgtattacttgtaagaatgatctctgctattacatgactcattcctgcatgcaaggactgctctcatctggtgccaaggaaagactgctgaattatggaattgcaaacattatcactgactgttactcacaacactgcagggcaaactgatatgcgccaaatcagccatgttaaggggttgttattgcacctctcctcaggaccagctgttgctatttcgcattaagactttaaccatatcttagtccaagaactcatcaacctcagcagttgagttgcttggaaatgcccagggtccacacaagttccccaggggaacccaccatgggtctggggactggagtcatgggacaaaaaggggaatggtagaggcagagaacagaaacagggaacggaaacaacagataaaaggaaatcactgacacagatggcatgcaaaaggcctttcagagtggaaatggacaatcccgaaattggcaacatatgatgtgctctttattcctgctccccaccggcatgtggtagaaggatgcagaggaaaggacggtaatgggtaagataatatgaataccaccctacaggcacgtgtcatctaggagcctaccgagtgtcccaccttagtgatctgaccctcagacaaaactgagagggagacgccaccatccccaccctgcagatgggagacagaggctctggggagtggtccccagaaacatgtggctactcagagacaaggctaggaccagggggtgatcactttccacatggacagtgtggaaatatcagccaataatgtgtcctctaatctatttattatggcctccacctctctgatgactttaaagtgcctcaccctcaacatagctgaaaccgaactaggtttgccccaccgaaacctagcagttatcatgcagataacagctaacatttactgagcatttattatgtgccaataataatgctatgaagcaattttactgtttattattgtaatttactgtttattattgtaattattattttattatttctctccacccaagtaccaaccctcccccactttgtccaagagaccacagtgattgccctacacctgccccaacccatcctctctgcacatctgggtcagggcaagctttccaagacttacctggccagtcctcactgcccaccccctgcagtcctcttacctgatcatccctccatccctctccatcccatgtcccagcctgctcctgcccccgactcagctccttcctgccaggcttctgcatgtactattccttctgcctggactgccaccccctcagctcaagcctgctcccccgcaacggctctagggcagcatctccctccagatgccatgaccccgtagttgttgatcattgcccccactgggacataggctccaggggagcaaaggaagaggctgttcttggtcgcctctgtactgcccgagtccggcacagtggtcggctcatagccaatgaataaacattcccggaacaattctatgactctcaaattagcctgagcaccaaaaagaggagcagggtctgagttgtgggctgagctatcctggtgccaaggcaggccttccactgccacgtacacaccctgaaggcagagtcagcacgcccaaatcctgtggggcctgatggtgaccactcaagctcggacaaaccccaagtgtgatctcactggaatccatgtcaacgcccaagtcctcaactccagcagaaactccccatctgttcctctgctctcctctccaccacactgccctcctgccactggaccctcaccactcccctccaagccccaccttcggcagtcagaataatttctttcttttttttttttttttttgtctttttttgagatggagtctcactctgtcgcccaggctagaatgcagtggagcgctcttggctcactgcaacctctgcctcctgagttcaagcgattcacctgcctcagtctcccaaatggctgggattataggcacctgtcaccatgcccaactaattttttttatttttagtagacatacagtttcaccatgctggccaggctggtctcgaactcctgacctcaggtgatccacctgcctcagcctcccaaagcactgggattagaggcgtgagccaccgtgcctggctggcagtcagaataatttattttaacataaataaagtcatcgcccagattgacaccttccagcttcttgtgactgttagacttacaacctggcatacaggcccggtgtcaccgggcccctgtgctactgataactaacagcacgtcttttattctatttttttgttttgtttttttgagttggggtctcactttgtcgcctaggctggagtgcagtggcacaatctcggctcactgcagcctccacctcccaggttcaagcagttctcccacctcagcctcctgagtacctgggattacaggggcgcaccaccacgccagctaatttttgtatttttagtagagacggcgtttcaccatgttggccaggctggactcgaactcctgacctcaggtgatctacctgcctcggcctcccaaagtgctgtgactacaggcgtgagccactgcccctggccaccagcgcctctttctatgtctcaacctgggaagccttgtacccgtggccccttccttgtcttctcctcccacctggaaggcctctctctccttctaggtcttccctgtcacctgacttcacaacacatctcacaactcaaaatgactgtgtttgtatcacaatcacaatctgtcccgcccagaatagcaggggctttgtcttgttcaccatccctgtgaatatttgctgaatccaccccttttactatgtgaatagtgaacaattactgagcccttgctgggggctaggcagtgaaatgcacattagatgcattaactcatcccctggtagacatccctactgccattttacagatgaaaatgaggaacaaagaagctaaggactggggccacttgggactcacgcccaggcagccagctgcagcgtctgcaatttcaaccctcccctaagtgcgctgcctcctggagttgtagaaggctacagactcatcccccagagtggccagggctcctggagggcaggcatcacatcttaggtttctccaggctcaggccctccaacaggaggtcctgaataaaagctcaggaataactgcagttcaaggaagccttggctagaaaaccctacaataaaaggcaggcaagactggccatgagtagcgccatccctgcagtgctgataattcacacctgcactcacaggtaggctaaggcagtccctcaggtgggctgaagaatgaaatgctggccacgtaagatgtaaaccccaaagagcaagtttgtcccatcaggtcccctatgttaccccataatatctgcatcctgatctttaaaactcttttccagagaaagtcaagcaaatgatatttggagggctttcctgctgcttttattttggaaagttatataagagtcctaagagtcactcctgagcgcttagagtagtggcacatttatgcacattcctcacttggtccttacaacaaccctctgagtcacacacgatcatcccaaatgacaattgtggaaaccgaggctcagtgacctgagggacttgcctagggccacagagctgccaagcaggaaatctaggctgcctgagtgcaagctcgcagtctgtactgtaatgccaaaggcttcactaactcatttcagaaagcaattgtcacgatcttctctaaactattaatacttacaaatactcattcaaggagtagagcttagaggctgtgaggcaaaggcagaaccatttctgggtgacacatcagaaaattactgttccgttcatctaaatgatgtttaaaatgcccactgcagcatgaaagtgcctctgctgagaaactgcagacatcagcaggagccataaaggaaagataaactcttggtaaagggaaggaagaggggctgagtgggtgagttacagctgaattcacaggacaccggtcccgcaaagaggaagccaaattgcagtccaagcagccaggatgcggagggcccggagggcttggaaccctgcaggcagcctggctgtggagacagagcaggacaagctctgagacacccccaggagtggcagacagagacaattcatgcctcccgtcccgggagcaggcaagggttcctgggttaaggggaaacaaaggggtccatctaaaaaatatgaaaggcctggctgtgctgagtgtgggtgaataaggtggagtatggttaacaaaacgattccacatcagcaaatgctaacacagggctcctgggatcccatagagagagagtctatttccatttttatttcttaactcaaaaaataaaattaaactttactttctagaagaggacgatgagagaagatcgctgggtggccacgtgatggataagacatgcaggcctcccttgctggtccccactggcctcattaaggctgggactattatttctcaacacacatggtctgtcctgtcacacgctagtggtttccaacaagcgggatgcccacagcaagtgccctccaatccgtcacagtccctgccgcatcttgggtctcttgacctggcctatttactcttatctaccagccactgtgggcctttggatttgcatcctgcttgataaaaatcactgaggagctacaaagagatgagattggccctgacgccaattgtcactcatctcaggtccttccaaaagagctggcagactcagaggtccatggacactgccacatccagtaccacaggctacaacacatacacttcctttctaagccatgaataggtcacaatctcaagcaagttatatacacaggaaaaacaagggccagtttcctacattttataagattcttatatgcaaggctcttgtttatttgtttttcagaccaagtctcactctgttgcccagggtggagtgcagtggcacgatctcagctctgcaacctctgcctcctgggttcaagcggttctcctgcctcagcctcccaagtagctgggactacaggcgcgcaccatcatgtctggctaatttttgcatttttggtagagatggagttttgccatgttggccaggctggccttgaactcctggcctcaagtgatgtgcctgccttggcctcccaaagtgctgaaattacaggtgtgaaccaccaggcccggtccacaaggctcataattttaagggcaaccaacaatctgctgctatagtaaacagaacacattgaagagagaagcaagagctttgagaagtaaacaaaagaaattttaaaataatctgaatactaatgacacctctaagaagagggtcaggtgcaaatccaagccaggatcaggtattccattggaaactagttttttaaaaaaataaatcccacaagataatctctggtttcacacagagactggtatacaacaggaccatctttccagcgttagcctcaatatcccagtcttgggttcccttcaacgtaggtgttcttggttcatcgactgcctcacatggaatgcagaactatccccctacccatgcacgattcccccgtacagaaaaaaattcagagcaagaatactccagcccacagacccagcctgtctttaaggatcagaccatcccacaacgtgacatcctcgaacagactatttcactggggctgcccatggagtctatttgggaaaggcaaacagagcggccgatggcaggggctgctcagatcacaggaatcccaaacctaacaaaaacccaataatgttataaagggagaagggaagatgatgcttaaatctcaaacacaacttcagcaaaaggtattgttgcatgggtcatctgtattcctccaggacagaagatggtaagagcactaataaaggtcattatactcatttgagcagggcactcttgaagattttcatccaggaaatggaccagcattccaaactattacttagagattagctctgtgtgtgttggagggtagcctaaagggttagggttaaccccagaaaggcaggaagttccagaaaaaaggcagtcattctacccaagtcttgttggaactaaagcacagcgggaaaagcgagcaaaccaaaggggaattagagacactcacaaagggaggggccttgggattaatggactctctaatttttgaatttcctgaggtttacggctgattaggccccttagccatactgtaatgtgatcaaatttcaactgggttcacagcacagttgaaggtagaagatgacacagacatcaccagtgggccccagagactacagacaaggtccgcagtgctcgcttccgggcttgatcgcactaattaggcacctttaattccccaaacaatggcgcacaggctggctcagagggcactgtgtgatccaccgcatgcttgaggagctcttacaatactatgtactgataattctctaatttggtacaagcatatttaagcacatggctcaaaggtggagagaaatgacattgcaacccgcaaacacatatgcacaaaaatattcaactttgccaagtgaagacatacaagtgaaaaatgagggacgatgtactgctgactaaattagaaattaagggagaaaagcgcccagtgttaacaaagaagcaataacctgatgctcacactgcggacggtgttatgaatcggcctgacactttggaaagcaacttggcagaatttgtcaagagctgtaaaagtgttcatactgtggcacggtaacgttactcctgggaatccaaacacagaaaccacttcagaaggaccagtcactgtgacatcgcttataaggaaaaaaaagaaaaacaacaacaactggaaaaaacctaaagggcaacatcagggaagttacccccctgccatctgatgtttaaggagtaaacagccagtaagcaatgatggttgtaaggacttcctgataatgtgggaaaagtcttaggtcataataatttttaaaaaggaagatgaataattatatgtagcctatgaccacaactaatcaaaaacctcatgtatataagaaataaaaggagttgccaaaaaaaaaaaaaaaaacactaaactggtgcaagtgacttttttccttctgtgatctgagctttccacaatgatgctttattaagttgaactacatgaaattgccaacacacagccatttctgacctacacaagtggcactttcacatgggtcaacataatattttttgaaagttttaatacttttatgaaagtatttttatgaaagctttaatacttttatgaaagtatttatccaagttttgttttgttttgtttgtttgcttaattttgagacggagtttcactcctgttgcccaggctggagtgcagtggtgcgatctcagctcactgcaaccctccacctcccgggttcaagtgattctcctgcctcagcctcccaagtagctgggattacaggtgcctgccaccaagcctggctaattttttgtacttttagtagagacggggtttcgccatgttgggcaggctggtctttaactcctgacctcaggtgatccgctcgcctcagcctcccaaagtgctgggattacaggcgtgagccaccatgcccagccttatgcaaggtttaataactttagatgttcacagtatctgcccctgctctgcgctaccacccctcttcaatgtctaaggacagatctgtaaacacatgtgacacacaaatagagtggtctaaaagcagtcctcagaattctgtaatccaaaaaggagagaaatccttctaaggtgtgaagcaacggacagaaacaaaatgaccaaagtcagtttcaccacatttaagcccaattctgaaaaatgcaggcaggcttctcctttttaactactaggtggagagggcacctccatgtggaacattcgaagggcagaaacagctcaccaggtcaggaaagccagcaggcaaagtctgttggcaggagaccgttggcaggaaggtgtggtagggaaagtgccaccccacgggcctgaccctcccgcctgcctgcccttccaaaggcctcctccaccttcaaccaggtcccatttttccaggccagagtcttaaaggatgtttgcttccctttgctggcctgaggacaaggctaattttactcaacaaagtaaaaaggatggaaagaacacactgaaaagaacaggctgaacaaccacctgtatgggtagagccatttaaaaatcattcaaacacaggcacagaaaacacctcaacaaatgtctatcaaagtcttagcagtatctcaggggtagaatgaaaagtcgttaaagttgttaaagttctgtgttatttaaataaaataagcattacttttgcaggcagaaagacaattcggagattaaaatatttttaaagagagaaaataggagacctgctttgattgatttttttaaaaccttctaccacgccttgctcagcctctcagcccccacacctggggtagaatttcttcatccaaaaaacgggataggggctgggagaaagaaatgccagtacccggacagccactgtgggccgggcactgtgctgggagctttagccacatcgtccacccttccacttggttgaagaagagtaaaacagtcccccttacctgcagtttcactttctgcagtttcaattacccacagtcaacagtggtctgaaaatattaagtgaaaaactctagaaatgaacaattcagaagttcaaaatttcccacggctctgagtagcatgatgacatcctgctgtaccgccccagacgtaaatcatccctttatccagtgaatccactgtctacaccgcccaccccatagtcacgtagttgccttcttagtgatcacacagttgcagtccttgtgttcaagtcacccttatctgacttaataatggccccaaagcgcaagagtagtgatgctgtcaattccattatcccaaagagaagttgccaaatgcttcctttaagtgaaaaggtgaaagttcttgatctaataaggaacgaaaaaaaactgtatgctgaggttactaagatctacagtaagaacaaaccttctatctgtaaaattgtgaaggaaaaataaatgctagttttactgtcacacctcaaactgcaaaagttacagccacagtgtgtagtaagtgcttagttaagatggaaaaggcattaaatttgtgagtggaagacatgaacagtattggttttttgtttgtttgtttttttatgagacggagtctcgctctgtcgcccaggctacagcactgtggcgcgatctcagctcactgcaagctctgcctcccgggttcacaccattctcctgcctcagcctcccgagtagctgggactacaggtgcccgccaccgcgcccggctaattttttgtatttttagtagagacaggtttcaccgtgttagccaggatggtctcgatctcttgacctcgtgatccacctgcctcggcctcccaaagtgctaggattacaggcgtgagccactgtgcccaggctttttttttttttttttttttttgtatttttggtggagatgttgccccggctggtctcaagctcctgagctcaagcgatccacccacctcagcatcacagagtgcagggattacaggcatgagccaccaagttctgatcaacggtactaaccgcagtttcaggcatccactcggggtcttggcacacattccccacggataggggaggatggctgtatcactccttaagagcaacaggcagccagggaccccagctcaacacccaccgacacatgatgtctactgtgttctgaacatgcataagcatataatttgaactgcattgttagccttcaggaaaggggcaccaggagctgtgctggccaggtacctagatcatttactgttcaaaaccaacccaggagctgagctactgagctcagcctccctctctcaaggctgggaaaggaaagttcatcttcactcagatgcaagcttcaagtaggcagagcagctgtctcttattcacccctgggcgggggcgggggggggaggggcgggttccagcacagcacgtggctcatgggctgagcctccagaagtattgttagtggatgggagaatggatcttcatatgggcttagagaggtgaagggacttgcacaaggtcacccagctagtaagcagggggtggagcccactttcaggtccaaactggcaagcctcagcataggtcactgttgctttgcaaactggcaaccctcagcataggtcacacagagggacaactgaacgttgtaggaccaggctctgcctccttctctctcccccgacccacctgccactccttggagctcctggctgaggcggagcttcacccagcctgagctgagcatgggcatccagaggcactccagtcggggtctgtttcacagaagcaggcccttcgtgaatatgcatgaggggcatgagctggcttccacgcatgcttcctgctcacctcatcctaaatcctaaacccgcagggccattgcccccttgacttgagcactagggtaaaatctatttttgtaaaaacctgatggaacttttacttaaaataagagttttaagtgtttatggaaacgaaatctatcttttagaagccactgcataaatacttaactgaagaagagtttggaatggggcaagcctgagtaggaatccgaatgctatggatcaccagaaacatcataacaggcgaattacctaccctcactgagcctcagttttcttgtctctaaaactaggataataacacctagctcactggggtgaatgaagattaagtcattacatttaagtgagatgatgcattgacttaatgtcttgaatactgtctctggcacacagcaatgaataaatatgtgctattactactgattctattaatgatacaatcataaaaatgactgcacaagaagggacctgcagtctcggctactcaggaggctgaggaaggaggatcacctgagcccagggctttgaggctgcagtgagctgtgatcacacctgtgaatgagccactgcactccagcctgggcaagataccccatctctttaaaaaaaaaaaattaaggccaggcgcggtggctcatgcctgtaatactagcactttgggaggccgaggcaggtggatcacgaggtcaggagattgagaccatcctggctaacacggtgaaaccccgtctctactaaaaatacaaaaaaaaaaaattagccaggcgtggtggcgggcgcctgtagtcccagctactcaggaggctgaggcaggagaatggcgtgaacctgggaggcggagcttgcagtgagctgagatcgtgccactgcactctagcctgggcgacagagtgagactccgtctcaaaaaaaaaaaaaattaaaattaaaaaaagtcatctggtccaaaccctcaatacaggtggggaaactgaggcccaaggagggtaagcatgttagataactcctgatagtccaacagcatttactgcagtgtttaaaaaatagtaggcacgaagtaagcgcattgaataaataataaccacatatgaaacaacatattcacctattcacctaatgtgcttcaaaacagttaaaaacaggtccagttgaatggcattccctctggctcctatccagaagaattctttaaagaaaagttctcaatgggagtcaacattcatcagcacccgcactgttcgctaaggcagccactagccttcgataatttcaatttatcaaattgaattcactgatactgaaatttcagtccactaaaatgaaataaaaccaaatattcagttcctcaatcacactagccacatttcaagtgctcaagagctgtatgtggatagtgattatggaacagcccagatatagaacatttccatcatcacagaaagttccagtggacagcacagctgcaaagagaagatatcattaatgtgtaatttctgttctcatccagcagatttagtttcctaaatcctattgcaaggcagcaggaagggaaagacctcgttagccttgctttattatgcaaatctgcatattcctgtcaagtccaatctccctcagaaagttcaaatagagtattattaggtggctgcgcgggtctacagggcaatgtctggggtctgagggcaggtgagagtacacaggattttatgaaaatgtgttctgtgcaaacacctcacttgtgccgctcttctccacaccagcaaactgagcattctttaacacagttcggcaaccgctggccaagcctcacttacataagagtgccataaaagactgggtcggctgcttctgcaaaacacctgtggttttgcaaaaggatgtgatttcttagaagtcagtaaacaggctcatttcctttacagttaaattttggcatcagaataccaaaatactctatgaccccacctaagctcacataaccttactccccaccttaaatggttgggagagcaaaaggccctgtgagctggaactgcccagggtgccagccttgctgctgggccagtggccaccatgcccacctccaccactttcctttgaggccccaggaggctggtacacactccaggagccaggaagaccacttggcacccttagctcctgggacactagaacacatggccaagttataaagacttcatatgcatcttctcatctggaggtgaggccctttcaaagcacacagggtggagaaacgtggataatatttcaccctctatgttaaaaagaggagaaatgaaatatatttgtatttgcttgttatgcctaaagaaatgaggacagcaggccaggcacggtggcttatgcctgtaatcccaacattttggaaggtcaaggtgggcagatcacttgagaccaggagtttgagccgggccaacatggtgaacccctatctctactaaaaatacaaaaaaaaaaaaaaaaattagctggatgtggtggtgcacacctgtaatctcagctactcaggaggctgaggcaggagaattgctttaacctgggagacagaggttgtagtgagccaagatcatgccactgcactccagcctgggcaacagagcaagactctgtcgaaaaagggaagaaagaaaagagaaaagaaagagaggagcaaaggaggaaaggaagaaagaaaaccgaaaaagaaaaagtccacataaaagcttatctctgaagattttttttttttttttttttgagatggagtctcgctctgtcgcccaggctggagtgcagtggtgcaatctcggctcactgcaagctccacctcccgggttcacgccattctcctgcctcagcctcccgagtagctgggactacaggtgcccgccaccatgcccggctaattttttgtatttctagtagagacggggtttcaccgttgttagccaggatggtctcgatctcttgacctcgtgatccacccgcctcggcctcccaaaatgctgggattacaggtgtaagccaccgcacccggccctatctgtgaagatttataacagatttactctcaacatccaaaaactggaggcaacccaaatgttcatcaactgctgaatggtacgtccataccatggaatactatggaatgctctacagcaagaaaaggaaatattaatacatgcaacatgaatgaatcaaataaatcatgttacacgaaagaggtcaaacacaaaagactccatactatctgcttccatttatttacaattatagaaaaggcaaaaccgcggtgacaaagcagatcagtggttgtctagggatggggaacaaggctgtctaggagggggaaaagggccaaaggggcatgaagggactttttagggtgaggaaactgttctataactcgattgtggtggtggcaacatgattagtaccaaaactcaaactgtacacttaaagctggttaattttattacttgcaaataataccctgattaaaaacaaaaaaaagaagaccctagaaatcttagctgtggttggcaggggagagtggaagacactgggcatgtgagaagagaaggcagtgttttatgtgtgttgtggtctgaatgctggtaccccctcaaaattcatatgctgaaacataatccccaatgccagagttaagaggtgaggcctttaagaggtgattagatcatgagggccccaccttcatgaatgacattaatgcccctataagaggcccaggggagctggccagccccttccaccatgtgaggcgctgtctatgatgcagagaacaagcctttgccaaacactgagtctgccaagaccttgcttacggacttcccagccttcagaactgtgagtaatcaatttctgttgtgtacaaattattcagtttaaggtatttgttccaggagcccaaacagactaagacaatgtatatatttttatttttgaaacctgtgactgaattgcctattccaaacttgagctctaattctttcaaagccaactgcagaggtgactctgtgcaatggctcaggtagaagtggtgtggtccattgctgggttcctgttggtcagggatataggcaccaaaagcttagagggtggggagaatgaaaacctctggatctaaccagagctgaatgtagaaaaccatctatctcctctcctcccagaagccagtgcctcctgtcctgggcctctgggctcatgtgataaagacaagagctaccatttattgggcacttactatgtcccaggtgctacgactcatttgacgtgcattaactcattaacagtgataagaccaacaacatgtacggagccctatatgtgctaggtatgacaggccttcttacctgcttgacctcatttaattagcctcaaatcgatcctatgacaaggaaccagtcccagagagttaagtgaagcccaaggctacacagctaaaagtgtaagggaacaaagatttaaacccaggcagtctggccccaggagcccagctaccatccatgaccaaggacaacccttttattgggacagaggcgacactaatcactgcacgcacttaggctgaggtgtggtgggtggaggatcagactcagaggtgaatctgtgctcctggcctactccaccagctccacagctccgccaggagggtctttcactcccacactggggaggcagagccagatgcatggagctattcaaggtcctgcctagctccaaagcccttactctttgcactagaccaggctgcttccttggctaataaacagtgagagctgaaacccaaacaaaaacaagcagcacacgtgaagacaaaatgttcctgagctgcaacgtttttcaatcttttgagctcatagatcacatgtctaggtcagagtcctgagcttcctcacggcgcaggtgatgtgagaggggctgagtaacctcgaggtaccactgaatggcatcctgcagtcactcaaaacgtgtgagcctggagggaccctggtgctcacatggtctgatatgcaaagaagaaaaagaggcatgggggatcgggaatagttcaacatcacccagcacatcagaggccaggatgcagtcccaagtcacgctccagactcctggtacagtgctcttttcacgcctgcagcatttcccatggcatgctgtgcaggccaatggggtttaagggaggttttagagagcatatggatgaatgcagtttaataattacctatatttaatattcataggaaaaatataactagcacatcaaacatgattttgtagatgtttctgcttacgaagaggctagatagcggtgttaggctcaggccaaagttttttgtttttgtttttgagagagggtgttgttctgtcacccaggctggaatgcaggagttattcataggaaaaatcctaacacacaagctccagggatcctcccgcctcagcctcccaagtagctgggactccagatgcaccatcacacccagcttttatttatttatttatttattttgtagagattgggtctcactatgttgcctaggctggtcccaagtgatcctcccaccttggcctcccgaagtgctgagatccaccatgcctggcaactacgggcactgtgcccagccctcaagccaattttaaggaaagcctcaaataaataataataaaagtagcatacaaatccagcaaacattgtgctggtagacagccacactgggctcattcctgcagtgcagcaggctaaagcaagaaggaataaaaggaaagataaagcaaacagaagggagaagggaggcaaagagaggaacagtcccctccagcggctcagctcttgcgctgaggagtgaggcccccacagcagaggacacggatgtgccacactcattctccctacaaacttatctagcctaagtcaccgctcttctcaccccaaacgtgctaaggtccaaaggtccaaacactgtgtatcagcccaatcacagggagcaaatggccctttaacacccgccctgagactactatcagaatggcctccctctatcccagtatgtgggacaggtatcagctcagatatttaatccattttcttgcctgagtgattcaggtgtccccattaaattctcttccatctgctgcatgcttcccagtgcagagaggccagagggcccccgaaagcctccccattcacaaaagcccaaatgaccagggctgttttggtttaaagcacaatttgggttcacataacacctcattatgcttccccgacatcgtttccacaccagcatcagatgctgggaactagagcttgaaaacactgcagggccgcagagctctcaagagctgtgcccattccacccctgcagggcctaagaatgcagccctcagccaggcgcagtggctcacgcctgtaatcccaacactttgagaggctgaggcaggaggatcccttgagctcaggagtccaaggctgctgtgagctatgattgagccactgcactccagcctgggtgacagagtgagaccccgcctcctaaaaaagggggctaggcactgacaatatgaactccaaactatgcatatagactaagacgctgaaacaatatattgaaaggttaacagtgctgctggcaagctaagattatgaattatttttgtttcttccctcttttctatattttcaaacttttccataataaacatactgcttttataacaaaacaaaaaaacacaataaacttttatttaatgatactatcaggttacaaagggctccctcctgatggggagaggggtcccttgccactggtgctcacactcaaccaagcgccatccactcccctccactagcctgtgggcctttcactagctcggggtccccaaggcctggaacataggaggcgctcagggaatgatgatacacaggggttgggggtggagtcgtgaaaaggaagtcaatgataaactctgaggtatcagctgtgcggcagggtggggcggagcagggcagggcagagcagggcagggcaggagagtgtactgaaatagaagagggtaaatcagagcctccttccacccaggacttccttctcagcatggccctgcctcccacccagctgctttgaaagctctcccacccctcactcttctggctcctctgagtttaaattagtcatttccccagcacccgccatgccctcctgggccactgagtcggcacacgccgtctctctgcctgccatgtctctgggcccacctctcctcctcctggcaaatgagccctctcacctccacttcaacaaaatcggtcccctgggacccgtgccttgaatctctcagcgagacgcctccttcaatgtacggctgcactcagacacagcccctgacagcaattatcttccattctacaagtctgtccgtctgtctgactggctcccaccaatggtctccatatagcgacggcaagtaccttttcatgcccacccccaagctgggcacacaatattaatcaatgtctctttgaatgaatggacagggagacgggtacgaaggccagcagtagtcaaaggaagcttggcggtgaagacgggatagggccaagccctgaaaggtaagacagaaagacacaggcaggagggaacaggcagggaagggggagccacaagctggtggtggccagaggattgtgggtgctctacagatgaacatcttttacggcagtagatgactatatgtttatttcagtgtgtactttctatatacagcaattgatattgttttccattcatggtaaggacaaagtttccttcctaaataatttaagttaaaaagtgaggaaacttaaagaaaaaattaataaataacagttctggcatagagattaatacagcaaaaaccatgagctaaccttagaacacatttttgcaggaagggagtcctctcaacttggccagaacagggagattgaggaagtgaagtgaagcctgctaggcagggaggatgagtcagctcagagggctctggggacaggcagtgaggcggcggccacggagagagcatttgtcagagcaaagtgaccggttcaagaaggtgcagagagaaaaaatactctacactctccctcctggggacttatctcaaggaaggaagatactcaaaaggaggaaaagaatacacacacacacacacacacacacacacacacacacacacacacgcccgcccactgcaagcaacagagagcacagtaaagggcttgcaaattgttcacttctgtaatgcccacaagcacccaggtcggggggtattccacagaaccacaagcccaggacagacggactactgtgcttcactcaacactagcacatcttccaaactacaacaccgtcttcacatgtcacatgttaatggctgcattccattccattgtggcttgagcacaagagtttgagaccagactgggcaacacggtgaaaccccgtctctacaaaaaatacaaaaattgctgggtgcggtagagcaaatctgcagtcccagctactcgggaggctgaggcaagaggactgcttgagcccgggaggtggaggctgcagtgtgctgtcaccacgccactgcactgtagcctgagcaaaagcatgagacgctgtcgccaaaaaataaaaaataaaaaatagtccattgcatagatgtgccaccatttttacctactgttggacaaccactttctccagtgtcttgttacgatgattcctgtccctatgtaccccataaacatgagctacagatcaaagggacctgggcttgaatctggacctttccttagatttcttcttgaactcaggccattggcattctgactgttcgacccaattgccacgaagctctctcacaatgtcctatttggaaaatgtggtctttccatgcatcactgaaaaaggatgttcaaagatgagctttgaaacaggcctaagtttatgtggcagaaaagactcacacaagagtgtagaatctagattctagagtgttagacataggacctgatcccagtgctccagtggtttactgtgggaccttggtcaagccccaaacccctgtgagcagtaaaattccatgacacagcagaggctgagggcaaaggcttttaaattcagagcagctgggttcaagacctgactctgccacttattggcaatttatataaagtctaaatctgtatcattctgaatttacataaaggcctaaattcataggatcccatgcttagaaggattctgggaaggaaacggaacggtgcatgcagaggaccaggtgaagtgcacaagaaccaatgccaccacctggcctgccttcctagctctgaggcctgctgaatgctaaggctgaggtgtgagctgcttgtacagtggcccccctttatcctcgggggataccttccaagacccccagtggatgcctgaaaccttggatagtaccaaaccctatatatactgttttttcctacacatgcatacctatgatgtttaattcataaaccaggcacagttattatcaataactgataacatcgaacaattctaacaacataccataataaaagctacgtgcatgtggtattctcttcaaaatactggactggggttgatggcgggtgactgaaattgcagaaatcgaaactatggaaaaaggggggatgattatacttgttccaaaacgaggcccatcacctaaggcttggaaatcactctttccccatttgtttccctttagattctgacatgtaatgaaattcaagtgggaattttatcagttaacccaatgcctcaaactgacactggagtaagtagtcaagcctcttgaagcactcggagcacagaccccaagggtgcagggctgaggatcccacactcacagtatttacatgtctatgttctgacaatcagtcacgtgatgggagggcccttcgttggaaccatggcaaccagttcttgtctgttacgtcgagaaatgcttcctcggctgggcgctgtggctcacacctgtaatcccagcactttgggaggtcaaggtgggcagatcacaaggtcaggagatcaagaccatcctggctaacacggtgaaaccccgtctctactaaaaataccaaaaaaaattagccaggcgtggtggcgggcgcctgtagtcccagctactcgggaggctgagacaggagaatggcgtgaaccaggaggcagagcttgcagtgagccgaaatcgctccactgcactccagcctgggagacaaagcgagactccgtctcaaaaaaaaaaaaaaaaaaaaaaaaaaaaaaaaaaaaaaaaaaagaaatgcttcctcaacaaccaatatgcatctcacagatagtatgtaaccaagataaaagtaggatccttgaggatattcccaggattctcctacgtgctctccatctggaatacagaaagctcagaaaccatgggccatcagcacacagggaaaaccagttctgtggcaggcaaaaggacaagggtattctagttagaaggttgataaacgcctccagataaagttattagaggaaggacagatgaaatcagtgtttaagaaaatgcgaggcctgtttcccaggaatattacctagtgcaaagtaggatgaaaaagtaagagaggttgtcatgaactgaggacatggagaccctactcatctcgaaggcagatgttgccatctacagcctagagctctaaaccctctgaggttagggatctctttcaacatctctgggtggctcaaacccttggggcatgaactaataacctgtcggttatgtaggcaggcagcagactgtggcctctgctcgtccctggccgcaggtgtaacacagccagggcaaggaaccagctggtcctgagtgtgaacaccagcttagccaatgacagctttatcctcatactatgctctattattccagagtctgcctggatgtgtgcagagaagaggaggagaaagggaagtgaggggcaggactatgcagtacccaaggactcaaaggtgattccagaccctgactaccgattagtagttactatgtagagaatgaggttccattttagatgaagagctgcaactactgcgctttcattcttcattttttttttttttttttttttttttgagctggagtcttgctctgtcacccaggctggagtgcagtggcacgatctcggctcactgcaagctccgcctcctgggttcacgccattctcctgcctcagcctcctgagtagctaggactacaggcgcccgccatcacacccggctaattttttgtacttttagtagagacgggatttcatcatgttagccaggatggtctggatctcctgacctcatgatccgcccgcctcggcctcccaaagtgctgggattacaggtgtgagccacagtgcccggcccattcttcctgcattttaagatgggttccaagtcattaaagcaaaactgagggagtcacctaagaaatactccactttcagctgcagaagtttaaaaaactctaaagaacatctgttgcaatcactaacataaagcactttcccctgtacatgaaaatgacatccttggatcagactccagggtgcctgcgagggacaagttttagaatctgaaaggaatggcttgaaaggccatctctgccccttcctagctgtgtgatgttttacaagtattttttaacttttcaaggcctccatatccacatctgcaaaatgggggcatgccaaggctatggtagtaattgcataaaataataactacaaggttaagcacagaggccagcctaatccaagtccccttgcatgataaaccccataagcagaagtgcaaaggcctgatcagcttaaaggagtggcccaagagcaagcaccctagagcctgaaagtcaggatctgtccttagtgtgatcactattgcttgcattttagatgtacagtatccttcagcacagtgatttttagatctggctgggcatggtggctcacacctgtaatcccagcactttgggaggccgaggcaggtggatcacctgaggtcaggagttcgagaccagcctgcccaacatggcaaaaccccatctctactaaaaatacaaaaatcagccgggcatagtggcacgtgcctgtaatcccagctacttgggaggctgaggcaggagaatcacttgaacccagaaggcggaagttgcagtgagctgagaccacgccattgcactccagcctaggcaaagagaatgaaattctgtcttaaaaaaaagagagagatttttagacccaatccaatggtgttaatagcatgacaaatgatggaattcctatggacaatcacaagcctgtattaaatgtccacatgggagaactaagctatagcattttatgtacattcttttttttttttgagacagggtctcactccatcacccagactggaaggcagtgatgtgatctcggctcactgcaacttctacctcccaggctcaaatgatcctcccacctcagcctcccaagcagctaggactacacgtgtgtgccaccacatttggctaatttttgtattttttgtagagacaggatttcaccctgttggccaggctggtctcgaactcctggctcaagcaatccacctgcctcagcctcccaaagtgctgggattacaggtgtgaactacctcaccgggccctatttacagtattcttacttaatcctctggactaccctggaagaggacaatagtatttccattttgctgctcaggaagttgaggctgagacatgaagtgactaggttcaagcccgcacagttcataagcagccacagtggggtgtggatctgggaggctcctttcgctatactaccccaggctgccttccaacaagccctatttttcttcctgcattcctttatcttgcccccttcttaaacctaaaccctgacacttcacatgccttagaatcaaacacctgcccttaaaatgaaatatcaaaccctgaagcagggcagcttgtaagtacggggcagtttaccaatgcaaacgggttagtagaagctgagagtgcctaggaagacctgccaccttcacaagaggagaaaatggaccagaaaataaacacagtacctgttgagggggtcgtgcgggtgacgaggagcatctaaaggcaccatactttggctgcctcaaaggctctgggtaccaaatgtaactggcatgcctgggtgggccacttacacccagagaaacaaaaaaattaagtcttccagaagagtgacttgtattatcacctgaaacaaaagcaccatttcaaacaacttgttcatggagaggcaggtgcatggtctgcgaggcccagaactgacaaggacctgcagggagctatggaggaggcgggagatcaggtgtccacactaagtccaagctcccaacacaaagcaaagggagtgtccacatgcgaagacccttccggctctaataacacactacgagtccatgtcactgataataacatcgtgttgtggttaatgttaataattatggttaacacttgcctggctttacacatattaactcatttaatcctcataaaatccatcagaaatatctacttttatgctcaccatttcttagacaaggagatggaggcacagagtgaagggaactgccctggtctatacatcttggacctgaagccaggctctctggctccagagtctgcccttcactgcccctggactaggaatcatgactgcctgggatcacatagaaactccaagaaagccaccagtgtgacttcaggccaagcgctcagcgcccaccatgtgcacagcgttcagtaaatgtcagctgctgttaggatcacggctcccaccacggccaaaccctgacaaggccagcaccactggggcagtcctgagcagcagaaccgctcaagagagcactgccccatctcgggggcagaccccgctcggctcctctgttctcgactgagagcctgacactgacaactgggtaggccctaggagaagccaggcttggccgagagctcaggcccagagatctggacatggctagtctcacagtggaattgcctggccccagtgtttagtctgtattaggttgaaccacatgaaaggctggttaattcaacccttttttacctaggaaaatggcaacttcatatggttcaacctaatggagggagggattcttacatttattaaggacctactggacattcagtcattcatctaacacctgtagagcaatggctgtgtcagggccagtgtgtaacactgcttcagcaccccaagactgagagccaggatttttcatcttccctcctaaggataagaaacaaacttaccaggcagaacaagggtaaccaactcgatctgcctgagctcaggtaactactaaaacaggccaattttggccaggcatggtggcttcacgcccataatctcagcattttagaaggtcaaggcgggaggatcccttgagcccacaagttcgagaccagcctgggcaacaaagtaagactctgtctctaaaaaataagtagatagatagatagatagatagatagatagatagatagatagatagatagatagataggcaggcaggcaggcactgtggcacatgcctgttatcccagctggcaggcactgtggcacatgcctgttatcccagctgcatgagaggctgaagggggaggactgcttgagccgaggaggctgaggctacagtgagccaagatggaaccatgcactccagcctgggcaacagaatgagaccctgtctcaatcaatcaatcaaacaggccaattttgtctttcctctcagaatccctgcatcttacactgtatatggtgaccagggctgggatggggcttcataggaaaaagccaaaggatcctgcaaggctttgtcacccaatagtccccatggagggctgtcgcaatgattaagatgtgctgctgccactcacgtcacaggcaggaagagccagggacactgacactactgcacaaagaaccgtcctgtccagtaggccaagccacacagtggccgacgctaggctaagactatctcgccctttcagctgagtggctatcttttggaaaacagattgcagttcacaaagttccatctccttgcatttcaacaagtggaaccaaaaaaacctcctaaacaaaacccagacctcttcagccactgtggctagacgtacaggggaacctctcggccccagtttcctcatctataaaataaacatccccatgggctggtgccagagaggcaggagaggggaattccatcagcatgcgctgagtgcggtggacctggacctccatggcaactgccattaactagctgggggcccttcagcaagttactacacctctctgagctccggtttccttatctgcaaaatgaggaaacagacctcacagggttggtgttgagagaattacagacaatgactgtgggcatccggtaaatactggcagaaggaaggggccactctgtgagtgaacactcaataccagcctacagactgaaggtatccttcatttcatggcatcccctgatgcctgtgccatgagtgcactcctcaagaccaagaatggactctgcttaaccacaccccagcccatcctctctgcctgaacaaggtctcaaatctcaggacaaccaggggtccacaccaccctgtgcccaaaagagatttcaggatagaaggtgtctggagggtatacactgaggacatgacaacagctcacattggaaattctcagcagaggaactaacagccaagcctggccgctgctcttttggagtctgagttcctcagtgtctcaagacttttcacaccagaaggatgtggtggattaaggctcctccttccagtttctgagcacaaaactgcaacgcagggagcccactcatgtgaaaccaacgacagcccatcagggtcaaagcctcacgacggagaagccttcagcagcaacactctacctgccaatcactgctgcaactgagaagggaaaagggcaccggtaccaccggaaaatgccactggctcaattctaattggaagctccagcagatagggtgcaatgcaaaagcatcttttcataactttttttgaaagaaagatggggtcttactatgttgcccaggttggccttgaactcctgggcccaagcgatcctcccacctcagcctcctgagtagctgggaccactgacacacaccacagcacctggtttaactttctattttaagttaaagtacttcacttggtaaatacgatgcctgaatccacttactagggctctgagacagcaagcccaaacactgttaaataagataccgagcctaactcaggagcatcatgctgagttcagcactagaagaggaagctgcacagagcaattgaagcagagggtggagaagtgcggggtctgagccagtggtaacaactgcttccaagctgcaatgtggtaagagctcttgagaccagaaaccctgggctgctgttttcagcagtctggtgtttaaacagaatgagccccttaagaccactctccttgggcaagggactctacatcttggagtctcagaagaaggaactagcacctgccttccaggctggttgggaagttaaatgaaacaccacctatcatccatccatgttaacagaataaccacaataataagagataacactcctactgcacttacaacgtgccaggcatcgtctacactttccacacataaactcagtcctcacaatcatcactacgtgccaggtgaatggcaaccaccagggttgttgccttacaagacacgtgacgacacaactgaaaacctaacactagaaagttgtaggcaaaggctcctgttcacaagcatccagagatgtcagaaacatgtggggtgaccataggaggaagcacggaaaaacgcaggcaagcagcctccctgcctgtctgacgctgtggacttccccaggctggttctgcactcactcctgagtctttcagaactttggacatacttgcttccacccgcttcctccatttaaccttaagactcagatggcatattctattaggtctacctgactgctcagtagacatccacggaatgaatgacccgatggaaaaaaatcactaaagggagcatagcgcagtgccaggactgccaggtgggcctcggtttcctcacctgcataatgagggtgacatgagaatctgcctcgtagggctggctggaatattaaaaagtcatcagtcaaaactagctcctggccaagtacagtggctcatgcctgtaatccccagcactttgggaggctgaggcaggcagatcatgaggccaggcgttcaagaccagcctggccaacatggtgaaaccctgtctctactaaaaatacaaaaaattagctaggcatggtggtacgcacctgtagtcccagctacttgggaggctgaggcaagagaattccctgagtctaggagacggaggttgcagggagtcgagatcgtgccactgtactccagcctaggtggcagagcgagactctgtctcaaacaaacaaacaaaaaaaaactagcttctgttattcctacagctgccatgcagagcccgccaccccaccatctccctcagcagactggtgtcttaggcaccagaacctaatgctgtgtgcatcaggctgaacttggtgccacctgcagtcacagagtcactggctggatggatcactgggctacccagactgaaatccccattcagttgttaacaggctctcaaggctttgcagacaccactatctaggatttagactgacctgaaatagctgtgtgtcaatgataaactgtccaatcagaacacctacatgggacagctctggggcagaccccctcagctccagaggtggtaaatcattccgtgtcactctgcctttatctccttccaccatcccttcctttccacacccacagctgcacagtggccaggaccctcataagctcacaagctgatgcttgtggaggcctctctcccatctctttcacctcccaggcctcctgcatgcacagccagagggctcttcctaaaataccaccgctctgccagcctcctcgaatttctacctgccctgtcaaaaatttcactggctccacactgtcccagatctaatgcaaactccttagcttagcaactcaggcactccacaactcactcctgagactgaggcaccccatgggctcgcatctactgcttgtgtgaccacaccccctgacctctgcttttgtgccagtccccttgaccataccccaccctgtcctctctgcctgagcacactcttcccaggcttcatgcccagcccccaagccgactgcaggctggagtggtctgcagggctgcgtggaggagggggaaatgcaagccaggcctgcagggatgggcagaccacagcacccatgggtccctggctaagtcttttctagtactacttcattcctgctgcacttggctttttggacgcatcttgcctccccctcccagattagaggacagggatgatggcttctatttgtgtcccttattctgtggtatgcagaataagacatgcaacaaccacagctactgtgtgccaagcactggagtaagtacattacaaatttcacccctactccccatctctataaaatgttatcctcatgcgacggaacaggaaaactgagaccaagggaattagccgcctcactgacagtcacatgctgagtggcagacaggactcaaatccagatgtgcccaactgcagagaccatgttctgtggagcaggcagccgcctctcagctctcactcagtgtttatgtagctggcgctaagtgccaggcggccagtgcaaggtgtggggtactcagagggaaccaaacagacaaggtccctgctctcacagagctcatatgctctgtccccagccctgtctctcttcttccaagcctggaagagggcaggaaccctccagtcacagggggttccactggcacaaacaaggaattcgggcctgacatatagcatgaggctctggcaacacatggtgcccagctcacagtgagcttgtctttaatggagaaaagagccccaggctctattaggtaagttgtgcgttcaaggcacaacccagagccagacaaactccaaagcagccatcggcaggcagtacggagtggagaaaaacggtttgctctggagtcagaaaacccaattcctccacttagtagctagacagggactaaccatacacccctttgcacacttttggaaaatggtgataataacaatagttaatgtttacatcactatgtgccagatgctactggatgcacttgacagatattacttaaccctcattacgaccttatgcagaggtactgttatcctaaagcagtctggctcctaactctattttcttgtactatgctgcctccagcctaaagttgaacctaccttgtcaggctgtggtgaggaccgttctaacagagtgcatagcatgtggctggtgctccataaccattaaacctccctttccttccactgaaacatgaatctgtgaaagcctaggtctggaaatagcatatggctctagctggtcccaatatgggtgatcttgcagttgcatcccctggaattccacaccgcaccctcactggtggatctgctgcaaggggaaatgggacaagatcctgtatttacggggccctctgctcactgtgttctggaaaacacagtgagtggggtccagcacatgacttgggctgacagggatccgaatcccaggcctgctgttcacaccggtcactcaagctctcaagcttcaggttccttgtgagtaaaatgggggctgggctataacctaagtcatgtttctgggtcacagcagatcctcgggtacccgggttggacaggctggacaaagctacccaggctggacttccaaggtactgtaaggtttcatttcggggccccagaaagccttggctgtgcagaggagcggactgcgtgcacgtgcaatccaattccacccaatggcagacacaagagaagacacaccccaaaaggcctgggagtggagcctggcacaagcccccagctttctcttcagtttcctgccatagctcatgcagatgtgcctgcaggtacactgaacaaggctctttcccccttaagctttaggtaacgatgacatccccacccctcaacaatgtgagccatgagggcagagatccttgtcttgcatcctcagcacataagcaccacagagtaggcacttaatacacaaaaagctgaattaacattatcctgtagctgcaggtaccccacaacatgcctcagtatttgcctaacaataagcatttcccagcctggagggagggcaggcttctaacgggcgaggcacctgccctgccaccatttccctgtggtcagtcatgtcctgttccccacctcatggaatgtaaaagtataggatgtctgagttataaataggagcatctgctttcaaagacacggcttatcatttccttaatctcaagccactgatcactgcctactttttataagcatgccaccaaaaagaggccaggtgggcttaaatgaacagggctgtatagacagacaagagggatgtgagttgaacaatgtgtcttatccacatcaagagacattaatgtcaactatgttgtttcaccttgtaacaataccaagttcccatcagctcctgccaggcaaaaccatctgtgagctggagcagcaattcctgagggggcctccctagtccccgttcctgctaaagcctcaccatcatcataactaagaataattcccaagtcagaaactgaagctgtgtaaggaacggtgctctgaaattgtacagcactcagacagtggtaagattattacctgctaagggaatgcaaataaattccatttgcctatgcattttaactgggaaggagaaactcatgccaacaaaaatcatggaattcattccaaagtcaaatgcattttagattctcaagtcactatttccctcaatggataacagagatctagctgtattctctaccatcaaatctactgaaaatgaaaaacatggtgatctgaattcatttacctacaatgcaacctcacaccaccacttctgtcctacgccaaccatctacaccggcttaatggtcagagtattcaaataggggataaacgtaacaataagcagtcagaaattacaaggctaagggatactaagaacaagtgactgagagaatgaatatgaaatccaagcaggtaagttcatggacacagacacatgccaaagagaacattccaagtggtttcttccaacgccaggtgctgttctaggccccacggatacagctgcggaaaacacaagacacaaatctctgccctccaagagctcattctggcccatgctaaatatgcctgtatcaccatacagctatttcactataaacatgatttcctatacaaaggatctaaaatacaatacatgggcaataaatactgctcctccccccttgccatgtttgaatatcccattttatgtttttcaaacggtatcattaaaccttctgacatacaagcagcttggtacaatgggaagaacagtttagagcctgccagatgggcttccactgaccaacagtggttcctccactggctgagcaacaccctgaataagtcactccacctcctgagcctcagctgcctcatctataaaatggggacagccccagaagggcttcctgtggatgaaaacagcttgtacaggtgaagcacaccacagtgactggcagacagttcctccaccctttccagccttttcagatgagagctgagtacaagactcctgagaagcttcaggtgtcatgtgctcctcctgggggactgaggcactttcccatcacctggcgagaatcgctgcttcctgccttatactttgtcctgagtgcacactcaggaaacttcagcccactttcaaagtcctcacccaccactgccctggagaagtcgttctccatcaaggcctggggccaggcccacctccccaaacaaggagttttcagccaaagttactggacaaatccgaaggccttaaaagtggcattgcccatgtttttaatcagcatacaggaaggcatcaaaagaaagcttaacccatctcaactactcaccctcgttcagcagcaacatcccttgactaaacaaggaaccatggtcctcaaaacactttgaggcccaaagtccacatacaaacatgctccaaaaatcccttgatcctgtcaggaagaagttctctggcccttccaacctaagtgctgggcctgtcctgcagaagggtcaagtggcaggagggcaggtctatctgtgggggcctatgtgaaaccccaggttcctcaaaagtctggatagcatctgccttctttaccaaaacaaacaccacgagcggagccagcactctccctaggcgttctgctcacctgatccgagggacttccataatcagcagttccaacccttgcaagctgacagttcagagggaaggggaggctgcgcctgcttgggtgcatcgtgtccaggccatatgctggatccagggcctggtggccccccaaggccacggcctcacaagggcgattgtgcgttcatccttgtcctgtgggccacccatcctcgcccctcggctcccactcaggcccgggcgccgtggaccccggcctgccctgcagaatgcttcgcacgcacagcacccacggcggcagcctcgagaagggcccgcagagcagcgcgctgccttctgggcacaccgatgcccgcccttccctcgctggctcctaggcggcctccctagaagcggcaactgagaaggcacagcaccgggaccaccccatccctgatggagagctcccctcgctccccaaaggctgcaaagaaggcgcgccccaggtacagggaaggggaccctgggtcgtgcaccaggcagggggcaggaccctgatgagaggctcagggcggggaccgagcggggctgacgcaggttacgctaggagtggcgaaaagtccagggaaggggatcatggtggggagggggcagtgaggtccagacgggggccatgggcggagaagaggaggtccagatttaagttcacagagagaagaggagattcaggctgaggccacggagaagaggggaagcaaacctaggccgctgcagaaggggctgaccggggtccagcctgaggccatggagaaggcaaagggggagggacagagggaggcagcggcctagcctgggccatggcagggagaaacgacggcctagcctgggccggagagacgggggaaagcagacctagccctagaccgggggaggaagggggcccacgccagggtcaccgagggggtgcctggctggggacacggttcgggagggagggtctagcctgggctatgggagagaccagcctgaacacagaggtagtgagtgggactccagcttgcgccaagggcgggggctgggagcgggggcagggtcactgccacccaagtcgtccgcgccggcggcaccctcctgggcggggagggaccgggtccacccagggtccgggaccccgcccctcccccaccccgggaagccacccgtcccaggccagggatgggcagggggagggggacgcgagctccggaggggcccccgggccggggagggggccgtgcggcctttaccatggtggcggcggcggcggcggtcccggtcccggcgtcagtggctctcccccccgcagcagggcccggcgcttccacttccccgggtgcccaggagtgaacatccgggtcagcacccccctccccccgcgccgggc

SEQ ID NO: 184 - DNA, 146800 bp, Homo sapiens; identical to SEQ ID NO: 183

SEQ ID NO: 185 - DNA, 33119 bp, Homo sapiens
tcaattgtaccttttttctttaaaaatagagctctttatttaaacagtttagggtaataccaacaagcagtaggatatcgtttaaatatgacataaacatagaaaaaatagaaataaatacaaatacataagaacaacatataccgttagtagtctaaagggatacatgttgctttcacctaaggcactaacacttttcacgggatatgcttccagcgcaggcccagcccacaccgcgcagttcccacctgctgtgcacgtgaaagggctttgtaaacagttaagtgctgaccacacaaggcaaattattatactgattatcatgccctttccaaatgcttctcctggctttttgtgaatgacttaatgacgataaaggagatggagtttagagttactggaaaacttaagctatgtcagaaattaaactctggaaaaaattctttaaaaaaatagtaaggtttggctgggcgcggtggctcacgcctgtaatcccagcactttgggaggccgaggcgggcggatcacctgaggtcaggagttcgagaccagcctggccaacatggtgaaaccccgtctctactaaaaatacaaaaaaattagccaggtgtggtggcgggtgcctgtaatcccagctacttgggaggctgaggcaggagaatcacttgaacccgggaggtggaggttgcagtgagccgagattgtaccactgcactccagcctaggcaaaaagaacaaaactccgactcaaaaaaacaaaacaaaacaaaaatggtaaggtttaagaatagaaacggagtggttatttcatacaagtctaagatgatgctgatgatagcttttacttttttgaagttacctccacgaagcagctcggctggtgccagagagaacatcggtacaggtctgggaatttccctgggagctggccccaagccacagccctccccagctccgtagtttgtttgttcttcctctcctgggctcaatcatctggacaagcctcactgcagggaaaacccctggggagacacaggtgtgtgtcgtatgtgtgtatgcatgtgtgtgtgtgtgccccagcagcggtgaaggcctcctgacccttagaaatcctggctgtgaccttcatattttactgacatggacaaggggtcagaggttggcccggctgtgcagagatcgaagctcttacccttggggatgtgcacaagtcatcagagcagcactgctgggcgaccttggacaagtgcctttgccacccttgacctcagctcctttgcaacaaaaggagtggtttgctaactttttcttgagtagtggatccctctaaacaaaacctcacgtggaaagccacagtgtgtgaatcagggcacagtgaggctgctctggtgaaagtgggaggctcctatagccccatggcgccccctgcaactgcagcccaaggcctctgggggacatggtttgagaatccctggatgagatgccctaagaagcttttccagttctgccatttaatgctgtacccttgtggtggctttaaagcaacacagctctgtgggttcaatggctttgaagatcccttcttcacaaatccagaaatgttagtcctggcaggttgaatggccacagagccaaggttgttcagatactccaccacaaaacacttcggtcctacgggtgaaaactcagctacgctcatctatattcaggtgggtgtaggttaactgaggatgcatcagcacccccaggtaaggatagtcacctgaatctagaaggcattggtttctcataactggaagggagaatgggacttctaaggaccacaacggtcaaccaagagtctaacgtgccatccaaactgggattacaggcccagaagtccgattcctgccatgttactgtcctactccaacaaactgggtccctagaaggtggagcagttggttcctcccctgggaagcagggttcccattgctaggtgaaggcggagagaccagggtccccttgggtggggctctggcttctgagagctcactctcctgactgggaggcagtgagggtagaaggaaggaggtagactggggatgagacaagctgaatgttaagtgctctcagtcactctgggtttaggggccacaggtgggagatgcccaggggtctcctggagcctggatagatggagaattctaccggccaccacgtagagagcacccaggacacagcaggctccgtgctacacacatctgagatcccctagaaccctcaccacacccaggcgtagctgcagatgaggaagccgaggcagagaaggaagatgtcttccccaagatcatacaaccagtgaacagcagagctgggatttgaaccccggtctgtctgacactaaaaccgtacagtgccatgactccaaagaccaggatttgaggacagccacccttcccttcccatccaaaaccctcagccaactggatttttatctgggcctaactaggggacccatgaatcaggaggctgagccctgggatgggggagttcagtggctgctgggaaaggcatgaggtatagcaggtgtgcctccagtggtctcaagttccagagggccccttggtggtgtccgcccttgatgtccgcagtgacctgacctcacctgtttcatgttgtccggggataatttttccccctggcctgtcaccctagggacaatgggggtgatgacaccccaccaacctctgacctcagcccaccctgtgtccacccctcttatagctcagcctaaagagggcgggtcacaggagggaggggcatcttgttgctcagcccgacaggcaaacagccgctaggtggacttcccggaagtgcaatgcccctccgccgcccaggggaggtacggaggctcttgagtttcttgggaagcccagtagtccttgcaaaggcagcagcagcatcagattcggtgggatgtcgggggacagctcacctggccatgtaatgccccaatgtccggcccctgtcctcggtcctctgggtgctctcagccccccagctgcccgcatcgctgtcctcaatttctgattccctcgcctcctcttcctcctcagggctgctttcccagcagaaggtcagtgtctgaagagaaactgggggtcccccagggaccagattcggctccggtggtaaggtgccccaggtggcccaggaggagaggttatcttctgggagctcttccaggaaacccgagtccttggagaattcaggtggtgggagagattcttggtgcccatccccacccggcccttggcctggccccttctcagccaaatagccagaggacccagccctgtcccaggaggagtccacagtgctggcccagcttctgtctgaagaatcccaagcagaggagccttcgcttgggaccagaggagccctgggcctccctgagtccaccccaccagcctccgagtgccctggagcctggtgctcttgccccaggaaagaaggtggttcaatgtagggctggaagctgacgccatcttctgtgtcctcctcatcctcctcctcttcgtcctctgcaaggtccttcttccatcttgtctgttgggtggctggggccctgactcgaggcgtcggcctgacccctctggtcagttccttttggggacagaggaacaagtcattcacggactctggtctgctgggctgaaaggttgccacagggtgtgtgtgtccagaaaagtcctgatttgggtaggggagagaaaagcagaaaatttaggctttcctgaagcataattatcatcatctgaattcccctagaaacagacctcagacaaggcttcaagtgtaagcagtttctttgggagatgatcccagaacacaccagatgggactgggggagcagccaggaagcagggtgttatcaagcagctgaccactagggctactggcacttaatcctgctggcaactcagggagccactgggcacacgcacctcagaaccatcccaggagggggacgctcctgggctatttacccacagtcattgttgaggaatggaagagctggtggctgtgacacttgcagcctgccacatgcaggggcaatgtgggctccagaggccagagaaagcccattgggtgcaggcgctgggagttgcaaatccagctggtgtgctcttaacaggaaggctgagggcacggggcagggcacagacatgtctacccgaggttgtcaccctgacagttagtgggattctcccacagatcctggagccaggaaatttggaaatgctccctttgccaccctgccacgatgcagggacactcagaatccatcctcaaagcccccatgcccatcggagcctcgcatatgcccaagctgcccctgccagccctcatctgaacagggccgacctatatcacctcctgggcttcccctgccccagctcgcccctaggttctaagggagagacccagcagaccagggaagaaactccaaggtcagccaggacacagcttatcctgggttaaagtgtgaactaaaaattggaactcttttaagatgtcccctttggtgcctcctctcctccccttttgagtgtctctcctgaggtccaaggccaggggctctgctctcagcagctgacacatccttagcagaggtgaagttatttatctcaaaggaacttaaggcactgctccctccagggcctgtttgccattttattcaggactaaatgaatgcattactaatggtggaaattcagacacaaagatagatgttttggtccaagagtctggaccatcttgatattctatctgaacaactcatagctccagccccactcccttactctcaacccctccccacctgctgcacacccccagatttgctataccagggcccgtggcatctttgcccgctgaaaccaggggttccccatgagggtcttccagatcacaccccctgcggcaattactaacagcagtatcagaagcgatggcagcaccaggaaagcccagttggcttctaaggaaggaaaaataacaatgagagaaacaacaatggctcttgtctacaactgcacctgtgccgagtgcttcacatacatgaccctatttaatcctcacaagaataaacccatcctgcagactgtgcaaaccaaggtttggggcattatgtaagctgcccaaagacacacaatgagtgtggttttaatccaggcgagtctatctctaggctcatgttcttaaccactgtgtcacgaagctcccaaggcccagagggaaagtttctctttctgcaccacttgatacccacctgggacctccagcaagaagcaggtgggcttagagaacttgctgtatttcgggacactgaacgtgtagatggttctggcactgaggcagtggtgttcgctggcagctggctggagagtgatctggactggctggccatggggagtgactggaaatagggtctgtttggaaaagaagcagagagtggcagagctgctgtggggactggtttcacacagccaggacagagtggggttggcagacatggtagggtgttttttttttgttttttttttttgtttttttgtaggggatagggtttggttctgtcacccaggccaaagtgcagtggtgtgatcacagctcactgcagcctcaaactcctgggctcaagcgatcctcctacctcagctctccaagtaactagggactacagatccacaccaccatacctgggtaattttttaaaattattttttgtataggcaaggtcttgctgttgcccaggctggtctcgaactcccagcctcaagtgatcctccctccttgcctgaactttctattcttttcctgcattaaagtttaagcattgaggaagcacttcccaagactacctgagttcttttcagctgagtctagaggtagggatagccatggttcaaaagcagcctaccacttggggtcgccctggcgtgcaccccattaaggtccctacttcgaggagcagattcttcaggctttccatcttggggtctcctagtctatcagcagtggaggaaacctctacagatgctgcactgtgtggtatggaaggcactggccacgcgtgactactgagtatgtgaaatgcatctggtccacactgagaagtgttccaagtacaaaacacacatcagattttaaagacgtagtgaaaaagaatgtaaaagatctcaatcactatcagaattgctcattgaaatgataccattcaattggatgaagtaaaatctgttattaaaattcgatttacctgtctctttttacttaatttaacatggaacacttaaaactgcacatgtggcttgcattatatttctttctattgggcagtgctggtctagaatatttgtgaggttcttgaaggcaggaaccacgctggattcggatctatattccccagaacccagagtatgcaaaaatcgggagtgtgaatgttactttagtggaagcaagaacattcaagagcagaggcccagggaccaagtctggttggccacttgtttatgtaaaaagttttattttttgttttttttgagacaaggtctcactctgttgcccagactaaagtgcagtggtgcgatcatggctcactgtggccttgcttcctgggctcgagcgatcctcctgcctcagcatcccaagcagctgggaccacaagcatgcatcaccacacccagctttttttttttttgtagggataatgtttcaccatgttccccaggctggtcttgaactcctgggctaaggtaatcctcccaccacctcggcctcccaaagtactgagattacaggcatgagccaccgcacctggcctgtaaacagttttactggaacccagcgatgcccattcatttacgtataggctacggctccttttgtgctataactgcagcgttgagtagtcctgagcgaacatacggcccatgaagccaaacatatcgactatctggccttcttcgggaaagtctgccagcccttgccataaataaatgcagctatacacacatgcatacacagaaaacaaatctgaaattggatatacaccagagtgatgtgtggtcatctctgggtacttttggtctgcttcttagagcttatctgtatttttcagtttttctgtactgaatctgttgacttggcaagcaggcctcctgtaggtcatcatactttgatcagattttattagggctgactgccagaagtcaggagtgtacagggaagacttcctggaggaggggtgcaggagcaggctgggagggtgagaagaacctgagtaagaaggggtggaggagcgggcctagcctgggggcaggaaaggagcttcccaccttgtttccggccccctccttccagaatgccacctcatacttcagatccagtgggggcatgcaggggggcagctggtacgtggcattggcactcaggatctcctccgtctgggtgagcaccaggacaggtggggccggctccactgcagaaacagagcaggacctgtcagtaatcccgaggggccgcactgcctccatcccccaagaccagagagctctcttggaaatggaaaagcaactagcatgtttcaaacacttcttgtgcacctagcaccttataatctgttatttcagccttgcactgaccctgggagggagatatcactactctcatttcatagagaggaaaactgaggcttagagaggagaggtgacctgggcaagctcattgctgacctgccttctctcatgccatcccatccgcctgggtgccctccacatgtcactggcctggcagatcctgcccatctggattcattttctattgctgtcataacaaattaccacacacacagtgccttaaaaatgatacaaacttattatctcacagttctctaggtcagaagtccaggtgggctcagctggttcctccgctctgggtctcacatctggaaccgatgggggagaagacacttccaagcccccttgggttgtcagcaaaacttagttctttgtggctgtagggctgtggtccctgtttcctggccgattgttagtgggagcctctcagctccggaaggcacccacatttttcatcacgttaccactccatcgtcaaaccagaaacggcaccatggagtcctgtttatgcttcaaatctctctgacttccccttctgccacttctcttctgcctccatctggagaaagttttaaaggctcatgggattagattgggcccatctggattatccaggataacctcactatttgaagatctatgtctcagtctattttgtgttgttattacagaatatcacaggctgggtaatttataatgaacagaagtgtatttggctcatgtttctggagacttggaagtccaagagcatggcactggcatctggtgagggcctttgtgctgtgtcatcccatggtggcaggtggaagggcaagagagggtgagagtaagccagcaagagagggcagaactcacttttcttttcttttctttctttctttcttttctttctttctttctttctttctttctttctttctttctttctttctttctttttctttctttttctttctttcttttttctttctttttttcttctttctttcttttctttctttctttctttctttctttctttctttctttctttctttccttccttccttccttccttccttccttccttccttccttttctttcttttctttctttctctttctttcttctttctttcctcttttttttttttttttgagacagagtcttgctctatcacccaggctggagtgcaacggggcgatctcagctcactgcaacctctgcctcccggattcatgcgatcctcctgcttcggcctcctgagcagctgggattacaggcgcccgccaccactcccggacactttttgtattttttagtagagacagactttcaccatgttggccaggctggtctcaaacaactgacttcaagtcttggccccgcaaagtgctgagtggcataagccactgcccctggccagaactcactttttaacaatccattcttgataaacacactcccgcaagactgaccttaatctattcatgggggcagcgttcttaaggactaaatcaccttttaacagggccacttcttaatgcaatcacaatgatgattaaatgtcaacaggagttttagaggggacattcaaaccataacagtctataacgttaattaagattcctactgccacgcaatactgacatctaacatattcttagcttctggggattagggcagagcacctttagaggatcattctgcctaccatggtcttccctctgtcccccacccaaaatccacatctctttcttttttctttttttttttagatggagtttcactcttgttgcccaggctggagtgcaatggcgtgatctcggctcaccgcaacctctgcctcccgggttcaagcgattctactgcctcagcctcccgagtagctgggattataggcatgtgctaccatgcttggctaattttgtatttttagtagagatggggtttctccatggtggtcaggctggtctcgaactgccgacctcaggtgatctgcctgcctcggcctcccaaagtgctgggattacaggtgtgggctgggattacccaacccacatctctttcaaatgcaaaatccattcactccatcccaatgtcccccaaagtctcatctcattacagcatcaactcaaattcccaaatcaacagtatctaagtcagagtcaaatagactctgggcatagtccagtcagtacaactctcggggtacagtttctctctatctgtgggccagcaaaactaaagttttctgctcccaacataaaatgtgggacaggcacaggataacagttgcagacaatctggctcaagcatggggacatgaaagggacaatcaggtcatggtccaatgcagtttgaaaatccagccaagaaaactccattaggtttcaaggcctgggaagaattctctttcgctcttagcactgccctttgagcttctggtttcaccgtctgagatatccttccttttcactaaaggtagcaggtgtttgcagctaagtagttttaccagtctgcatctcaacagtagaaactggagagtccaacagccttctttgatttcatactctctgtgttccatttaatccaagctaacagtgtttctgtggatgtaaacgtctcaggaactttacgggtctcctatggatgtcatgggggaatccactgcattattagataaaagccaggtccacagatccttttttcagataagcccttctctacttttggctccagctgagatggctgagggacaatgctgttcagcttcctagaagtcccctggtttgattgaaggggactgtgagttataatcttaatctcttcaaagagccttttgagcgactgagtactttgatcttttatcttcctgaagtttggtataatcacatacttggctgtttctctatgtcacacttttgggagcaatctctttttttttttttttttgagatggagtcttgctctgtcacccacccaggctggagtgcagtggcatgatcttggctcactgcaacctccgcctcttgggttcaagtgatcctcccacctcagcctcctgagtagctgggattacaggtgcccgccaccacacccagctaatttttgtatttttagtagagacggagtttccccacattggccaggctggtctcaaactcctgacctcaggtgatctgctcgcctcggactctcaaagtgctgggattacaggcatgagccactgtgcccagctacaatctcttaattttattgttttttgcataggttgagaacctcccaaatcatcaagtcctggttcctttctgtttaagttcttccctcattttctctctctcctcttgcattttactataagaggcaggaagaaaccaggccgtgccttccacattttatttggaaaccttctcggataagcattcaaattcatcatttacaagctctgtgtcccatatgactgcaggacacaattctgctaagctttctgccagtacagaacaagtttcttcctttctcaagttttcaattacacgttccttaccttgtgaagcagtgccttgagtgttagtgcgtctactaacaggcttttcacgatgattgaggtattcttggaggggatttagcttttctctaaaatgctacttgtttctttctgcactctgagtcttcaacttccacattcctaccgatagtctgttgagggccttctagccttgcccagtggcttgaagatggagagggcaatgtgacaaggaatatggcagccagagaaaactaaatacaccacctttcaagttctaactaaaatgccacttcttccatgcagccttccctgattcccagccagcagggatctctgaccacactagtcacctttgccctgtgtttgtggtcaaggtaaacatgtggcttcttcatgatgtcattacttacatgtttaggaaacatccactgggtactgactaggtatcaagcttcaggaagggagctgaggggaatgcggagatgaggcctccttgtatcctgaccttcaggagctgaaagtttggggtaaatgaaatatgcaaactaccaaaagaaagtgaccacggccacatatgagagcagaaaaagtgtggagggagtgtaaaggcaggaaggatcaccctggcttgggatgtggggctgaagaatcaggagaaattcagggaggaggcaaaaaattaatgaaaacattttaaatatctttgtgtctttccctttattcttctaatgtcttattcctacccattcagcaattattgtggtttgtctgccattcttctagccagagagccttcctgtctgccttcttatccttcctttccttcccatccatccatccatccatccatccatccttccttccttccttcccaaccaccctttcttctcaatcatcctttctaaccaatatttttttcttcctatgcctcctttcttattattcatttatacttctcaccttttatctagccagtgagccttctaacctactcatccattcttcccatacatccattcttcttttctctttcacctttctacacatccttccttcttgtctctccttccttccttccttgcttctccttcgctccagcccttccttccctgcctggatgtcctgcttttcttctatactatctacccacccatctcatccacccatctgccttttcttctgccttctgtgatggttaaattttttctttctttaagacagggtgttgctctgtcaccgaggctggaattcaatggaacaatcatggctcactgcagccttgacctcctgggctcaagtcatcctcctaccttggcctcccagatagctgggaccacaggtgcccaccaccgtacccagcgaatttaatttttttttttttttgtagagacgaggtctccctatgttgcctaggctggtcttgaactcctaggctcaagtgatctgcctacctcatcctcaaaggatcttcccaccttggcctcccaaagtgatgggattacaggtgtgagccacagtgcctggcctgtgatggttaagtttatgtgtcaatttagctgcactaagggatacccaggtagacagtaaaacattatttctgggcccatctgtgaggatttttccagaagagattaacattttaatcggcagatttggtgatgatctgtcctcaccagtgtgggcaggcatcatccaatccactgacggcccaaagagaacaaaaaatggaggaggaatggcacattcacattctctcttcctgagctggcacatcaacttctcctgtccttggacgttggagcttcctgttctccggcatttggactctgggacttatatcagtggcccctctgattgttgggcctgtggcctccgactgggggttacaccactgctcccctggccttgggccttcagactcagacagaatcacaccacaagctttcctggttgtccagcccatgactgcatgctgggggacatttttgtgtctgtgattgcatgagccaattcccataataaatctcctcttattataaattttttttttttgagacaaagtcttgctctgtcacccaggctggagtgcagtgtcgtgatctcagctcactgcaacctctgcttcccaagttcaagcaattctcctgcctcagcctcctgagtagctgggactacaggtgtgtgccaccacacacgggtaacttttgtatttttagtagagacagggtttcaccatgttggccaggctggtcttgaactcctgatctcaaatgatccatccgcctcggcctcccaaagtgctcagattacaggtgtgagccaccatggctggcctctttttatttatttatttatttattttgagacggagtcttgctctgtcacccaggctgaagtgcagtggcacgatctcagctcactgcaagctctgcctcctgggttcacgccatcctcctgccttagcctccccagcagctgggactacaggcgcacatcatcacgcccaactaatttttttttgtatttttagtagagtcggggtttcactgtgttagccaggatggtcttgatctcctgacctcgtgatccgcccgcctcggcctcctaaagtgctgggattacaagcttgagccaccgcgcccggctggcctcctcttagtgtatctgtatatatcctattggttcagtttctctggagaaccttgactaacatacttcctatcctccatctctctatccacacatatttccttcctaataggcatctatccttccatccaacctccttccttcccatttttccattgcttcctcctccatcccctccatcctccctttcttcttacccatctgtccttcccttcttttatccatccaccgagccagcttctttccacacgaatcatctcttcttccttctctaccatctcttcctgctgccctgcaatcagtctgtccctcttctctcttaaagccttattttgtccttgaacactgtgagaagcccgggcagcaagttacagctctcagctctctgaggacactgtctgggcatttatcctccctttgttacccggccctgcccgaggtcagaaagatccagttcacatctatgtccaccggttactagcggtatcaagtccactggttactagcggtatcaagtttcttagcttctgtgagtctcaggttgatggaaatgaacctcacaagtttgctgtgaagattaaaaatagactgaaaaaaaaaaagtgccctcctcacccaatgtcaatacatgatttctgccagtaagcatgggacatttttttttctatcatctttacccccccaccccccacaaatttctacagtgtatagaaaatacttttgcaaacagaatttgtttttttttctttgtttattaatttttttcttttgagacgctctgtcgcccaggctggagtgcaggggcgtgatcttggctcactgcaacctccgcctcctgggttcaagcgattctcctgcctcagcctcccgagtagctgggattacaggtgcctgccaccaagcctggctaatttttgtatttttagtaaagacggggttttgccatgttggccagggtggtctcaaactcctgacctcaggtgatccacctgccttggcctcccaaagtgctgggattacaggcgtgagccaccacgcctggcccagaattggttttaaacattgtttttaaggagagaagctgaacataaaaaataggaataagcatataaagtgccttgtgtagtccatgaccaaaatggtgctcaactgaaaataatgaacattgttagcagagggtgcacgtgagattgctggtgctggctggagctcccctaactccctgacaggctgccagacatggtccctcgctgttgctggtcccacaccccatctcaaagggcctggcccagggagctgccctctgctttggggaagtgggagacagatggtcaggagaacagaaccactgagcactgagcacagctccccgatgggatggacagccttccactcagtcccttacccacagacctaccttcaaaaaggtaatccaggtattcggactccacccagggggacttggagctgggagaaaccgtccgcacgcgtcccttgaacttgttgtacaggtcctgtttcttcaggcacatcatagaacatagcagctccttggttcccgcacactcttccacttcgcgccaccgtctacgggtgggagagctgggggaggagagaggagagcttgggccatggactcagcctctccgggtcagggaacttagagaacagttgatcatgcttccctctgtttggctggactgactttaggtccatccgtccagacaggcagccactggctgagacaggataagaacagcctggtcaggagctcaggttctggagccagatggatgggagtgggaatcccagccctgtccctccctagctttgggaccatgggcaggtccttgcccctaaacctcagtttcctcatctgtaatgcctccctcacaggactgttgcggtggctgctattcctagtactagcgaccattactatatgtttgttcattcaggcgtttatgggccacctgctgcatgccaaggaccatgataggtactctgtggatgtcagaggggaacatgcaggtccatgactccaacctggatacttcagagagctgcctggcccttctatctcttctgccacgtgaggacacagtgtttgcccttccgctatgcgaagacgcagcgagaaggcaccatcttggaagcagagagccgcccttaccagaacggagtcaggtgccaccttgaccctgaacttcccagcctctagaactgtgagaaggaaattgctattatttattaattgctattatttattaatagcaattattagaattacaccattctaaggtattttgttaaagcagtacaaatggactaagccagagacccagggagcctaacattttattttaatttttattttttgagatggagtcttgttctgttgcccaggctggggtgcagtggcatgatcttggctcactgcaacctccgcctcctgggttcaagtgattctcctgcctcagcctcccgagtagatgggattacaggccagcgtaaccacacctggctaattttgtatttttagtagagacagggtttcaccatgtcggccaggctggtctccaactcctgacctcaggtgacccacccgcttggcctcccaaagtgttgggattacaggcaggagccaccgtgcctggcctaacatgtttttacaagatcactctggtcaaccagcaaggaggccatggtagggatgtgagacaggatgatggtggagacagtgagaaagggctggattcaatatctattttggaggtaataatagaactaatagaacttgctaacggattggatgtagaatgtggggaaaaggagaatcaaggattgctcctgggtttggggagtgaccaaggatgaatggagaaggctgagatgggggctgacacaaagatcagattttgagaaagaaccaattcctctgttttgtttcttcatggaaaatgttatactatgcaaatattcacaccaaaggaaccagtgtagttatattaacaggagacaaaatacagacttccaagtccaaagcaatactaaagatgaaaagaacattagataatgataaatgattccattcaccaggaagacagaaaaattctaacttatgtgtgcctactaaacaacttcaccctctataaagcaaacagacaaactacaggtagaaagtgaacagccacacttacaacaagaaattttaatacatctcacccagcaattgatgaatagacaaagaaaaataaatacataaataaataaagaacaacacagttatcaagttggtctaatgaacatatacagaactaactaaacaaattggttgaaccacatgtgaactattaacaaaatattaacacaaagcaattcttaagaaattttaaagaataggtatctcataaagtatttcttctgattgcaaaacattcagttaaaagttaataacaaaaagagaactaaaggaagtttgaaaatttaaaaaaatatatattttttgagacagcgtcttgctctgttgcacaggctggagtgcagtggcacaaacatagctcactgcagcctctactcctgggctcaggtgatcctcctgcctcagtctctgagtcactgggaccacaggtacctgccactacacccagctaattttcttttctttttttttttgagacagagtctcgctctgtcatccaggctggagtgcagtggtgcaatctcggctcactgcaaactcctcctcctgggttcaaagaattctcctgcctcagcctcccaagtagctgggattacaggcacctatcaccacacctggctaatttttatattttagtagagatggggttttaccatgttgcccaggctggtctcaaactcctgacctcaggtgatccatctgccttggcctcccaaagtgctggtattacaggtgctgggatgagccaccactcctggcccagctaattttaaaaaaatattctgtagagagggggtctcactttgttgcctaggccggtctcaaacttctggcctcaagcaatcctcccacctcagcctccctaagtgctgtgattacagatgtgagtcaccacacctggccttaaaaatattttttaaaacaacccatagatgaaagaattataatggaaattaataaatagctgaaagtgaatgatcaccaaataacacaaatgaaaacgtataagacagctaagtaatacttagaggaaaacatatagctttaaatacttataatagaaaataagaaagaatagaaattaataagctaagcaataaatgataagaagccagaagaaacatgtcacaaaaacatatccatgaacagatcaaaactggaacctgatacttcaaaatgggcaaaagacagtaaaaagtgatgcaggacaagaaaaaaccacataaaacctaattagaaaaactcagacacagaaaagaattatatatatttttaaaaagcaaaattcatttcagaagtgaagaataaatcagaaggaatacaagaacaaattaacacaatagatgatgccttaaaagaaacagaaggcaagaagaaggaaagttaaaaaaatatgtaaaagctaaaattatagaacttccagaagaaagcatagaagaaaaatcttcatgaccctgggtcaggcgaatattgcttaggacaccaaaagcgttaactgttgaaggaaaaaaatctgatatattagtctgtgagggctgccatggtaagacaccacaggcagggtggcttcagcaacagaaatctggaggctggaagtccaagatcaaggcatcagcaggtttggtttctactgaggcctctctccttggcttgcagatggccgtcatcttgctgtgtcctcacaaggccgttcttctgtgtgcatgcgctcttggtgtcttcctcttcttataaagacaccagtcctattagattagggcccacccttatgatctcattttactttaattacctccttaaaggctcatctccaaatagtcacttagaggttagggcttcaacatatgaatttgtggggtagagtataattcagtctataacacctgatatactggattttatcaaattaaaatatttttctcttccaaaaaaaaaaaaaaaacccaccaaaaaagcctaacgaaaatgaaaaggccagccactggggaaaaaaatcacaatacatacactgataaaggatttgtattcatagataactcaataataagaaaataaatgacctaataaaaagtggaaaaatatttgaatagtcacttcacaaaagatatatgaatggccaataagcacatgaaaagatgttcaacatcattcatcattagggagttgtaaattaaagccataataaaatactactacatactcactagaatggttaaaatgaaaaagactgataatactaagtgtaacaagcacatggagtaactagaactctcatgtattgttggtggcaatgaacaatggtacagtcactttggaaacagctcgacagttccctgtaatagtacacattcattacctaatctcctaaatcttaaccctagatccatttttcttctccctccctccctccctccttccctccctctctttcttctttccttcctcccctctctctcttttttttagagacagagtctcactctgtcacccaggctggggtgcagtggtgcaatcatagttcactgcagtctaaaacccctgggctcaagggatcctcccacctcagcctcctgagatggcagggctacaggtgtacgccaccatgcctggctaattttgaaaattttttgtaaagatggggtctcactatgttgcccaggctgatactcctagatctttatctaagagaaatgaaaacatatccacacaaagacttgtacatgaatgttcacagcagcttaattcataatagccctattatggacgaattgagttcccccaaaattcatatgttgaagacctcatccccagtggtattgtgttttgagataagagctttaaagaggtaattatggttaaatgaagtaataaggctggggccctaatccagtaggactggtgtacttgtaagaagaggaagagataccagagtgaacacacacagagaaaaagccacgtgaggacacagcaagaaggcagccatctgctagccaaggagagaggcttcaggagaaactaaacctagcaacgccttgaccttggacttccaacctccagaattttgagaaaataaaattctgttgtttacccagactgtcgtactttgttatggcagccctagcaaaccagtgcagatttgggcaccagaaatgaggtgctgaggtaatcaatacctaaaaatgtggaagtggctttggaattgcataatgggtagaatcttgaagtttgaagtgcatgttagagaaagcctatattgccttaaaaagactattggtaggaatatagacattaaaggtgattctggtgaggtctcaggtggaaaagaggaatgtgttattggaaactggaggaaaggtgatccttgttataaagtggcaaagaactggttgaattgtcttctagtgttttgcagaaattagaagttaaaagttcattggctagccatctcaaaaatgataatataaaataaataacaaaaagataatttaaaagacataaacttggatgcttagcagaagagatttctaagcaaagtgctgaaggtacaacctggtttcttcttactgcttatagtaaaatgtgagagaagagatatatgaaaagaattggtaagccaaaaggaactagaacttgaagctttggaaaattttcagcctatccacattgcaaaaaaaaaaatgagaaagcatgttctggggaggacactaaggttgtggctagaacaaccttttgataaagagatcagaggtgcaactcatagacttaatcagccatttaagcagaaattagacatactgatgggattataccagcagaggcacttccagctttgactaaaggggacagagatgggacagaatgaaggaaggctgttggacttctgggattctaaagaaagggacaagagctggagctatttggctgtgaacacgcaatatccttcaagtatagggaaaaatttcctggaagatgattcagagatcagcagggttgtcactgccaccaaagacctggaggcaacactgtcccctccttagtttcagcaggctaggctgctgctaaccagtgactcgagggtagggtcaccacccagggcaaaggggatagggctgccgccccagtgggcccaaagggcagagcactgagccaaagagggctattcttgaaacttaaaatctaatggaatttgccctgcgaggttttagacttgcttgggacctgtcactctttccttctttcctatttttctcttttggaatgggaaagtctatcccatgcatgtcccatcactttattttcaaagcacataacctgtctggtttcacaggttcataagtggagaggaatttggcctcaggatgagtaacacctccagtcacacccatacctgatttagatgagactttggacttagagtagatgctgaaatgggttaagagttttggggctagccaggtgcagtagctcatgcctgtaatcccagccctttgggaggccaaggcaggcggatcacctgaggtcaggagttcaagaccagcctggctaacacggtgaaaccccatttctactaaaaatataaaaaattagccaggcgtggtggcgcatgcctgtaatcccagctactcaggaggctgaggcaggagaatctcttgaacccgggaggcagaggttgcagtgagccgagatcacaccattgcactccagcttgggcaacaagagcaaaactctgtttcaaaaaaaaaaaaaaaagagagttttggggctgttgggagggggtgaatgtattttgcatatgaaaaggacacaaattttgggaggccagagggcaagcatatggcagccctagcaaatgaatacctgcccagaactggaagcaacccaaatatccactgacgggaaaatggattaacaaatgtcatacatagtcatacaatggcattactactcagcaataaaaaggaattaactactgatacatgtaacaatgtgggtgaatttcagaaacattatgctgagggaaaggagccagacacgaaagggtacatactatacacatccatttatatgaaattctggaacaggcaaagtttaatccacagtgtcagaaagcagatctgtggttgcctagatctggaggcctgaatgcaaagtggatgagggaactttctggggtgatagagaacgtcttacatcttgattgtggtggtgggtacgtgggtgcccacttttgtcaaaactcatcaaattgtatactttaaaatgggaacagtttattctatatacattttaactcaataatgttggttttaaaagaaaattggaattaattcagcacggcaagctatgataagaaatgtgcgctcttagctacaaacatgtcagctaaaagcagactagagtttcaggaaaaataaatgtaaccaagagaaagattacaaataagatgttgaataatctcacacatggaagcatacagttttttaaaaactcaagagtgaaacctatttcatttagagagcagaatagtagatagatagacagataaaaggcatttgaaagaaaaagacaagtattctctcctttttctttaatttgagacagggcctcaccatgttgcccaggctggtctcaaactcttgggctcaagcgatcctcctacctatgcctcacaaagtcttggaattataggtgtgagtctctgtgcccaaaagacaaatactgaacacagaaaaagaagatccaacatacaagtgatatgagtccctaaagaagaaaatcaaaacaagagaatagaacaaatactaaaactataatttaagaaaaccttcctaaaataaaaatgccttggaaccatgtattaagtgagaatattgagtgcctaaaaatatcaactcagaatgaatgagcaataccaacacacagtcaaataaaattactagattttaaagaaaaagcaacaaccctttattagtcagggttctccagaggaacagaactaataggttatacgtatatatgaaagggagtttattaaggagaattggctcacacgatcacaaggcgaagtcccacgataggccgtcagcaaggtgggaaagaaagaagccatagtgactcagtccgaatctgaaaccctcaaaaccagggaagctgaaagtgcagccttcagtctgtgaccaaagatccgagagcccccagcaaaccactaacttaagtccaagagtctaaaggccaaaaaacccggagtgtgatgttcaagggcaggaggagcagaaggaagcatcccgcacgggagaaagaaggaagctggaagacccagcaagtgaagctatcccaccatctgccacctgctttccagccagcctggcagccagttgggttgtgcccacccacactgagtgaggacgagtcttccattcccagtccactgactcaaatgtcagtctcctctggcaacaccctcacagacacccccagaaacaaaactttaacagccatctaggcatccttcaacccaattaagttgacacctaatattgaccatcacaaaccctttgggcgaaaagagcaagaaactattaagaggcaagtatgtatgttttgggataaagaaaatgagtaattatgggtcattctagttctatcatgtcccctgtccttgagaaacaggattctcagtgtgaaagaaagaaaatatagatgtaccatagaagtcaggtaaaaatcctaaggaactaaatttagatgggaagcacccgtataactcattaggcattttatcttaaaaattatgtacatgtaggctgggtgcgatggctcatgcctgtaatcccagcattttgggaggccgaggggggcagatcacttgaggtcaggagttcgacaccagcctggccaacatggtgaaaccccgtctctactaaaaatacaaaaattagccgggtatggtggtgggcgcctgtaatcccaactacttagtaggctgaggcaggataatctcttgaacccaggaggtggaggttgcagtgagccgagatcatgccactgcactctggcctgggtgacagagtgaagctctgtctaaaaaaaaaaagtatgtacatgtgtgtgtctatgtggtatacacacatcactctgttcactgaaaacaccaaaagcaatagctaagtagtgatcagcatagctagcatgcagattatagtctttataaccatttcttactaaatggagaaatggctgactgcaggttttaggtcaggaattgtaccagagggacctggaacatcttgtcgtaatggacagctggaaaggtatctgttaaatctggaaagatttaacttgaccactagggtcaagttaaaaggactcaggagcaaacttgatgagactcccactggacagagatgaggcaattcaagcttcaatgagcagagtacgtcgcaatagactgaaaccaccaaatgtgtttaaatgcctgagttcataatgataataataaactagcaatcacctttgggagatgataaggaaccaattcattatcttgaaaattgataaaggaaaaaaattaagcatttatcctctcttgcctatttgaatagtatgactggatatcaaataccagatgagaggatacatctctttataaaataattccaactaacaaatgaaaaaaattatataattagaatatcaccattctaatgtataaaagacatgaaaaatatcatagaagttcagaggatagactttctttctttttaggatcttgctctgttgttcaggttggagtgcagtggtgtgatctcagctcactgcaacctccatctcctgggctcaagtgatcctccccacctcagcctcccaagtagctgggaacacaggcacatgctactacacttcactaattttttgtattttttttttttgtagagacagggtttcaccatgttacccaggctggtctcgaactcttggactcaagcaatctccccacccacctcggcctcccaaagtgctgggattacagatgtaagccaccatgcttggtcctagaggatagactttcaactccttaataaatttattccagccatactacgcccagctgtgtgactttgagcaacatgcacccttggtgcttcagtctcctcctctgtaaagaggcgtactgaacttgtcctcagagagctgctgtgagattaagttcattacatgtgttgacacagtgccagccacacagtaaatattaggtgttttctggcacctgataacgctcttgcttttgaaagctctcttgcagtctgtccctgctcaagccaggctcccatcactcacatgtggattccacacatggaaggatgacgtgatgcaacaggaagggcacaaatgttggagtcggacccgagttccccttctggctccatgacgtccttcctcagacaagacacagcaccctctgagctcaatcccctcacctctagaatggggaaaacacagagcctgcctggtcacattgggagaaggaagtgaaatattcacgtagggcccttagcacttggcctggcacaggacgggtcctgaggacacggtggtcccctcctcttcctgctttcccctcctcaccaactccaggtgaatcctcccgagcttctgcttctatcatctcactgtcctgctaaagaactctgaacgattcccatctatgttcgaagatggtggatctgcttccattgtcagatttctctggattcgctgtggctgcctgggcttccaaattgagaatgatcccatcgggaaaagtgtgaccatttggccaagcgcggtggcttacgcctgtaatcccaacactttgggaggctgaggtgggtggatcacctgagctcaggagttcgagaccagcgtgggcaacatggagaaacctcgtctgtattaaaaatacaaaaattagccagatgtggtggcatatgcctgtaatcccagctactctggaggctgaggcaggagaatcacttgaacccaggaggtggaggttgcagtgagccgagatcaagccactgcactccagcttgggtgacagaccaagactctgtctcaaaaaaaaaaaaaaaagagaaaaaaagtgtgatcattgagggatgcctaattgcccaggtaacagctcctctgctgtgtacctagttgcctcactgatcagctgggacagctccaagcacctcatccagccacttgagaatttcatcctctggcccccacagctacatccatgccccacaccaactttcctcaaagacttacccccgccccggcagactggtcacctgtacactgctcttcattcaacatcttccccacctccagacctttatcaaaagcccctctccaaatgccggccacatgccatctcccgtagggcccagagagctagccagtgctgcccacactgggtgcagctgtcccagagaagcccctccagcccccacccaccccctcagtcttcccatccaccagccgagagagtcccctctacctctgataggccacaaaataggtcacatcctgggggttgccaagccctgggagccatgtcaggtacacgctgaagttctgggagagcagcgtcacattctggggaggggccagacggggcctccctgggggaaagaaaggggtcatgaagcctggagctcctggctggtcttgactcaggccatcccaagctgaggggcagcacgaagggcaagcaggtgctcactgagtttgaggaaccaggagccactgactggctgtactgcagcccttgtgccatgagagaagaccctttgccaggaggggaggctcctgcacactctgggaccggagggttccagcagaacaccatggaacaggaacctaatggcctccaggagggagcatccttgaggatatcaaggaccaggggctctgtcctgttctcagccacatccccagagcctgcctgccatggcctcagcacatagtaggtgcacaataaacatctgttgagtaaatgaatgaatattacaataacatgggttacaccaaaggcttcctgaccggtctccttgcttccaaccttgtgtaagggagatgacacagcaaaggttgctgcctaggcattagaagtagatgccacactcagatggtccaagccagtggccagagataagaacttcgaggcatctctccctcccggcaaactgggctccccacttcccacccattcctttaaagggatcattcaagcatttgccctcaaacttaacctgacccacaccctagtcccttacataatatacttctcattgccacaagctctcactttctttttgcctgactcttcattcccgcttcatgtagcccaggatggaggatgaccctccctactcattgcaccttccctgctcaggatctgtaagtaataagcctttgaacttgttttgcattgaggtggtgtactgaatttgcaccttccatctcaggaacccaggcccagcccaggcctggttttccctgggttgctgggaacacagtctggctcccagcgccagagcaatggtcagacaggcataaacttggacatggatcagacaagagtcacagggacgtctgccagtataaacaagtgtgaaggacccccagccatgggttagacagctaggctattaggctgtccgccaggtaagaagtatttcatgggccgggcgcagtggctcaagcctgtaatcccagcactttgggaggtcaaggtgggcagatcacctgaggtcaggaattcaagaccagtcttggccaacttggtgaaacctcgtctctactaaaaatgcaaaaattagcagaacatgatggcacagggctgtaatctcagctacctgggaggctgaggcacgagaattgcttgaacccaggaggacgaggttgcagtgagctgagattgtgccactgcattccagcctgggcaacagggcgagactccattccaaaaaaaaaaaaaaaaaagtgttccatgaagggcacactgtaagtacccacgcccagttcgctggcattattcattagggcaggcttgccagccactctgctactggaaccctaatttagctggaggcgatcaaaagcccttgtcccaaggtggatgatcactaaatccacatttggaggcatgttactatggaagtttaggtgacacctatattcattatttatttcacaatttcatttttgtattcacatttcagatttgtgaatgcagtttttttcctgaaaattcattttaacttgaaagtatgtttttaattcccctgatgtaattaatggactatgtgcatatttatacctaggtgtgcttacatgttaataatgtatttgcatagttgtgagaatttcatattggactccatagtggtaaaaaaataaatacaggccgggcgtggtggctcatgcctgtaatcccagtactttgggaggctgatgtgggcagatcccgaggtcaggagttcgagaccagcctgaccaacatggtgaaaccctgtctctactaaaaacacaaaaattagccaggcgtggtggtgcacgcctgtaatcccagctactcaggaggctgaggcaggagaatcgcttgaatccgggaggtggaggttgcagtgagcagagatcacaccactgtactccagcctggtgacacagtgagactccatctcaaataaataaataaataaataaataaataagtaaacacaacatctgtcatatacatttcttttctgttggtttaagaaaatatctgacagctttacctacttctgcaggttcatccaagcccagatattactgaacgaatatattgatgtagagtatgtgttattttgttttcagttctgctctagatcataactatgtaaaaaacactgtcataatcagttatactaaaattcatgagcccaaatgtaagatgaaaagtctgcactgtagtctaaggtcattgctctatcaataattacattctcattttgatttacagaagagctttatggtagaaacaccagaaaacacctcatactattaaaaggctttttccccattaaaaaaaaaaatacaggtcgggcatggcagctgacacctgtaatcccagcactttgggacatcgaggcaggagaatcatttgagaccaggaatttaagacttgcctaggcaacatagtgagaccacatctctacaaaataaattttttaaaaaattagcagggcacaatggtgagagtaaggaggctgaggtgggagtttcgcctgagcccaggagttcaaggctgccgtgattgtgccactgcacttcagtctggccaacagagcaagaccctgtctctacgaaacagacaaatatacaaaacaccttgccttcagtccattctccacatagcaggaaggattaaaaatgaaaatcagatcatgttcatcttctgcttaagccctctaaaggcttccatctcactccaggtaaactcaaaagtctttattatttttattttattttgaggcagagtcttatgctgccacccaggctggagtacagtggcacaatctcagctcactgcaacctccacctcccgggttcaagcgattctcctgcctcagcctccagagtagctgggattacaggcatgtgccaccacacctggctaatttttgtatttttagttgagacgaggtttcaccatgttggctaggctggtctcgaactcctgacctcaggtgatccgcccaccttggcctctcaaagtgctgggattacaggcctgagccactgtgcctggtctaaactccagagtctttacaatcaccaccaaggccctacccaatctgacccaccactcctcccttgctcccatatctccatccacacaggactttttgcccttcctggagcaccccagccacactcccaactccaggcctttgcacacgctgttccctcatgctgttccctctgccttaacagttctgcccctggatatccacctggctcactcctttgctgttttcacattcctttgatgtcactgtctcgaggacactttccctgactccctttaactgacctctattcccctctgtggcacattttccttctcactgttaatcttcatcttctgaaatacgcatctgattacaccactccccagtttcatgccctttccttggcctcagaataaagtccacatttgttattgaggtttgtgaggccctgcctgacgtggcctggcctggcctggccaggccgtcttgctgctctctccccaacagctaccctacaggctcatcaggcaatcttcctgctcgatgttgccaagccactgcattcttctggatgtttttaaacccaggtgtctttgactgcctggtattcaccatctagtctttgaaatacttgattcaaatgtcacttcctccagggaatcttccttgacatatctacgaggtgatgatgatgatgataacgatgatgataataatagcagctaaggccgggcatggtaactcacccctgtgatcccagcattttgggaggcagaggtaggcaaatcacctgaggtcaggagtttgagaccagcctggccaacatggtgaaaccacgtctcttctaaaaatacaaaaattagttgggcatggtggcacacgcctgtcatctcagctacttgggaggctgagacacgagaattgcttgaacccgataggtggaggttgcagtgagccgagattgcgccactgcactccagcctgggtgacagagtgagactctgtctcaaaataaataaataaaataataataataataatagcagctaatgtgtattgtgttctgtgagccaggttctgtgctaaacagtttacctgcactttctcttttaatcctcattacatccctaggaggtaggtattcattataataattataatcgttacagatgggaaaaccaaggccctctcagctattaagttgtagaatcagattcagtccaggcctagccaactccaaagtccgagctcttgactgtactttgtcttctaggttctcatggggtctattgagctttatgattccaactattccatctattgaccactacgagtcaaacaagatctgttgaccacggtgtgccaggggtttcaaagaagaacacaacttcattcctgccctataggagctcatggtcccatggagaattcagggtcctgaagtgtcccatgtgccatgatggaaatccatacgggttgcaaaatggcatcagggagggagggtccagttctgtggatggctgtccccagcctcggctgcctacccatcaccttctagacccaaaagtgggtgcctgcttccacctcatcctgtgtcctctagctgggactgtatcaccacgaggctagtgctattactactcccagcttctggacttcctaacgggtgaccagcaggagaccaggctgtctgcaagccacttgtaaggtatcctatgggcaggacagtccccagattcgagctaggtcacatgagaaaaacagcagttagagcaactttcctctatgaagccttcaaaggatgccaggcactagtttggctctttacatgtaaaacctcaatcacccttgggacagaccaccctatggggtaggtgtcattcattctgcttccatggaaagggcgctaggctcagagacagatgctaactaacttgcctgaggctacacagtcagtttgtgtgggagccagtatttgaacttagatctggctgtacttactcctaaatcatcacaccatagttagtgttgtgtatattaaatacttatcaggtgaaagtacaagaaggtctgggtttgacagtgaaaggggaacagaagaccccaccctccctccacacacaggtacacggtccctcatcagccacagagaacgctgctgtgggcactgggggctggagcatccctggctggcctagtgacccagtggatggacagcctgtcccacgtgcctaccctggaggcaaaagctagccaggcttgctttagcccctcttctctcttctgtgtgcctcacctctgccatccttcttgaggaattccctgaattgctctgagcctcagttttcccatcggaaaagtaaaaataatatctacctccgaggatggctgggtcgtgaggcttccagaataatgcggtgcctggcacaaagaagttgctgaataaatataggcttttatgatgattggattatgcccagggacctttacagctctttaaactgtgagtccaagactaggaaaatatcctgggggcgatttctggaccttctcttccctgcttcggttggagtcgtgggcggtgaggtttggtggttgggtcctacggcgaggaattttgtacctgacaccttactcatcagtagaggtgggaaaacaacaacaacaacaacaacaacaaaacaacaacaaaacaacaaccaccaccaaaagaaagccgtcttgttagaaagcagggcacaggcgaccagagctccgtcccaccagaggcctggcaggaacgggaagggacatcaatcggtcccactttccctgctgtccacactttagggtcaagtgtggttttcacgcagggatcagtgctttctttaggaaacattaaaaagcactttattaaaaaatatgcagtatcaaactgccgctgtcttttttctccagttctcctgaagctggaagcattaggaaactggattcgtttcctgcgggagaggaatatcaaagacccggttctgttcagtcctgggaagaagcaaactgggggcgcgtaggcagggccgattcgcacccggctcgggtggctgcggaccccgtgcctgtcccaggagctccgggtccgagggtaggcgcggcccggcccggggagccctcttccccctccctcccgcggccccgcgcccttacctggagcggcctgcagcaggcacaggagcagggggccccagcgctcgggccccgccatggccttcctgccgcggcgtccccgccc

SEQ ID NO: 186 - DNA, 33119 bp, Homo sapiens; identical to SEQ ID NO: 185

SEQ ID NO: 187 - DNA, 33119 bp, Homo sapiens; identical to SEQ ID NO: 185

SEQ ID NO: 188 - DNA, 130789 bp, Homo sapiens
ggagagaaaggacgcacgcttcccgccattttgttcagcttgccgggcaaccggcccctgctggggactacaagtcccgtaagcctccgcggcggcacgtcctaccctacactgtccagccggctccctttttccccctccccgggggccaagggctccggctgctgcctggcggccaacgggccaggtaggatttccgggagaggctgctgtggaggctgaggaggcggcggcggagatctgggtaagttcagcgagcaagggaaagtgagcaggacgcgctcagtatcaggctgcggcctcctctcaggctgcggcccctttcttggctctgcgagagggtcccggtccgggcagaaggtaacggcccgggtcgccgtcgcttcgggccagggcggggcggggccgccgcctccctcctcggccctcccacaacggtccaacccgggcttctccgcctgaggcagggcccgcgcaggctcgccctctccgccccccgagacttggctgggcccttttgtctgggctgcgttgctccccctttgtgtccgtgcatggagtctccgccacgggggagcctgttcccccggtccccaacagggactgctccctggggatccggttacagtaaccggatcgggtcaaagtacatttttcaaaaccgtcctgcctcagacctctgcacccctgctgggcagaacgggggcttcggagccaggcggagtttctgtaaaaacctggaggttattatttaactttcaaacatcagcctgggcggcttcagggcacgaaactcccgacgtttttcttggtggagagatgagattaaggaaaagaagcgacccctctctcccaccctctacaccccggctccgggaaaccgggaaggcatcgaatttgctgcgatgtctgtgcagctcacatctgtgatcggtggaccaaagaaccagtggtgaatggtagaatggcagttcacgcacctcccaaatctcggaggagagtgacttacagggcatcactgattgcttgcaaaaaaaaaaaaccctccagtgcttcattcggacactcagctcctcgctccttccaacctcttccttttcttgttctttttaaaacaaacagtggaaggaaaaagtccttcagtggaagaatttgctttatagaggaaccagaaacccagtggcttctagaagtcacttactttttcgccaaattaaagaaatgaatttcgggcgtggtggcgcgcgcctgtaatgccaactattctggaggctgaggcaggagaatcgcttgaggccagaagttcgcgaccagcctgggcaacacagcaagaccccatcttaaaaaaaaaaggaatgaagcccgtttagaaatgaagccagtttaggggatgaggtgtggtagattcttaccggaaaccgcggaactgcgtggattgtggattcgatcaaatttggctagataatggtaactgtgtatgtcctcctgttggaagactgcattgctagaatcagcttaaggtaaaatttgtttgtttgtttcatttaagagacaagagtctagcttggttgctgaagcttgagtacagtggagagctcctagttcactgtagcctcgaacttcttggcttaagccatccttccaccagaggctcccagatgcctgggactagaggcatgagccactgtgcccgactatttaatttaatttatttatatttatttatttattttgagacaatctcactttgttacccaggctggaatgcaatggcacgatcttggctcactgcaacctccacttcccaggttgaagcgattctcctgcctcagcctcctgagtagctgggattacaggtgtgtgccaccatgcccagctagtttttgtatttttggtagaaacaaggtttcaccatgttagccaggctggccttgaactcctaacctcaggtgatccacccgcctcggtctcccaaagtgctgggattacaagcgtgagccaccgtgcctggccaatttttatgtatttattttttgaaatagggtctcgctgggtttcccaggctggagtgcagtgagttgagcactgctcactgcagcctggacctcctcctgggctcaagcctctgcctccagagtagctgggacaacagacacaggccaccagcgcagctaattaaaaaaatttttaaaaaaatttttgtattgattggggtcccactctgttgcccaggctggtcttggactcctgggctcaagtgatcctccctcccaaagtgctggtattaaaccttaagataaagaatactgtatttgttttttgagatagagtcttgctctgttgctcaggctgtgcagtggcgtgatcttggctcactgcaacctcttcctcctggtttcaagcgattctcctgcctcagcctcccgagtagctggaattacaggcatgtgccaccactcccggctaattttttttttttttttagtagagatggtgtttcaccgtgttggccaggctggtctggaactcctgacctaaagtaatttacctgcctccgcctcccaaagtgctgggattacaggtgtgagccaccgtgcctggccaataaaaaattctaaagaaggtcattgcaaataacccttttgaaaaataggttaattcgtgtttcaagtctctgggatgaggacagccaggaggacccctttacatgaatcagggaaggttactgaagttagataggttaattcctgccctagccgagtaggcaaaataaagcccttcaccctgtattactttgtttgatatctcataatggaagtgacttactcttgagaatcctagattgtattagtaatactgtatagggatggtagatccttaatgcagttcttcaatttttaatccagcagtgagtgagggtcttttgtgttttcctggctatagtttgaagaagcaaccacagaattgctctagttttaataataaactggttgggcgcggtggctcacacctgtaatcccagcactttgggaggctgaggcaggcagatcacctaaggtcaggtgttcgagatcagcctggccaacatggtaaaatcccatctctactaaaaatataaaaattagccaggtgtggtggtgggcatctgtaatcccagctacttgggaggctgaggcaggagaatcacttgaacctgggaggcggaggttacagcgagctgagattgcgccactgcactccagcctgggcgacagagggagactcagtctcaaaaaaaaaaaaaaacacagaaataataaactaagaaacagcagttactattgactattgcttaattgtacaaacatgacaattttctcaatattatttatttttatgattattattatttttttgaggcaaggtcttgttctgtcccccaggtggagtaaaatgctatgatcatggcccactgtagcctcaacctcttgggctcaaatgatcctcccacttcagccttctgagtagctgggactacaggtgcacactaccacacttggctaattttttaatttttttgtggacacgaggtctccctgtgttgcccaggatggtcttgaactcctggactcaagcagtcctcctaccttagcctccgagagtgctgggattataggcgtgagccagtgtgtctagctatatatttattcatttattttgtttgttttaaacataatttttttttttgagatggagtttcactctttttgcccaggctgaagtgcaatggcacgatcttggctcactgcaacctctgcctcccgggtttaagtgattcttctgcctcagcctcctgagtagctgggattacaggcatgtgccaacatgcctggctaattttgtatttttagtagagacgggaattcaccatgttggccagactggtcttgaactcctgacctcagatgatccgcccacctcagcctcccaaagttctgggattacaggcgtcagccatcacgcctggcccataattttataatttttatagagacaggtctcgccatgttgcccagcctggtctcaaattccttggctcaggcgatcctctcacctcagcctcccaaagtgctgggattacaggcatgagtcaccatgcccggcctcccagtaccattttttaaacaaattaatacacattgtgtcatttaatcctcactacagttctgtgagatggttgttactctcattttacagctgataaagcctagcctctaaaatgttgaagtgacttgcccaaggttatagttaacccaggtaggaaatatcagagtaaaccatacttcaaatctagtcctctttcagttacctcacacttattacagctactaatcttagcagcaccaacagctttaatttgctaaaatctaaatattggagaaaatggaaaatattttccaattaaggcaaattgatttacaaggaactggaatttctggaaccataaacaatgagtctttctcttaaattatattgaacattggtcccattactttgtcttctcatatgctgtgattaccttgtgcctaggcagaatggcagttttatgcaacgctcaaaaagtggtgagttactcagttttggttccccctaatctttgctataaggtttattaaatatgttggagaacataaatacaatagctttggctgctgaaactaacattgaagacagaaccaaaattaagatactgtacttttttagtcagaccatcgggactcaagagaatgctctctctagtttctgcttttaataaaaacttttaatcagtttcaaacctgcagttaagtcttggatttatgttagtacatgccatgaatgtgacatcagaaacagaaacctatttcacctcccttacttattaggtaaaatgcataacatgccaatggaattgagtcaatacaattatgtagtctagcctttctaactggtagtagcctgtttgaaatcttttattattgcattataatgggaaagaactttttttccttgtgcttttgctgttggtttacttcatttccaaaaccatctgttcattcagtcaacaaatacggaaagtctgttatattctaggcactgttgtagacattgaggacaaaacagtgaaaacaagtattttccctcttggggtttacctactgattagggttggctgggaagaggaaggagtctgacagtaaataagcactaaataaataaaattccctcatataactgcaaccttgagcaactcaacctctttgagctttagttttcttgtctttaacatggatgtaattgattcctgctcttcctatcttgtggattgtttctaagagggagtagaataagtatttggatacattattcgcttcaaattcctgtagcaagttatttttactactattagaagaagaggcccagcacggtggctcacgcctgtaatcccagcactctgggaggccaaggcaagcagatcacttgaggccaggagttcgagacgagcctggccaacatggcgaaaccccatctctactaaaaataaaacaattagctgggggtggtggcccatgcctgtagtctcagttacttgggaggctgaggcatgagacttgcttgatcccaggaggcagaggttgcagtgagcagagattgtgccactgcacttcagccggggtgacagagcaagattccatcctcccaccacccctgcccgcccccacccacccccccaaaaaaaaaacaaaagaaaagaaaacaaggagcattggaagaagattatttataaagagagaggctgggcccagtggctcatgcctgtaatcccagtgcttcgggaggctaaggcaggaggatcactttatgtttatcccaggagtttgagaccagcctggcaacatagcaagactttgtctctacaaaaaaaaaaattaaaaatcagccaggcatggtagtggacatctgtactcccagttactcaggaagctgagataggaggatcacttgagctccacggtttgaggctgcagtgagctatgattgtgccaccacactacagcctgtgtggcagagctggagaccctgtttcaaaaaataagtaaataagtaaaataggaaagagagaagggaatggatggattctttattctgagggagctctaaagtcctgttgtaaaactttcacaatcggccaggcgcggtggctcacgcctctaatcccaggactgtgggaggccgaggtgggtggatcacccgaggtccagagttggagaccagcctgaccaacatggagaaaccccgtctctactaaaaatacaaaattagccaggcgtggtggtacacgcctgtaattccagatacttgggaggctgaggcaggagaatggcttgaactcgggaggcggaggttgctgtgagctgagatcacaccattgcactccagcctgggcaacaagagcgaaactccatctcaaaaaaacaaacaaacaaacaaaaaaaactttcacagccgtgtcttcacaggggctaccataaccaaattatgtagacctttttcttttctcttctttctttttcttttttttcactgctgtggtcccagctactcaggaggctgaggcacaggaatcacttgagcctaggaggtggaggttgcaatgagccaagattgtgccactggactccagcctgggtgacagagtgagaccttgtctcaaaaaaaaaaaaaaattgagacagagtcttactctgtcacctaggctggagtccagtgacatgatcagggctcactgaacccttgacctctctcccaggctcaagcactcctcccacctcaaccccctgagtaactgggactacaggcatgcaccaccatgcctggctaattttttcttttttttttttttcttttagtagagacaaggtctcattatgttgcccagaccagtcttgaactcctgagctgaagcgatccacccgccttggcctcccaaagtgctgggattacaggcgtgagccactgcgctgggcctatgtagaccttttaattttttttttgagacggagtcttgctctgtcgcccaggctggagtgcagtggtgcaatctcggctcactgcaagctccacctcccgggttcacgccattttcctgcctcagcctcccaagtagctgggactataggcgcccaccaccacacccggctaatttttttgtatttttagtagagacagggtttcactatgttagccaggatggtctcaatctcctgacctcgtgatccacctgtctcggcctctcaaagtgtggggattacaggcgtgagccagcgcgcccggccttaatttttttttgaaatgagttttgctcttgtcactcaggttggagtgacagtgtgatctcagcttactgcaacctctgcctcccgggttcaagcgattctccagcctcagcctcccaagtagctgggattataggcgctcaccaccatgcccggctaaattttgtatttttagtagagacagggtttcgccatgttggccaggctggtcctgaggttccaaactcctgaactcaggtgatccacctaccttggcctcccaaagtggtaggattacaggcgtgagcctccgcacccagcctttttttttttttttttgtagacgggagtcctgctctgtcacccaggctggagtgcagtggcgtgaactcagcacactgcaacctccgcctcctgggttcaagtgattctcctgcctcagcctcctgagtagttggggttacaggcgtgcaccactatgccctgctaattttttttttttttagtagagatggggtttcaccatgttggccaggctggttttgaactcctgacctcaagtgatccgcccgcctcagcctcccaaagtgccaggatcacaggcatgagccaccacacccagcccatcaaagctttttgaaatgatctgtaggccaggagtggtggctgcggcctgtaatcctaggatcatgaggccacaaggtggagttcaagactagcctggccaacatggcagaaccctgtctctacaaaaactacaaaaaagttagcttggcatgtggcacgcttctatgagtcccagctactctggaggctgaggtgggaggattgcctgagcctggaaggttgaggctgcagtgagccgtaattgcgccactgcactctagcccaggtagacagagtgaaagaccatctcaaaaaaaaaaaaaaaattgcttactatcttgatggttggtgagagggtttagagaaggtatttatgtacttgttaaaaatttttggccagatgtgttggctcacgcctgtaatcccagcactttgggaggctgaggcgggcggatcacgaggtcaggagattgagaccatcctggctaacacggtgaaaccccgtctctactaaaagtacaaaaaattatccgggcatggtggtgggtgcctgtagtcccagctactcgggaggctgaggcaggagaatggcgtgaacctgggaggcacggcttgcagtgagccaagattgtgccactgcgctccagcctgggtgacagagcgagactccatctcataaaaaaaaaaaaaaaaaatttggccaggcgcagtggctcacacctgtattcccagcactttgggaggctgaggcgggtggatcacctgaggtcaggagttcgagaccagcctggctaacatggtgaaaccccgtctctactaaaaaaaaaaaaaaattggctgcgtgtggtggcaagtgcctgtaatcccagctactcaggaggctgaggcaggagaatccctgaacccgggaggcggaggttgcaatgagccaagatcatgccattgcactccagcctgggtgacagagtgagacttcatctcaaaaaaaaagaaaaaagttttttttttaaccatttttttgtttttctttctttctttctccccccagccccccccccctttttttttaacaacccaagggcacaagggggaaaaaatagaggaagtatttagaatgttttgttttgttttgattttaaggatgggagaggtttgacatgtttgaagggaaagggaaagcagccagcagagaggcagatattggagatgtgcacagagaaaatgtagataatgaagaagtcttaggaggaaatagaatgaaaagctcatgaaacagtaaactttgaagaggaatatgaagaaataaagggtgagagaagatatatttggaagtggtggacatggaaggtgaaataagagtagttgttaccagttgattactgttattacccaggcactgatctaggtttatttatttttatttttatttatgtatgtatttatttttttaagacagagtcttgctctgttgcccaagctggagtacagtggcacagtcatggctcactgcagcctcaactcccctgctgggctcaagcaatcttcctgtctcagcctgctgagtagctgggactacaggcataccgccatgcctggctaatttttgggttttttgtagcgatgggatttcgccacattgcctaggctggtcttgaactcctaggcttaagcgatcttcctgcctgggcctcccaaagtgcttgaattacacgcatgagccaccatggccagcctataatttctttctttcttttttttttttttgaaacagagtctcagtctgtcacccaggctggagtgcagtggtgcgaccacagctcactgcaacctctacctcctcaggctcaggtgggtgatccttccacctcagcctcccgggtagctgggactataggtgcgggccaccacgccaggctgattttttaaaatttttgtagagatgggatttcgccatgttgcctaggctggtcttgaactcctggtctcaagtgatccatccaccttggcctgccagagtgctaggattacaggtgtgagcccctgtggctggccctggcctataatttcttttcttttttttttttttgagatggggtctcgctctgttgcccaggctggagtgcagtggcacaatctcggctcagtgccagctccgcctcccgggttcacgccattctcctgcctcagcctcccgagtagctgggactacaggcgcccgccaccacacccgactaattttttgtatttttagtagagacggggtttcaccgtgttagccaggatgatctcgatctcctgacctcgtgatccgcccgcctcggcctcccaaagtgctgggattacaggtgtgagccaccgcgcccagcctataatttcttatattccataattgtaaaattatttttccataagtggagtaaatattatattctcaacttgtgtttctattatcaacttttttttaacttttggacagactaatttagatgtgtgggataaaaatgttattctgtgtttttttaaatgtaactttttttttttttttttttttttgagacggagtctcgctctgtcgcccaggctggagtgcagtggcgcgatctcggctcactgcaagctccgcctcccaggttcacgccattctcctgcctcagcctcccgagtagctgggactacaggcgtccgctaccacgcccggctaattttttgtatttttagtagagacggggtttcactgtgttagccaggatggtctcgatctcctgacctcgtgatccgcccgcctcggcctcccaaagtgctgggattacaggcgtgagccaccgcgcccggccttaaatgtaacttttatgttcagagatatatgtgcatggtttggtatacaggtaaacttgtatcatggaggtttgttgtgtatattattttgtcactcaggtattaagcctagtgcccattagttatttttccagatcctctccctgctcccatcctctactctccaataggcaccagtgagtgttgttcccctctgtgtccatgtgttctcatcatgcaatatttggaacatgtgatatttgtttttctgtttctgcattagtttgctaaagataatggcctccagctccacccatgttcctgcaaaggacatgatcttgttgttttttatggtggcatagtattgcatggtgtatacataccaccttttctttatctagtctacttttgatgggcatttaggttgattccgtgtctttgctgttgtgaatagtgctgcagtgaacatatgtgtgcatatgtctttataatagaatgatttatattcctttgggtatataaccagtaatgggatttctgggttgaatggtatttctaagtctttgaggaattgccacactgtcctccacaatagttgaactaatttatactcccactgacaatgtataagcatttctttttctccacaatctcgccagcattattttttgaattttttttttttttttccgagacagagtcttgctctgtcacccaggctggagtgcagtggagtgatctcggctcactgcagcctctgcctcccgggttcaagcaattctcctctcagcctttccagtagctgggattacaggcccacaccaccacgcccggctaatttttgtatttttgtagggacagggtttcaccatgttggcagtctggtcttgaaatcctgacctcgtgatctgcccgcctcggcctcctaaagtgctgagattacagccgtgagccactgcgcctggccttttttttttttttgagacggagtcttgctctgtcacccaggctggagtgcagtggcgtgatctcagctcactgcaacctccgcctcccgggttcaagcgattctcttgccttagcctcccgagtagctgggactacaggtgcatgccaccacgcctggctaattttttgtgtttttagtagagacgcagttaaaccatgttagccagtatggtctcgatctcctgacctcgtgatccgcccgcctcagcctcccaaagtgctgggattacaggcatgagccactgcgcctggcctggcctatttttttactttttaatactagtcatcctgactggtataagatggtatctcattgtcatttcgattggcatttctctaatggtcagtgatgttgagcttttttcatatgattgttggctgtatgtatgtcttcttttgaaaaatgtcagttcatgtcctttgccgacttttttcttgtttctttttgagacagagtcttgctctgttgtctaggttggagtgcaatggcacaatcttggctcgctgaaacctctgcttcccagcttcaaatgattcttgtgcttcagcctcctgagtagctgggatgactacaccaccacgccaggctaatttttgtatttttagtagagatgaggtttcaacatgttggccaggctggtctcgaactcctggcctcaagtgatccacctgccttggcctcccaaagtgttgggattacaggcgtgagccactgcgcccagccctttgcctactctttaatggggttgtttagttttcttcttacaaatttgtttaagttccttgtagatgctggatattagacctttgtcagatgcatagtttgcaaaaattttctcccattctgtaggttgtttgttcaccctgttgatagtttccttttctgtgcaggagctctttaattagaccccatttatcaatttttgcttttgtagtaattgcttttggtgtctctgtcatgaaattttttttttttttgagacagagtctccctctgttgcccaggctggagtgcagtggcacgatcttggctcactgcaagctccggctcctgagttcactccattctcctgcctcagcctcccgagtagctgggactacaggcgcatgccaccacgcctggctaattttttgtatgtttagtagagacaaggtttcaccgtgctagccgggatggtctcgatctcctgacctcgtgatccgcccgcctcagcctcccaaagtgctgggactacaggcgtgagccaccgcgcccggcctatcatgaaatttttgcccatttttatgtccagaatggtattgcctagcttgtcttccagggtttttgtagtttcgggttttacatttaagtctttaatctgtcttaggttaatttttgtatatagagtaaggaagggatccattttcaatcttctgcatactagccagttatcccagcactgtttattattattaatttatttatttttagacagagtctcgctctgttgcccaggctggagtacagtggcacgatcttggctcactgcaacctctgcctcctggattcaagtgattctcctgactcagcctactgagtagctgggactacaggccccgccaccatgtctggctaatttttgtattttcagtagagacagggtttcaccatgttggtcaggctggtctcgaactcctgacctcaagtgatccacccacgttggcttaccaaagtgttgggattacaggcatgagccaccgcgcctggcctcgtgcaccatttattgaatggggaattcctcattgcctatttttgtctggcttatcaaagatcagatacttgtaggtgtgtggcctttatttctgagttctccattctgttctattggtctatgtgtctttttttgtaccagtaccatgctgtattggttactgtagccctgtggtatagtttgatgttggatagcatgatgcctccagctttgttctttttgcttaggatttccttggctcttttggttccatatgaattttaaaataatttttttttctagttttatgaagaatgtcaatagtattttaataggaatggcatggaatctatacatttcttagagcagtgcggcccttttaacaatattgattcttcctatccataggcatgggacgtttttccatttgtttgtgtcatctctgatttctttgagcagtgttttgtagttctctttgtagagatctttcacctccctggttagctgtattcctaggtatttgtgtgtgtgtgtgtagcagtcgtgaaagggattgtgttcctgatttggcagtcagcttgactgttgttgaggtataggaatgttagtgatttttcacgttgattttgtatcctgaaattttgctgaagttgtttatcagcttaaggagcttttgtgctgagaccatgaggttttctggatacagggtcatgttgtctacagacaaagatagtttgacttcctctcttcctatttagatgcccttaaatacctacttcattgaatttttaacgtgcagtggtattgaattttatcgaaagcctttaatgcatctgttgagataatcatgtggtttttgtctttagttctgtttatgtgatgaatcatatttacgaatttgcatatgttgaaccaaccttgcatcccagggctaaagcctacttgattgtggtgggtaagctttttgatgtgctgcggatttgatttgccagtattttgttgaggatttttgcattgatattcatcaagaatgttgacctgaagttttcttttttttgttgtgtctctgccaagttttggtatcaggatgatgctggcctcatagaatgagttaggaaggagtccctcctcttcattcttttggaatggtttcagcaggaatggtaccagctcttcttggtacatctggtagaattcagctgtgaatccatccggtcctgggctctttttggctgataggctatttattactgactcagtttcagagctcgttattggtctgttcagggattcaatttcttcctggttcagtcttgggagggtgtatgtgtctaggaattatccattttttctagattttctagtttatgtacatagaggtgttcataatattatcagatggttatttgtatttctgtggggtcagtggtaatagccccttttcatttctgattgtgattatatttgaatcttctctctttttgtctttattagtctagctagcagtctgttgtattacttttttcaaagacccaactccaccaggcgcaagggctcatgcttgtaatcccagcactttgggaggccaaggtggatggatcccttgaggcaaggagtttcagaccagcctggccaacatggcaaaaccccatctctactaagaatataattagccatgcatggtggtgcacacctgtaatcccaactacttgggagcctaaggcatgagaatcgcctcaacctgggaggtggaggttgcagttagccaagactgcacctctgtgctccagcctggacaacagagtgagactctatctcaaaaaataataacaaataaataaataaaataaaacaaaaaacccaaatccctcctggatttgttgatcttctgaatgagttttcagtgtctcaatctccttcagttcagctctgatactgattattctcttttgctagctttgggattgatttgctcttggttatctagttcttttagttgtaatgttaggttgttaaattgagatctttgtaactttttgatgtggatacttagtgctctaaatatccctcttaacactgccttagctgtgtcccagagattctggtatgatatatctttgttttcattagtttcaaagaacttcttgatttctgccttaatttcattatttactcaaaagtcattcagggccagtaacagtggcttatgcctgtaatctcagcactttggtaggccgaggcaggtggatcaccagaggtcaggagtttgagaccagcctggccatcatggtagaaccccatctctactaaaaattcaaaaattagccaggcatggtggtgcatgcctatagtcctggcttcttgaaaggccgagacaggagaattgcttgaacctggaggcggaggttgcagtgagctgagatcgtgccactgcactccagcttgggcgacagagcaagactctgtctcaaaaaaaaaaaaaaaaaagtcattcaggagcaggtcattcaatttccatgtaattgtatggttttaagtgaatttttttttttttttttttggagacggagcctcattctgttgcccaggctggagtgcggtggtgcgattccaactcactgcaacctccgcttctgggttcaagcgattctcatgccttagcctcccgagtagctgggattacaggtgtgtgccaccacgcccagctaattttgtatttttagtagagacagggtttcagcatgttagccaggccgatcttgagctcctgacctcaggtgatccgccctccttggcctcccaaagtgctgggattacagacgtaagccaccacgcccggctggttttaagtgaatttcttagtcttaatttctagtttgattccgctgtggtccaagagattgtttactatgatttcagttcttttgcatttgctgagaagtgttttacttccgattatgcaaccaattttagagtatatgccatgtggcaatgagaagaatgtgtattctgtttttcatttgtttgtttgtttttctgagacagagtcttggtgtgtcacccaggctggagtgcagtggtgcgatctcggctcattgcagcctccacctcccagattcaaacaattctcctgcctcagcctcccgagtagctgggactacaggcatgtgccaccaatcttagcaaatttttggacttttagtagagacagggtttcaccatgttggccaggctggtcttgaactcctgacctcaagtgatctgcctgcctcggcctcccaaagtgctaggattacaggcatgagccaccacgcctgaccaattctgttgtttttggatggagggttctgtaggtgtcttatcaggtccctttcacccactgctgtttgaatcctgaatatctttgttaattttctgtctcgatgatctaataatgtcagtggggtgttaaagactctcactattattttgtgggaaactaagtccctttgaaggtctctaagaacttgctttatgaatctgggtgctcctatgttgggtatatatatgtggcggtgtgagccaccgtgcccagccttgtgtttttttaaataatgctatccaattattttcagtagcaattgatttgtgagggcattttgaaccttgtaagacaccaaataatgacgtgtttttattagtcttgtgatactagtatccacctaggtcattagatatttaaaatctgcactttatataggaccaacgatatttaaaaaaatagtgaagtatctttcttacactagtgttgatgatgtgtatatttcttgtttacctgagtatagggctcatagagaaatggttgttctttgggaaagcttaggtgagttgattgtttattaagcaagcttaaaaattagagccctcaggctgggcgagatggctcacgcctgtaatcccagcactttgggaggttgaggcaggtggatcacgaggtcaagagatcgagacaaccctggccaacatggtgaaaccctgtctctactaaaaatacaaaaattagctgggcgtggtggcacgcacctatagtcccagctactcgggaggctgaggtaggagaatcacttgaacccaggaggcagaggttgcagtaagctgagattgtgccactgcactccagtgtggcaacagagcgagaccctgtctcaaaaaaaaaaaaaaaaaaaaattagagccctcaaacagttttccccctcctccagtgagtgacaaatagaaagagggaggattccaagagataatatttaaaaatagccttacatcttcttcccttcattcatggattaatccctgttaaaaatgctgccagtaaatagcaaagaataactgtatagaaccaatcataggatataaaaggactttcttcttccttttacttgcacatacccaattttgcctcctgtcccttcctctaaatttgaatttatttcagggtgagcattatgattcaggatatcagtgcacctttgctgtatgtattaaagggtgaaaggctgggcatggtggctcatacctgtaatcccagcactttgcgggggctgaggctggaggattgcctgaggctaggagtttgagaccagcctgggcagcatagcaagacactgtctctacaaaaaacaatttttttttttttgagatagagtcttgttctgtcgcccaggctggagtgcaatggcacgatcttggcccactgcagcctctgcctcccaggttccagcgattctcctgcctcagcctcctgggtaactgggattacaggtgcacgccaccacgcctggctaatttttgtatctttagtagagacagggtttctccatgttggccaggctggtctcgagctcctaacctcaggtgatccacccgccttggcctcccaaagtgctgggattacaggtgtaagccaccatgcccggcctttgttttttttaattatccaagtatggcaacgtgggcctgtggtctcagctacttgggagcctaaggcaggaagatcacctgagccaggagactgaggatgcagtaagctgtgatggtgccattatgctgcagcctggacgacagagtgagactctgtctcaaaaaaaacaccaaaaaaagatgtcacataatcttaaaatttgtatggaacacaaaaaggctctgaatagtcaaagcaattttgagctaaaagaataaagccagaggcatcatactgtcttatttcaaaatatgcgacaaaactgaagtaaaacagcgtggatctgccataaaaagacatagacaaattgaatagactagggaatccagaaataagtccacgtaggtatggtcaattgattttcgacaaagatgccaagaacacacagtggggaaaggacaatcagtgtcttcagtaaatgatgttgggtaaagtggatatccacatgcagaagaatgaaattagatccatgtctctcaccatcttaaaaaatcaactctggctgggcacggtggctcacgcctgtaatcccagcactttgggagcctgaggcgggcagatcacgaggtcaagagatcaaaaccatcctggccaacatggtgaaaccccgtctctactaaaaatacaaaaattagctgggcgtggtggtgtgcacctgtagtcccagctacttgggaggctgagataggagaatcgcttgaacccaggaggcggaggttgcagtgagctgagatcatgccattgtactccagcctgggcgacagagccagactccatctcaaaaaaaaaatcaactcaaaatggatttaaagacttaaatgtaagacctgaaactgtaaaactactagaagcaaacacaagagaaagcttcatgacttggtctgggcaatgattttttgattatgaccccaaaagcacaggcaacaaaaagcaaaaatagtcaaaggggattacatcaaactcaaaagcttccgcacagcaagggaaacaacagaatgaagagacaacgtatagaatgggagaaaatatttgtaaactatatgtatgattagaggttaataggaaaagttatgaggaactcaacagcaaggaaacaatcccattttaaaatgggcaaaagatctgaatagacatttctcaaaagaagacctataaatggccaacaagtatatgaaaaaatgttcagtatcactaatcctctggaaaatgcaaattaaaaccacaatgagatattacctcacaccgtgttagaatggtttttatcagaaagatgaaagatttgtgggataccatactggtgaagaaaaaaatgtaaaattaaaagaaaaaaaataacaagtgttggcaaggatgtggagaaaagggaaccctcatgcactgttggtggaaatgtaaatttgtatactactttttttttttttttttttgagacacagtctcgctctgttgccaggctggagtgcagtgacgcaatctcggctcactgcaacctccgcctcccaggttcaagcgattctcctgcctcagcttcccgagtagctgggacgacgggcgcgtgccaccacgcccagctaatttttgtatttttagtagagatggggtttcactgtgttggccaagatggtcttgatctcttgacctcgtgatcgcctgcctcggccccccaccaagttttgggattacaggcgtgagccaccgcgcctggcctgtacactactgttctatggaaaacagtatggagattcctcaaaaaattgaaaataggattatcatacaattcagcaattccactactgggtatatatccaaaggaaatgaaatcagtatgttgaggtatctgtacgctcatgttcattgcagcattattcacaagagccaagatacagaatcagtgttaagtgtccatcagtagatgaatggataaagaaaatttggtatatatacacaacgaaatactattcagccttgaaaaagaagggaatcttgtcatttgggacaacatggatgaacttagaggatattacattaagtgaagtcagccaggcacagaaagacaaatgctgcatgctcttattttgttgttacagacagggttttttgctgctgtgttgcccaggctggagtacggtggctattcccaggtgcaatcatagcacactatagcctcgaagtccctcctggtatcaagcgatcctcctgcctcagccttctgagttggtgggactacaggcaggtgccaccatggctggccacatgcttttacttatatatggaatctaaaatgtcaaactcaatcttacaattctcatatacctatattaacaccaccaaggctgtggctaccattagcaacaggagcattaaatatctgttgggtaaactgtagaccaaggcttttagtattacagaatataattctaataaaaattccaggctggggcagggcatggtggttcatgcctgtaatcccagcactttgggaggtcgaggcgggtggatcacctgaggtcaggagtttgagaccagcctggccaacatggtgatacccctatctctactaaaagtacaaaaaaattagccgggcgtggtggcccatacctgtaatcccacatactcaggaggctgaggcaggagaatcacttgaaccccaggggtggaggttgcagtgagccgagatcacgccactgcgctccagcctgggcaacagaaagagactgcatctcaaaaaatagaaaaaattccaggctgggcgcaggtggttcaagcctgtaacacagcattttgctaggtggaggcaggcggattgcttgagcctaggagtttgagaccagcctgggcaacatggtgaaatcccatctctacaaaaaatacgaaaactagctgggtgtgttggtgtgcacctgtagtcccagctacttgggaggctgaggtgggaagatctcacctgagcccagggaggttgaggctgtagtgagccgtgattgtgccactgcattccagcctgggcgacaagagtgagaccctgtctaaaaacagtaaataaaaataggacaggctcagtggttcatgcctgtaatcccagcactttgggaggccgaggcaggcggatcatgaggtcaggagatggagaccatcctggctaacatggtgaaaccccgtctctactaaaaatacaaaaaattagccgggcgtggtggtgggcacctgtagtcccagctactcgggaggctgaggcaggataatggtgtgaacccggaaggcagaggttgcagtgagctgagatcaagccattgcactccagcctgggctacagagggagattctgtctcaaaaaataaataaataaaataataataataataataaagtaaaactcatagaagcagagaataaaatggtggttaccaggagctgggtgggagtggagattgggaaggtgttggtcaaaggatataaaatttctgttagacagaaggaataagcacaagaaatctgttgtacaacatagtgaccttagtaaaaatatattctttttttttttttttttttttttgagacagagtttcactctttttggccagggtggagtgcaatggcatgatcttggctcactgcaacctctgcctcccaggttcaagcgattctcctgcctcagcctcccaagtagctggaattacaggcatgcaccaccatgcccagctaattttttgtatttttagtagagacggagtttctccatgttggtcaggctgatctcaaactcccaacctcaggtgatctgcctgcctaagcctcccaaagtgctgggattagaggtgtgagccaccacgcccggccactaaaaatatattctgtacctgcaaattgctgagagtagattttaagtgttctcaccacaaagaaacgtaattattttaggtaatggatatgttcattagtttgatttagccattccacagtcttcacatacagtagcgctcccccttatccacagttttgctttctgtggttttagttacccaagatcagccatggtctgaagatatgaaaaagaaattccagcaacaaacaattcattagttttaaacagcatgccattctgagtagtgtgatgaaatctctcttgccgtcctgcgtatgtcatgaatcatctctttgctcggtgtctccacactgagtctgctacatgccctttagtagcagacttggttgtcaaattaactcaggctattgcagggctcgtgttcaagtaacccttattttacttaataatggccccaaagtgcaagagtagtgatgctggcaatttggatataccaaggataaattcctttttcttttttttttttttgagacagactcttgctctgttgcccagactggagttcagtggccccatcattgctcactgcaacctccacctcctgagctcaaacaatccttgcacctcagcctccagagtagctgggattacagatgtgcatcaccatgcctggctaatttttgtattttttgtagagatgaggttttgccatgttacctcgaactcctgggctcaagtgatccacccacctcagcctcccaaagtgctgggattacaggtgtgagccaccactcccagccaagaagctattaagtgtatcctttaagcaaaaagatgaaagttctagacttactaaggaaaaaaaaatcttatgccaagattgctaaaatctatagtaaaaatgattttttttttgttttttatgaaccctgcatattgtatttgaaagaatgaattttctatctgtgaaattgtgaagacgaaaaaagaaaattgtgctagttttgctgttgtactccacattgcagaagttacaatcacagtgcacagtaagttcctagtgaagatggaaaagacactaaatttgtgggtgggagacatgaacaaaaacgtactttgattgagtgcaattggattcagtactgtccattgtttcagttatccactgggggctttggaatgtatccctcaaggataagagaggactactgtatttctgaatgtcattttacacaccgtaactatatataatttttgtcagttaaacaaaatatggcacaatctcttttaagctattggtgataccaataagattgggaattttactaacaatcttttacatactttaccttcttaaataaaattaggtaagagataggacttctgggacaacatctttatatacttgggagaagggttcatccttccactatggcaacactaatttattggtaaatgcaaaccactatagtaggctcattctattaaatgaatgcactgcataataacacttctgtcaatgctggactgcacaaatgatggtggtcttgtaaggttaaaatggagctgaaaaattcctattgcctggtgatgtagccatcatgatgttatagcacaatgcattactcacgtttgtggtaatgctggtagtaaacaaacctgtgctggcagtcatataaaactatagcacatacaattatgtatagtatataatacttgataataaatgactatattactggtttatatatttactatactttttaattgttagtgtgtattccttctacacacacacacacacacatatttttattttatttttatttttgagatggggtctcactttgttgcccaggctggagtgcaatggcacaattagggctcactgcagccttgacctctcaggctcaggtgatcttcccacctcagcctcccaagtagctgggactacaggcacatgccaccatactggctaactttttttttttcttcttccctgtagagacaaggttttgccatgttgcccagactggtcttgaactcctgggctcaagcagtttgctcaccttggactcccaaagtgctgtgattacaggtgtgagccacctcacccagccttattttttaaaaaagttaactgtaaaacagcctctggcaggtccttcaggaagtattctagaagaaggcactgttatcataggagatgacagctccatgcctgttagtacccctgaagacctttcaagaagtcaagatgtagaagtggaagacagtgatattcttgatcctgtccctgtggaggcctaggctaatgtgttgttagtgtcttagtttttaacaaaaagttttagaaagtaaaaaaaaaaaaaaaagaaagagggacggagggaaggaaaggagggagggaggaaggaagagggaggagagagacagagcagagagagaaaggaaggaaaggaaaggaagaaagaaaaaaagaaaaaaaagaaaagaaatcctcctgacttatcatcctgaatagctgggacaacagatgtgtcctaccacaccaagctaatttttaaaaaattgtttttatggagatgggatcttgctatgttgcctgggctggtctcaagctcctggcctcaagtgatcttcttgctttgacctacagaagcactaggattacaggtgtgagccacctctcctggccatcttttcttttttttttttttggagatggagttttgctcttgttgcccaggctggagtgcagtggcacgatctcggctcaccacaacctctggctcccaggttcaagtgattctcctggctcagcctcccgagtagctgggattacaggcatgtgccaccacgcctggctaattttgtatttttagtggagatggggtttctccatgttggtcaggctggtctcaaactgccgacctcaggtgttccacctgcctcagcctcccaaattgctgggattactggggtgagccaccatgcctggacctggccatcctttttttctttttttttttttttctgagatgaagtcttgttcttgttgaccaggctggagtacagtggcacggtctcagctcactgcaatctctgccttccgggttcaagcgattctcctgcctcagtctcctgagtagctgggattacaggcgcccaccaccaccctggctaatttttgtacttttagtagagatggggtttcgccatgttggccaggctggtctcaaactccagacctcaggtgatctgcctgccttggcctcctaaagtgctgggatacagccatgagccaccaggcccggctggccatcttttaaaagtatgttttgtctttgaggtttcctcaaaatgtgatacataacgatgccagaaatatatacggcttcatttttgtgggtgttgattttgtcatgatcagtgatgatgatgaattgcccttcctgtgctctgtaagcatgttttctgaaattaatgtcctttataactcactagtgttattttctgggataatttggattagcacgcaatgcttttgcttatcaataagccacacctctgttttaaagagctgattcatgcttcttagtggtaacagaagtactatgtttaacaaagaggaggaggtcagtttttcttcaaagaagaaagtttcatttttatgtctttactcctcagtaatatgttacatattgaatatttgtgcttaaaaacaaacttttcttaagcataactttttttttttttttttttgagtcagagtctcactctgtcgcccaggctggagtgcaatggcaccatcttggctcactgcaagctccaccttccaggttcatgctattctgcctcaacctcccgagtagctgggactacaggcacctgccagctactgttacaattacacgcctggctaattttttttttttttttttttttttagtagagacggggtttcaccgtgttagccaggatggtctcgatctcctgacctcgtgatccgcccgcctcgtcggcctcccaaagtgctgggattacaggcgtgagccaccacgcccggccaacttttttttttttgaacaggcttttccatttgtaaaactcagtccttactaagaacatgattgtaagtctctatataatgtttcattttctttgtgataggcaaaaacaaattaagttctttattaactgcttttatttgtagctactaaatttctctgctaagtgtaacaaaaatagtttagaaatagcaaagaaagttattttagggaaatgtagaggttttctacacttccagatttccagggaaaagggtaaattggtgacagataataaagatgcatgtagccaggcacggtggctcatgcctgtaatccgagcactttgggaggtcgaggcaggcggatcatttgaggtcaggagttcaagaccagcctggccaacatggtgaaatctcgtctctacaaaaatacaaaaattagctgggcgtggtggtatgcacctttaatcccagctactcgggaggctgagtcggaagaatcacttgaacctgggaggcggaggttgcagtgagctgagatcgcaccattgcactccagcctgagtgacaaagcgaaactctgtctcaaaaaaaaaagaagataataaagatgcgtgtagattacagtatttactccttatattaatgtagtagcatctgaaggtcactctagaagaatagataccttattactttcttaattttctctagtgatgtgctttttttttttttgagacggtgttttgttcttgtctcccaggctggagtgcaatggcgcaatctcggctcactgcaacctctgcctcctgggttcaagcgattctcctgcctcagcctcctgagtagctgagattacaggcttacaccaccacgcccggctaatttctttctttctttctttctttttttttttttttttttgtatttttagtagagacggggtttcaccgtgttggccaggctggtctcaaattcctgacatcgggtgatctacccgcctcggcctcctaaagtgctgggattgcaggtgtgagccaccgtgcctggccgtgatatgcttttaaatcaagtccaagaaaatgtggaaataacactttagttgttcagtctgccaatgtaaatttaggtttcattatcttgatggtgtttttagacattgtgtattttgatcaggctttgaatcatgatagaattaaaaactgctttttttgttttagaactgaaatggaggagtgaggtgagctttaagactgccaactatatgccaggcacagcccatttcttcctgttttattttataataaatgctatttcatgagattctcattaaagatgagtattattaatcccacttgaatccccaaagacaagaaggttaaattattctgcaatattatcttttgtaaccaaaatcattaaccagtttgtatatgattgatatttgaaactaacttgtgctaatttgtccaatgaaagataatgcaagttctcttaaccagtaaacttttgttcttttgatttttgcctggcttgttaagctttctcaggagggagaaggttattttgaataacacgggtctagcgttacagcaattacccagaaaggaatagaaaaggcagaaaataatttcattcttgacggtttccatctgagtagattaatttatatttgtatgtacaatctgaggctatcttggacattcaaaatgaaacaaggaatgaagctattattagggtaattgagaaaaaaataatttttgcttttttttttttttttgagtctttctctgtcgccaggctggcgtgcagtggcgcagtctcggctcactgcaacctccacctcctgggttcaagcgattcctctgcctcagcctcccgagtagctgggactacaggtgcgtgccaccatgccctgctaattttttgttgttgttgttgtttttgtatttttagtagaaacgggttttcaccatttgggccaggatggtcttgatctcctgacctcatgatccgcccgcctcggcctcccaaagtgctgggattacaggcatgagccaccgccgctggcctaatttttgcttttaatatcaagtttctagcctgcagtacatgcttctgtgtttctttcactgaactgacctagccacagttaccaagttgaggaattgatacattcgaagagttctgttaaaggtgggaagaggataatatattttagaattctcatatacctatgttaacaccaccaaggctgtggctgccattagcaacagcagcattaaatatctgttgggtggctggccggggtggctcacgcctgtaatcctggaactttgggaggccaaggtgggcagatcatgaggtcaggagtttgagaccagcctggccagcatggtgaaaccccgtctctactaaaaatacaaaaaattagccaggcatagtggcatgtgtctgtagtcccagctactcaggaggctgaggcaggagaatcacttgaaccccacaggcggagggttgcagtgagccgagatcatgccaccgcactccagcctgggcaacagagtagacagaccctgtctcaaaaaataaaataggccgagcacggtggctcatgcctgtaatcccagcactttgggaggctaaggcaggcggatcgcttgaggtcaagagttcgagaccagcctggtgaacatggtgaaaccctgtctctaccaaaaacacaaaaattagccgggcgtgggggcacatgcctataatcccagctacttgggaggctgaggcaggagaattgcttgaacctgggagctggaggttgcagtgagccaagatcgcgctactgcactccagcctgggtgacagagcaagactctgtctcaaaaaagaaaaaaaaatttaattaattaaatactgatattcaaaaagaagcacttttgaggcaatagttttatcagatctcaaatatgtatgttttgtatccatcctactggttctgtttctgagaagaaccctaatacagaaggtattccggaagacacgttagccaagcttgagatttaaaggaattagctgtgtaaagaggtaggaaaggctgggtgcggtggctcacatctgtaatctctgcactttgggaggccgaggcgggtggatcaccagaggtcaggagttcaagaccagcctggccaacatggtggaaccccatctctactaaaaatacaaaaattagctgggtgtggtggcacatgccggtaatctcagctactggggaggctgaggcaggagaatcgcttgaatccaggaggcgggggttatagtaagccaaggtcatgccactgcactccagcctgggcgacagagcaagactctgtctcaaaaaatatatatatgatgaataattttgtgttgatgaaatttctgctgtgtataaatattttttgagtttagtatgtctctactgttaagtgatatggcatgatttatttcttttaccacttttcggtattcacattgccaggaaacttgttcctttgaagttatttggttttctcatggctcacatacgtcatggatacttacctaattccatttctattaatttcttgttggtctcggactatgtagtactgtttggtgctagtgttcatttatttattcagtaagtattttcttagtacctagtgtatgcaccttctaaatgcagggatatagtagtgaacagaacagataaagtatctaatgatactttctagattgggagagacacaataagaacttaggtaagcatatctatagataaattacagatagtataccatcagatagtgatacattaaaataaaaataaaacagggtaaatggatagaatgttttgaaaagggggtgccaaggaaaggcctctctgagggagtcacacttgagtgacctgaaataatggagcaaatcacgcagtttctgggaaaagagcattccaggctgactgaataacaactgcaaaccctagggtaagaatgtgcttgttatgttacagaaacaatagtaagctcagtatgggtaaaacagagtgagcaagagaagtaggaaatgtggtcagtggagcagacagggaccaggacatgtaggatcttataggccgtggtaagaaatttgcagttgtcaagcacaatggctcatgcctgtaatcccagcactttgggaggccaaggtgggcagatcacttgaggtcaggagttcaagaccagcctggccaacatggtgaaaccccatctcttctaaaaatacaaaaattagccgggcgtcttggcgcacgcctgtaatcccagctacttgggaggttgaggcaggagaatcgcttgaacctgggagtcggaggttgcagtgagccaagatcgtgccactgcactccagcctgggtgacagagcaagactccatctcaattaaaaaaaaaaaaaaaaagagaaatctggagttaatttcagatgtaataatgtagccggcttaagtctggctgcttgccactcagaggccaaaaaaaagagaagccaggtgcggtttaaggaaagcagttttattaatcaaatgctaggagctggggaatggccaggctcatgccttcaaaagaccattccagttttttgggctgagtgaaggattttttttgagatggagtctcactctgtcacccaggctggagtgcagtggcgcaatctcagcttagtgcaacctctgcctcccagattgaagcgattctcctgcctcaacctccagagtagccaggactacaggcgcgcgccaccacgccctgctaatttttgtagttttagtagagacggggtttccctatgttggccaggctggtctcgaactcctgacctcaggtgatctgcctgcctcggcctcccacagtgctgggattacaggcatgagccaccacgcccggcctgagtgaagggttttaagaaggcaaagatatgggaaatatgtgatagtggtgcaggaggggataggccttcaaatcttgttcccatggctgtcttgagtaatcacctgtctggagttctggttttttcatcctgatttctgcctaatagtggtgagccaactgttcagaactccccttaggtgggaggattctgcaactggctctctctgcctgatttgtttcaaaattggcccctggaatttgtaagcaagcacataattagataagtgagcattgttcatggaagtacctggtaggaaagggaaacaaagagtttcaaagtatgtttcaaggctgaaagcaagaaaggaaaaaaaagttttaaaacgcattttgaggctgagatacttggctacaacagggatatatgacctgctttacttttttttttttttttttttgggggggatggagtctcgctctgtcacccaggctggagtgcagtggcacgatcttggctcactgcaacctccacctcccgagttcaagccattttcctgcctcagcctcccacgtagctgggattacaggcgcccgccaccatgcccggctaatttttatatttttagtagagacgaggtttcaccatgttggccaggctggttttgaactcctgacctcaggcgatctgcccgccttggcctcccaaaatgctaggagtacaggcatgagccaccatgcccttttttttgttgttgttaatagaggcagggtctggctctgttgcccatgctggagtgccgtggtgcagtcatagctcactgtaacctcaaatttctgggctcaagctgtcttcctgcctcagagtagctaggactacaggcacgcaccaccacgctcatctaatttttaaatttttttagagacagggattttactatgttgcccaagctggccttgaattcctggcctcaagtgatcctaccacttcagtatctgaaagtactgcgattatagccatcagccactgcatccagctctgctttactttttgaaaggatcacccaggccagtctgaggataacagaatataagagtctgagaagaagggaggttaattaggggttgattgtactagtctagcaagagatggtgatagcttagactagagtgagaagtggttaaattatggatatcttttggaggtggaggcaataagacttggtaatgatttaattgtagctgtgagagaaagagaagagtcaaggatgacaccttgttgaacaactagaaaacttaagctgccattttactgaaatgatacaaaatagcagctaacacagatgccagctctttttctaagtgctttacatctgttgccctactcatgaatagggaatacctgggggggaaaaaattgggagtgggaaatcaagagtttgttctttaaaacatagtaagtttatgaaacttcctagatttccaaatagagtattgagtatgctgtagatatatcagtctgttgaagttcaggggagatgttcagcctggaaataagaatttgtttgtatcatcagtgtatatagggggtattaaaaatggtagaactaggctaggcatgttggcctatgtctgtaatcccaacactttgggaggccaagatgggaggatcacttgaggtaaggagtttgagaccagcctagataacatagtgagaccccgtctctacaaaaatttttaaaaatttaggccgggcacctaatttggtgcttactaggtgctgtggctcaccatataggtttgagcatcatctgtttatgggtggttacagaggccataggaatatttctgtcttgcacaggtgtccagttagtggaaacacaaagtaggcttctcctctgcaaaaactacacaggatttttctagcaagacatgcttctgtttgtgattctgtaagaacaggggtattttgttaatggaaactttccatcacaaaccaggatcatcccctaggattgatattataacaacatcaatcaaaagaagtaaatgatttctgtggctttggaagagttcagtataatctaatagagaaattaaaggtctataagagtcccttggaacatgtgaaaggaccatgtggtattgaaaattgcgatctgtgatttcgatagcttaatattagaattggaaggtatcagatggctggcaaactgtcagtaaagtcctattcttaaaggagtactgtcctaggttgggttatctttgaggcagactctgatagtatagcctgaagaatgcttattaggaagtgcccttgggatcaacacccgtagaagggaggggacaggagcagcagtatttggccatagggagaagtcaagtggcaatagagatccaacaggagccttagtggaccccacgggggctctggagctaaaatgaccttttagagttgtcttatatgtgctgtaacggctgggcttacaccctggtcttgattggatgtggacccctgagaaggttgtgaccttccttgagtcaactcttcatatctgaggcactccctgaaaggattgacagttgtaggctgtctcccaacagcagtcctgtcattccttaatggaggatccagccagtgcaacagcatgctaccacagtatacccttgtgttgctcagatctactacttaaaaaacaaaaaaacagtatttttgagatataattcattattgtaaaatttataattacagtttatagtatacaactcaatggcttttaatatatttgcaagttgtgtaaccatcactctaaccaattttagaacattttaattaccccccaaaaaactctgttccccttagctgtcactctgtaatctcctccccacccacccccaacataggccaccgcaaactttctgtctctatagacttacctattatggacatttcatgtaagtggaataatacgctgcatggtcctttgtgattagcctttcatttagtgtgttttaaacgtttatccatgttacaacacgtatcaatacttaatttctttttatgctgaatgtcccgttgtattaattttgtttatccagtgatcagtggaaagacactgggtggttttcactttttagctattatgaataatgctgctatgaacatttgtatacaagtttttcgtttgtttgttttgggggacgtttgtttttgtagttagctgggactataggcacgtgccaccatgctcaagtaatttttgtattttttgtagagacggggtttcaccatgttggctaggcttgtctcaaacttctgacctcaagtgatctgcctgccttgtcctcccaaagtgctgggattacaggcatgagccactgcacctggcctgtgtacaagattttgtatgaacatccttttttttttttttttttttttttgagacggagttttgctctgtaacccagactggagtgcagtggcgcgatctcagctcactgcaacctccgcctcctgggttcaagcgattctcctgcctcagcctcctgagtacctgggactacaggcacctgccaccacgcccagctaatttttgtatttttagtagagacagggtttcaccatattgaccaggctggtctcgaactcctgacctcaggtgatctgcccgcctcagcctcccaaagtgctgggattacaggcgtgagccaccgcacctggccttgacatatgtttttatttctcttggatatatacctaggagtgggtcatatggtaaactctatgtttaactgtttggggaactgttactcttccaaatcggctacatcattttacattctcaccagcagtttattgaggccccagtttctctgcatctttcctaatacttgttatgtatttatttaacttttattttacgttcaggttacacgtacacttgcaggtttgttatataggtaaactgtgtgttacgggggtttggtgtacagataatttagtcaccccggtaataaccataacacctgataggtattttttctgatcctctcatccttcaccctcaagcaggccccagtgtctgttgttcccctcctagtatccatgtgttctcggtttagctcccaacacttgttattacctcttttatttattatagccatcataatgggtgtaaagtgttatctcattgtgacattgatttgcatttcctgtagggctaaaaatgagatgttgaagatcttttcatgtgcctattgactgtatatcttctcttaggaaatgtttatatacatcctttgcccatttttaaattgggttgtctttttgttattgagttattgttctttatgtattctagatataggttccttatcagatagatgatttgcaaaaattttctcccattctgtgggttgccttatcacttttttgatggtgtcctttgaagcacaaaactttaaatttttttctttttcttttttgagaccgaatcttactctgttgcccaggctagagttcagtggcatgttctcagctcactgcaacctccgactcccaggttcaagcaattctcatgcctcagcctcctgagtagctgggactacaggtacaggccaccatgcccagctaattttggtatttttggtagagacagggtttcaccatgttgtccaggctggtctcaaactcctgacctcaggtgatccacccatctcgacctcccaaagtgctgggattacaggtgtgaaccaccacgcctggccccaagtatgtgtatttcaatttcacattcagtgaccagggaatgaccaccagttaggagttcgagaccagcctggccaacatggtgaaactctgtctctactaaaaatacaaaaattagctgggcatggtggcaggtgcctgtaatcccagctactcaggaggctgaggcaggagaatcacttgaacccaggaggcagaggttgcagtgtgctgagattgcaccattgcactccagcctggacaacagagcgaaactccatcttaaaaaaaaaaggaataggaaaagaaaaaaataatctcactagcacagaacccagatttctatctatcttagtaaacaatcaaaagcatatttcactttatgcctcaattgactgctggccaaccataacttctatagcagctctcactttgatactctctagtaaatttaagttatatttaaggttaatttgagtttaatttaattgtttaataataaatttgactgataagattgtattaaaatttaggttatgtttacttaagtgaagcaaggaggtcactcagaatgaaaactttacatttccagtacaaacctatggagttgtcatgtattattctagtttatcatatggtcatgttctttagaatttgtcaccaggctactataataaaactcaatttaccaaattcttcaagatttaacttggtaatgaagctacaaaatttatgaataagtacagactgccctttttgaacagactgttcaaactaaggatggatctaattgatgaactaggtaaaaactactcttgagggggaaaaaaaaagccaaggtcctaaagaaatcatctaaggttgttaaaagcagaaaaattctgatcttacaaggtaataaacagcagtcttctcaaaagctcttaatctgagccagatgattgctagtacgagtagcccatgagccactgcgcccggccctacaactgcatcttactcccaagtttctccagtcattcctgtcagtaggttgtgacttataaaaagcaggctctgaattggagtttagtatttagactgttagggaatgaccttaggataaaaaccacaggaggagtaggaagctgggtagggcagatttgacacttgccttgattgggggtgcaggaggttgtatattatacttagtcaactttcttttgaaacgttttttgttttattttcatacttgagtggataaacttacagcttactgaaccatcctcctgtgtctaaaataacttccattttccttaggcaaaaccaattcccttcttcaaagatgttcctcatgccctttctcaggtgttgtatttttcttacaaaaaaacttgcctttttccctatactctagtaaattcaaaatgaggattggaaagggagcttatttgaggaaactgacaataatatattttaagacaaaaattagccttaaatgttttatgataatctagtattgtacatctgtatctcaattcccctaaaataactcccagcctggcacagtctcaggctgttgtaatcctcaagaggctgacatgggaggctcacttgagcccaagaattaaaatctagtctgggcaacataaggagatcctgtctcaaaaaaaaaaaaaaaactatcatttaataagttgtacatttctataatgttccacttttaaactatagtcaatgttactgaattaggattatttttttaaaagcataaaaggtgatggactatatgtattaagtgtatcatttacctttttctctttttagaaacagtatctcacctccctaaactggttaatagtggcatggaagatccatttggtgagtatcacctacattgttcttagtaaatgacatttctgttttatcctcacctccattaaagctttgagagtaaattggttttttttcatattcagtatgctactctctagaataatgggtctcaaactttttgcttctataagaattcagttatatatttaatgatagagtgccaattaccttttgtttatgtgacatatctattgatgtttgctgtattacaaattaaacctgagaaactttaaaaatattaatttgtttaaaaacaacattgataaacccattatatattacacaaataacatttttaattaaaaaaatcaagaaccatttgacaagataaaatgagaaatttaaatttctctatcttagccaggagtggtggctcacgcctataatcctagcactttgggaagctgaggcaggcagatcacttgaggctaggagttcgagaccagcctggccaacatgacaaaaccccgtctctactaaaaatacaaaaatttagctgggcatggtggcacacacctgtaatcccagctactctggaggctgaagcatgagaaacgcttgaacccaggaagcagaggttgcagtgagctgagatcgcgccactgcgctccatcctgggcaacagagcaagactctgtctcaaaaaaagaaaaataagtaaataaactctgtcttaatcactcagtaacttatgtatacttctctttggttggaaatgtagttctgctcatatttcagaaacaatgtgtgctttgtagtgcttcattagtacttggccaatggaagataacatgaaagtgactgggcgcagtggctcatgcctgtaatcccagcactttgggaggctgagatgggcagatcacttgaggtcaggagtttgagaccagcctggctgacatggtgaaaccccatctactaaaaatacaaaaattagctgggcatggtagtgggtgcctgtaatctcagctactcaggaggttgaggcaggagaaacacttgaggcctggaaggcggaggttgcagtaagccgggatcatgccactgcactccagcctcggcaacacagggagactctgtcttaaaagaaaagaaaagagaaagataacgtggaagtaatcataatagcaggcatgtgtaatatatatgtacgtgtgtgtgtctatatatgtgtgtgtgtgtatatatatatatatttttttttaatttattttttttgagatagtgtctcactctgtcgcccaggctggagtgcagtggcaccatcacagctcactgcagccttgacctcccgggctcaggcaatcctttcaactcagcctcctgagtagctgggactataggtgtgcacccctatgcccgactgatttttttttttttttttggtagagatagggctttgccttgttgagcaggcggctctggaattcataggctcaagggatccacctgccttggcctcccagagtgttagaattacaggcgtgagccactgcacccagcctaatatttctaattaagtttagcctgtgtatatttcatctagcaacatgagtaaaggaatgtaagtctagatatacaaaggtttaatgtctgcctttttggcgataaagtcatttactgtgtgtggaaccccttttctttctttcttttttttttttttttccaagactggatatcactgtgttgcccaggctggagttcagtggctattcacagaagcaatcatagcatgctacatccttgaactcctgggctcaagcagtcttcctgctttagcctcccactgtgtttggatggtaaggggtgaagaagactgagtaaagaggctgttgcattcagcattaattatgcatatttcccacgtagctaggactacaggcatactccaccactcctggccctatttttaactgatgctcatttcaaagtgagagatatgtcttaggatatcagattttttgaaaccataacattgactaggaagactagttaggaagtacttttcattttaaaatacacattagcaaaaaagaaaaaaaagaaatcagaggcagttttacttgtttaatttcagcgtactggaggaagcatccgattcaagcattttctgatccttcatcacacggaaagaagtctgaatccctttttatgccagtgcagcttgaggaagtatagtaaaaatactactatataatactaactgaggttaggctttttgggctactagtactagcaatcatctggctcagattaagagcttttgtcttgctttgagaagactgccctttattactttgtaatatcagaatttttctgcttttaacgaccttagataatttctttaggaccttggctttctttcccccctgaagagtagtttttaggattatgcctagttcatcaattagatccatcatcaattagatccatccttagtttgaacacaagagggcagtctgtacttcttcataaattttttttttttttttttttttttttttttttttgagacagagtctcgctgtgtccccaggctggagtgcagtggggtgatctgggctcgctgcaatctccgcctcccgagttcaagccattctcctgcctcagcttcccgagtagctgggactacaggcacgtgccaccacacccagctcattttttgtatttttagtagagacagggtttcaccatcttggccaggatgatctcgagctcctgacctcatgatctgcccaccttggcctcccaaagtgctgggattacaggcgtgagccaccgtgcccagccacttattcctaaagtttgtagcttcattaccaggttaaatcttgaagaatttggtaaactgagttttattatagtagtctggtgacaaattctaaagaacatgaccatatgataaactagaataatacatgacaactccgtaggtttgtactggaaacctaagttttcattctgagtgacctccttgcttcacttaagtaaacataacctaaattttaatataatcttatcaatcaaatttattattaaacaattaaattaaactgaaattaaccttaaatataacttaaattttctagggagtatcaacgtgagagttgctatagaagttatagttgaccagtagtcaattgaggcataaagtgaaatgtgcttttgattgtttactaagataggtagaaatttgggttctgtgctagtgagattatttttttctttttcttttcttttttttatttgagacggagttttgctcttgtcgccaaggctggagtgcaatggcacagtctcacttcactgcaacctccacctcccgggttcaagtgattctcctgcctcagcctcctgagtagctgggattaccagcacctgccaccatgcccagctaatttttgtatttttagtagagatgaggtttcaccatgttggccaggctggtcttgaactcctgacctcaggtgatccacccgccgtggcctcccaaagtggcgggaattgcaggcgtgagccaccatgcccggctgagattattttttatttttatttttttggtttgtttttgttttttgggggtttttttgaggtggagtcttgctctgtcacccaggctggagtacaatggtgtgatctcggctcactgcaacctccgcctcctgggttcaagcaattctcctgcctcagcctcccaagtagctgggactacaggcacctgccaccacacccaactaatttttgtatttttaatagagacgggatttcgccatattggccaggctggtcttgaactcctgacctcagatgatccacctgcctcggcctccgaaagtgtttggattacaggtgtgagcccggcctgagattatttttttctaaacacttatttaaatcttggaatttgtaaattaacattcattcaatcataatatggagtttataggaaaacagaaatgactcatatttaactaccattctcctctgtctccatttttccttctaaatgttataatgatttttttcttagttgtttactatacatatacacacatatacatatgataagaatttggtgtactcagtgtcatttgacaaagaaaagaattgaggatgtaaaatgagtttgtttcttttggtggagtgagaattttgttataatcaagttagctaataattaagtagaaatattgaaaaagagataaaagactacacattgggtacagtgtacacggcttggatgatggttgcaccagaatcttagaaatcaccactaaagaacgtattcatgtaaccaaatactacccattccccaaaacctattgaagtaaaaaatgacataaaaaaggaaaaaaagaaaacagaaaccacccaaaagaaagaaagaaagaacgaatgaacaaaagaaagaaagaacgaatgaacaaaagaaagaaagaaagagaaagaaagaaagaattatttgtggtattctggaaataaaagtagtgagggatttttacgaataaagtaccagaaggatagacctaaggtctctaggaccttttctacctggacagatgcttacacatttcattatataatatttaaatatcatgttcgttaatatcactattggtctcgttgaaaaaaatgttaaatgttgggaagctgtcaagctcattctggatgtaaattttccaaaataggaatttcacttgaaagcttgaattctatcactagcaacaaatactgttaattttctttattagtgacaggcttacttttgagaaaatgcctgtcagctatctaagcttgaataacatagcttgttgttcagtctttcaagtaaaaatagtattccatgaagaaaactgtctagttcagtttgcaactcagtcacacaaatgcctttcctggagataaccatcatacttagtatacaaatgtgctttatacatatttctgtttcatcataaacagtaataaaaatatatgtactaaagggttgatatttattaaaactaatattttttattgctttatcaaggacattcttaaagttgaatttatttttcactgtaactgtgtagttgtgaagaatacaatgatttctgctacagtttggtgctgttgccttgatttgtgttaaggtgctaacagttttgctcaccattgcttttgtaccatcagtgcaagtgtcaacacagtggaaaaggcaaataatttttttgtattcttatgtatttagttttacctcttggacttctgaaaggatctcagggatccccagagatcagcagattatacttgcttcattttcctgaggttcctagaggcccttctatggaagtcatgagtaaagttaagatttaatcctggagattgtattgggcagggtttcagtgtggactaggtcttggacatttgacagaaatatggtcagagggagtgattagctctgtggtttctcctaagcaggagtaccctgcaccactacccccgggccacaggaggtgagcagtgggccagtgagcattacagtctgagctccacctcctgtcagatcagtgattaggtggaacagtttcatcccaaaccaccccaacacccccgtctgtagaaaaattgtcttccatgaacctggtccctggtgccaaaaaggttggggaccgctgggttaaagaaacttttgtggagcgaaatgagtctggaactcattaggcaatcaagtatgttcaaagaagaaatccataagcatttagtcaagacaggctgagggccaggctcacctgggtactgtgttcttagctttaaaaaggataaatagcagcagagatattggtgatgacagctttcaatatatctcttgagtcacattgctccagtctgtgtacaggtggccttgcagtctgtagaggtggtacgcaactgtcatcctgggttatccagtctccattttcctgacagctttgcttctttcctgtgttagctcctttgtttcctaaaccctcatgtcttcctctgtcttggttgccagtagctttttgatgttgaacctcctggaataattatctaattcatttctttttcctttagatatgtttcctgcaagatttattcaactttatcttctacttttattaaatttttcttttctactattagagtttaatctccaggaggtctttttgaagtctctgcatgtttctttttatactatcctttcattctttcaacagattttccttgccctgcatagtctctttttttcctaacattgtttttaaatattgatttggtttcttttatgttagagtttttctctgatgtctagtaataattaactgtctgctgatggttaaaagtgagggactaaatagccagttagaagctttaaatgtataggcaggttgcctttgggtgagcttcttggccttattgttgatgaacattctcatatcagtatcagggtctaaggggcacagtcttcccactgtgtttggatggtaaggggtgaagaaaactgactgaagagactgctgcattcagcattaattatgcatattttcacttaattctcttccatttttaattttacttgtatttgtattttattttactttatttttatcttttgagatggagtcttgctctgtcacccaggctagagtgcagtggcgccatctcagcttactgcaacctctgcctcctgggttcaaatgattctcctggcctcagcctcccgagtaactgggattacaagcacccatcactgcctggctaatttttgtagttttagggtttcaccatgttggctaggctggtctcgaactcctgacctcaggtgatccgcctgcctcggcctaccaaagtgctgagattacaggcatgagcctctgcagctggccttattttctttttcattttatttttttatttttattttttggggtcagtcttcctctgtctcaaaaaaaaaaaaaaaaaaaaaagcaccgcagcctcgacctcctgagctcaaacaattctcccacctctgcctcccaagtagctgggactataggcacataccaccatgcctgactaatttttttactttttgtaaagatgcagtctccctatgttgcccaggctggtcttgaactcctgggctcaagtgattctcccacctcggcctccccaaaagttgagattacaggcatgagccattgcacccaaccccttccattttttgtaccatatccctaccatcagttgccttttgcgacccctttccagagaccatttgctttacactttcttggaaaacagattccaaaattccgccagagttagtgtaggacagacattgaagatcatggagtagggaaagtgatagaggaatcaaacagcttttaccttgcttctcctgattttaggtcacctccctttcatctcatttcagagacctggataaaatacaatgaatgtattacttgttaacctatactggtgtatactaccagttaaaagaaaaaattaggctgggcgcggtggctcacccccgtaatcctagcactttgggaggccgaggtggacggtttgcctgagctcaggaattcgagaccagcctgggcaacaaggtgaaaccccgcctctactaaaatacaaaaaattacccaggcatgatggcgtgctactgtagtcccagctacttgggaggctgaggcaggagaattgcttgaacccgggaggcggaggttgcagtgagccaagatcacgccactccacgccagcctgggcaacagagcgagactctgtctcaaaaaaaaaaaaaagagagagaaaagaaagaaaaaaattcatggctacactgtacataagtgctgagtgaaggaaggatccagagaggatgtgcatagaatttgtgctaccatgatgctccacaccccactactttcaaaaatagctaattcgtgcttctgctttcttcctcccttttcaactgcttatggagttaacagtcattctcccaagagcataccagaacaaaagggactgaaaccctagcatatcacttatttaaaagtactgagttgtgacttccttctaaagatttttgaggtggaggaggatctgcatactaattgccttcccaaaatgttttaaatcatctgaatacttcattaagtttctatataccctctcttgtataaatatgaacatgacttgttgaaaatacttttttgggtgtgtttggtgattgtttaatgagatgtagattatcagtttgcattctgaatttaaagctagttgcaaaggctttattcatatgcatggcattctggaaacaaatttataagataatacctccttttgattagaatttgtatcatataggaaataggagaagtagtttgttaaggtagcaaatagaatttattatttcctaaacaaagtcaattatttttttcttattctgtatctgaatttatgaattattatgatgatgctataaaggagtttttttctagctgtttaagaacatttgccaaggagccaaactcaagacataatgcacttcaaagttcatgggaaaacatttttgatgttatgttgttatcacttgaagctcaaaatatgccagtaacatagtccttccctccctcctctttaagaatgaaagacaaaatacaagcttaattagttttgaggtcctcagggtgtaggagttaaattcctccagtattacatgatgccaaaattgatgctagttccattttttctcctagtggtcttgatgagaaatttaatatagcattattataaatatatattaaatatcctctgtcatcttatttcctgaaggggtataaaggtcaacatgtttttactgttacatcctacccactgcccagtagtaaacacacaatacatatctgtatgtgtttcttccagtggttttaatttttctgcataagatagaattaccaatcttaaggaaaacagagtacacaggcaccaaattctgtgaacctgaataacagatattatgtaattattttttctgtcagtagaaaaagatgagctgtagtagtagtagtagaagcctggaaaggcagtaatgctgacattctggactattgcctgtgtcctctcaccactttttatcacttctgactacgtcttactcctagaaaatcatagcaagtgggataggttgactaaatgcatggactggtttccatctgaatttattgctgcaaactgagcccttatcaatgtgtcatgcaccctggacagacgatgatatatgtcatacaaatgttttcttccagcctgtggcttgtctatttgctttcagaggcttttaaagtaatgcaatccaatttaatccattttctcttttatagttcataatttttgtgttttcttgaagaaatctttgcttaaccaaagattaggttttattttaagttgttgattctttttgagttaatttttagatatggtacaaagttggaaatattctcctttgtccactgaattaccttgacaccctgttgaattcctgatgaaactggtaattttctttcttgcttttttttttcttttttttgctgttccccccttccttccccctgaaatgggtaattttctaggaaaatataatttgccaaaggaactcaagaaataaaaatcctatgtagactagtgttaaaatgtgattaggccaggggttttgtggacaatttaattcatgttgatgaagcagatgattgcagtagtccctccttatttatgggggatataccaagaccaagaatgccagtggatccctgaaatcatggataatactgaaccccaatatgtactgtttttttcctgtatatacatacatacatatgtacctgtgataaagtttggattataaattaggcacagtaagaatttaataacaataactaataataaaatagaacaaataagtaaaacaaagattacttgaacacaagcactgcaataccgccacagttgatatggcaactgagatggctgctaagtgattaacaggcagtgaacacatacggtgtggatatgctggacaaggtgatggatgattcacccctgggcaggacagagcaggatggcatgagatttcatcatgatactcagagtggcacatgatttaaaacttacaagttatttatttctagaaattttccatattatatctttggactgcagtcaaccacaagtaactgaaactgcagaaagtgaaaccacagataagaggggacagctctataatgctatatcaatcagtatagcagagaaaaagaaagtatacctgtttattttataaagttggcaaaatcttgataactaaaagctgacagtctgggcatagtggctcatgcctctaatctcagtcctttgggaggcccatacgggaggattgcttgagcccaggagttcaagaacagcctaggcaacattgggagaccctacaaaaaaaaaaaaaaaaaagacacaagaatcttttaaaaagttagccaggtatggtggcacacatctatagtcccagctatttgggaggctcaggtgggaggattgcttgagtccaggaggtcaaggctgcagtgaaatgagattgtgccactgcactccagcctggaggacagagcacagccctatctctaaataaataaatgctgacaaagatagtagaaaaatacatttgtccggctgggtgtggtggctcatgcctatcccagcacattgggaagccaaggcaggcagatcacatgaggtcaggagtttgagaccacactgcccaacatggcgaaagcctgactctactaaaaatacaaaaaaaaaaaataataataataatagctgggcgtggtggcaggcaactgtaaccccagctacttgggaggctgaggcaggagaaacatctaaacctgggaggcagaggttgcagtgactcaagattgcgccactgcactctggactgggtgacagagcaagactccatctcaaaaacaaaaaacaaaacaaaacaaacaaacaaatacatttgttctattccacttaatacagctgtagaaagtctatataaattacatgtagattaaatccaacaaatcattattttttcttattacaaaaacaatatatatttctttgagaaaaatgagaaaatatggcataaaggagaaaattttaaggccaggtgcaatggctcacacctgtaatctcaggactttgggaggctgaggcagtggatcacctgaggtcaggagttcgagaccagcctggctaatatggtggaaacctgtctctactaaaaatacaaaatttagccgggcatgatggtgtgcgcctgtagtcccagctacttgggaggctgagacaggagaattgcttgaaccctggaggcagaggttgcaataagctgagattgtgccactgcacaccagcctgggtgacagagagagactccatctcaaaaaataaaaaaaggagaaaaatttaaatcatttgacctttctatccattggtaattactaataacattttgatatatctacttttatgatttttttctagggaagttttctatgtacagtagttacattttttaacatgccaatttatagctagctgttttctgcttgtttggtgcccgcccccatgcccagctaatttttttgtatttttagtagagacagggtttcaccatgtcggccaggctggtctcgaactcctgaaattaagtaatccacccgcctcggcctcccagagtgccaggattacaggcgtgagcgaccgtggctggcctgtttttgtccccatttgatatgtcaaatctataaatatattgaaagaatatgacccaagaggatttattgcaatatctaaggattatgtagatatattatcactttacacatatatatacacacacacatataaagtgtaaatatatatgtgtatatagtgtaaaaaacatatataaagtgatacatgtatgtgtgtgtgtatatatacacacacacactttttttgagatgaagtctacctctgcctcctgggttcaagcgattctcctgcctcagcctgccgagtagctgggactataggtgagcagccaccatgcctggctaatctataaatagttacaaattattaccttgataggtcaaaaactagaacgaaaatgatatgcttgcttatctttgtagatgggaaaattcaactcttctagttaaaagctttagttaccctaggaataggataatgtatttttattcttaaatacttaaataatatcaacatctgcatttctaccaaattgatttaaaaattgataacattaagacacattttataaagtaaaacttgttagataaagtctcctttgaccacctttgtctagtgacaacccatacataccacgaatgttgtgtatatccttctagttcatttttttctgttacaacattgcttacatactttgataggatcaagaccagttctctaggccagatgcagtggctcacacctgtaatcccagtgctttgggaggctgaggcaggcaaatcgtctgagcgcagcctgagcaacattgtgagaccccatctctacaaaaaatacaaaaatgaactgtgagtggtctcgcagtactgtggtcccagccactcaggaggctgggagaatcacttgtgcctgggagattgaggctgcagtgagccattgatatgggtaggctttgtcttcccacccaaatctcatcatgaattgtaaaccccataatgcctatcatccccacgtgtcaaggtagagaccaggtggaggtaattgaattatgggggcagtttaccccatgctgttctcatgatactgagttctcacaagatctgatggttttataaggcgctcttcccccttcactcagcccttctccttcctgccaccttgtaaagaagacaccttgcttctccttcacctcccaccattatggtaagtttcctgaggcctccccagccatgctgaactgtgagtcaattaaacccctttcctttataaactacccagtcttgggcacttccttatagcagtgtgagaacaaactaatacaagccatgattgtgccactgcactccagcctgggtgacaggatgagaccctgtctcaaaataaaagaggattgttatctatagaaaatctaaaggagttatttacaataacaacccaaattataaaatacctaggagtgatctcagcaacatagcccatatgataaaactagaagtgtgctgtagataaataaatagatccattatgtcaagtaatgggaaaaactggaaaagttattggtgtcatttattcctaaatttattatatatgtttaatacaacattaatagttgaagagaacttacattagcttttgatatttgacaaagtgatgatcaaatataacttagaaaaaaattaaagctaagaagttaacaaactcccctttttaatgggtttatgatgccagtttggtcacactaagttttgtaaggtcttgggtgtatttttggactttatgttcttttctgttgaacaatttgtcagtttttgtaccagttctacaatgtgtttattactacagtcaaaacaacgtcactggctgacttctgcatgtcctatcttattcaaaatgacctttcatgatcagagctttgagttgacccaaaggcagggtaatttttacaagattactgtttgaaacgtcaatgaaaccagagcacatgggcatgtgcacatatatacacacacatacacactcacatgttataattgaggcttccattgaatgaaagtaatggtagtataatggaccatcttgtagatggtgctgatggcctctaatcctcgttgaagattcgtgggtttttttgtttttttttttttgattcctcatcaaaccagtgttttatcttgcggtagccagagtaacatcatatcagattgtaatctatagctatagctttcctttttactattgcataaaaattaatattatatttgacctctttaagaatttttagatttcttatttaggtttcctttaatgctgctatattctgtttcttttcattgatttcttaaaataatttagatgctctaaaacgtaggcctggctgctttattttgtccatttccccgcacagggtgagtcagtcttttcctcacttcagtttagagctcagtaatcaaagggcacaaatagcaagaaggcttaagaattatgtcttaaatagtataagacaaaagtggcaccaaaggaaggacattcctgctaggatggggagcttggcttaatactaaaggtgtgtatttgtttagttctggttataatctcataatacatccgggatacatggcttaatgttggtttcagtgaaggccagttactatcctaaccccaccccaaaggtgaatgatggatggatgtatgattggctgactgaatgacttattaattcattcaataaatttttgttggctcactgccctaactgccatgcaggaaaaagatgagtaagttacattttcagctctcaaagaggagattgagaacttttaatgtgagacagagtgaagttattttatacaaataaaaatacttgtgttattggaatttcctgccatgttattcagcatgatttgtacttgtggaaattattaaaacttaattgtatagcatgtgtagtcagccctctgtttctgagggtttcacatccatggatttaaccaaccacagattgaaaatgcttggggaaaaaataataattatacaacaataaatgataatgcaatttttaaaaaatacagtataaaaactttacatcacatttacactgttaggtattataaataatctagagaagactaagtattatggaggatgtgtataggttatatgtaaacactttgccactttatataagggacttaaacatccatggattttggtgtccaaggagagtcctggaacaaatcccccttggatactgaaggatgactgtatttcccttcttttcctttactttttatttttaaggctagtcaaatgaagcagtgggaggggagaaggaacaaagaaatcttaagtggttgtgatcaattagttgtaaaccccactgcattctgaccagcccatatttcttttcctgtatctgtgttctttgaacagtttagtggcgatttctttagggcaagttttttgttttaccgtgtttgttttgtatctaaaaagagaatttggtgaccctggggaaataggtaaaaactagagacttctttttttgagacagagtctcactctgtcgccaggctggagtgcagtggtgccatctcagctcactgcaaccttcacctcccgggttcaagcaattctcctgcctcagcctcccaagtagctgggactaccggcgcatgccactgcgcccagctaatgtttttgtagttttagtagagacggggtttccccatgttgaccaggctggtctcaaactcctgacctcaggtaatccgcctgcctccatctcccaaattgctgggattacaggcatgagccaccacacccggcctaaaactagagacttcttaactaccttagagagtatagatagggctgggcatggcggctcatgcctgtaatcccagcactctgggaggcgggaggatcccttgagcccaggagttcaaggcctttctggggcaacatagcaagaccttgtcttgacaaaaaataaacagaattagccaggtgtggtggtgcatgcctatagtcccagctatttaagtggctgagatgggaggattgtttaagccagggaggtcgaggctgcagtgaagcatgatcatatcactacactccagcctgggcaacagagcaagatcctgcctcaaataaataaataaataaataaataaataaataaatgagtaaataaatatcttgcgctctcataaaacatacttgtacattgctaataataatgctccatgtagcataagtatggttaaaaggttatataaacctgtgcttcagtaattttgggtttctcatgaaagactatggctagagagtttttgttgtatatgtaggtttatggtgtagcaaagaatggagactcagatccagattacttagatgtgaatcctaactttgccagtttgccagtttttaacttagaccagtttactcctatgtgactcagtttcctcatatacaaaatgggaataataaatgctgtcttgctcatagacttgtaagaattagacaagttagtatatgtaaaatatttagaataatcgttgggattataacacacgttcaattcatgttagctattattattcaaacagaattgggagaaggaatacttgggaagttgaatttagtttattttctaagttttagctttcttcaaatcttttcacacataacagagtagataaatttgaacttaactttattttatttatgttctaatttttcagataccagtttttaccatttagggaaatgatcagaaaccaggaaacataaatcaaggagagaagaaatagagaacagaaatcagctttgagtgattaaaaactggtagtgctgcagttttgtccttctaagtgtttcttacaggaactagaaaagcagagctatttttaaaaattattaattaattatttttttatttttatttttgaggcagggtctcactctgttgcccagactggagtacaatggtgtgaacagggctcactgcagccttcacctcctgagttcaagtgaccctcctgcctcagcctcctgtgtagctggaaccacaggcatatgccaccactcccaaccttgttgcctaggctggtctccacctctggagctcaagcaatcttcccacttcagccttccaaagtgctaagattacaggtgtgagccaccatatccagctgaagagctattttcatttatttttatttttaaattttatttattattttttttagtcagagtctctctgccacccaggctggagtgcagtggcaccatctcagctcactgcaacctccgcctcctgggttcaagcgattctcctgcctcagcctcccaagtagcagggactacaggcacgtgccaccacacttggcttattttttctatttttagtagagatggggtttcactgtgttagccaggatggtctcgatatcctgaccttgtgatctgcccgcctcagcctcccaaagtgctgggattacaggtgtgagccaccgtggctggcctgtttttttgttgtgtttttttttgagatggagtcgtgttctgtcgcccagcttggaatgcagtggtgcaatctaggctcactgcaacctcttcctcccaggttcaaacaattctccctgcctcagcctcctgggaagctggggttacaggcatgcaccaccaccccggctaatttttgtatttttagtagagatggcattttcactgttggtcaggctggtctcgaactcctgaccttaggtgatccaccttccttggcctcccaaagtgctgggattataggcatgagctaccacgcccagccttattttttaaattttatttatttatttatgtatttctttattttgagacagagtctcactgtcacccaatctggagtgcattggcacgatcttcagctaactgcagcctccacctcccagggtcaagcagttctcctgccttagcctccccagtagctgggactacaggcatccaccaccacacccagctaagttttgtattttcagtagagacagggtttcaccatgttggccaggctggtctcaaactcctgacctcgtgatctgcctgccttggcctcccaaagtgctgggattacaggagtgagccaccaagcctgaccacaacaaagtgcttttgaattactggcttgaagaggtttgatataaacactatttatatagtcatcctagttcttctacaggaatttttattgagtcgtagtgtaactaggtgttcattactgagaatttttatttagtagagaatgaaggctatattctcctattcatgtactggaaaatgatattgtttaaggagatttcttgttaggaatttctgcataacttttacaaatgttatagctagctgtcatcagacacatactgtgttcccactggatatctagtgttggtaatattcaggtttctttctcactcacttaaagtgaatattgagggccagccgaattaggaagagttgtgaaagagagagaaggaagaataattggcagtggctaatagtcatctctttgagtcactagtcatagtcacatgtttcaaacctctgtgatgtgggctccttgatttctgactagtttctacacatcagtgatacctcttggttccttaatagatgtcaactgggccgggcacggtggctcacgcctgtaatcccagcactttgggaggcagagatgggcagatcacctgaggtcaggagttcgagaccagcctgaccaacatggtgaaaccccagtctctactaaaatacaaaaattagccaggcgtagtggcaggcgcctgtaatctcagctactcgggaggctgaggcgggagaatcgcttgaacccgggaggcggaggttgcggtgagctgagatcacaccactgcattccagtctgagcaacagagcgagaaaccttctcaaaaaaaaaaattgtgaatataaatagtccaatagtttgaaactaaataaaatgaaacttttatttagctgtgaagatttcttcagcgcatactaccaatagtagttggtactatgaaaaacagataacacatgctgatgaaacgtggaattgggaggccaggcatggtggctcacgcctgtaatcccagtactttgggaggctgaggcgggtggatcacgaggtcaggagatcaagaccatctggctaacacagtgaaaccccatctctactaaaaatacaaaaaaaacccaattagccaggcgtggtggtgggcgcctgtagtcccagctactctggaggctgaggcaggagaatggcgtgaacccgggaggcggagcttgcagtgagccgagattgcaccactgcactccaacctgggcgacagagcgagactccgtctcaaaaaaaaaaagaaacgtggaattggttctttgagatactctgttattactggaagactttttttttttttttaatagagacaagatctgcccccactggtctcaaactcctgggctcaagcaatcctcccaccttggcctcccaaagtgctgggattacagtaatgaacctggactgcacctggccgtggaagaattctgagtgggctttaaaaatccttttaagttcagcatgtccagtagaactttctgcaaagatggaaatgttctgtatctgccactctcccatgtgtagtcatatgtagctagctactgagcacctaaaatgtggctagtaaaagtgagagactgaattgtaaattgtatctcattttaataatacaaatgtaaataatcatgtgtggctagtggccacagtattggacagtacacatagacatttgagaactgagcagcaagtttgataaccaatacttctctaccaatgattaaaataatgtaattcttatttacttttagtatgcttggaaatgttgctttttgttttgctgccattagaaccaataacagtataatatttggccggacgcagtggctcacacctgtaatcccagcacttcgggaggcagcgggatgtggatcacttgaggtcaggagtttgagatcagcctggccaacatggtgaaaccccgtctctactaaaaatacaaaaattagccaggcatggtggtgcgcacctgtaatcccagctacttgggggcctgaggcaggagaatcacttgaactcgggaggcggacgttgcagtaagctgaaattgcaccactgcattccagcctgggcaacagagcgagaccctgtctcaaaataaaaaataaaaaataaaaaggctatagtattaggaagaagacagaggaagttaatttaggaatgtgttgtttactgcgggtcttcacttatacatcatcttcccactgaggcccttccgctcacccagtttataatttagcacccttcctttcagcccaccttattttcctttcctcccttttttactctgtggtacttgtcaccatctaatgtaatgggaagagggcagggattattttcccctgttgtattcactgctgtgtcccaacacctagaatgatacctgacacattagaggtactcagcaagtatttgtggagtgaataagtgagggttgtggtttctcaataattataatctaattcatttaacacttattttgcatatagcaagcattgagttagattaggtatatagagtacactatggtcactaccctttccatagtaaaacatttatttctttgtgagcttcaaatcactgacaagaaaaaaatttagaaaactaaaaacatttctttgaaccattatttaaaacagaatattgaatcggttaaatcattggttggaagggacttggcaatgatttgaatcagttgtctgatgtcacatggtggtttaaagttccatcagtgtcatttacatcctcttctcatttccccttttccttcatcccacaacatatgaaccttttgctcacttactttttctacatcttctcatctccattcagctagttctcactttcttctaggcctgcctttcccactgactttactggaccttaaggaactcctcaaatccctatccaatattaactgaaactttcctgttgattatgatttcttataactccttcctcagttccagaatcttctccctatcccctgggatatcctcaagagcttattggcctgaaaaccaaaacttgaagagaaagcaacaaggcagaatccctatatctccagtttctttgagtgtgatctttcattttgtggagctgaaagccatcctgctggcataatttcagtttctctcgctaataaaagtccaacatattgtaggttttaaacatatacattacttcatgcctaccattattgagagaagaagaaataatgtagcttctgtgacataaaagcatgacagaacctctccagtttttcctaaagaactgtggtggtttaatttaaactattggggaggtggggttcatttatatagagaatctaaatggaaggagaggagccaaaatatattaagcacctctaatcattaggtagtctttggaaatttttcttatttaatcctcataactctatgagcagttttcttcattttacagatgtgtaaactgaagtgcatgtaagtaaagtaactttccagagtaacctaatcagtaaatgggaaagctgagattttacatagttatatgactgtaaaccctgtgcttttttccattggtaagccatgctgccttctagaagtggaggcaagggagggaacaagagttacagcgtttgatgtagaataggaggcagtttgtttgtttttcacatccagtgagctagccacataaataaaccagtattatttgtggtaagtggcatgagtatctggtgattccagtggccctgccttaactttaaccttctgtcgctttcagcctgttcttcaggctagttcacatgaagtacaaacacttcctactaaggatcttgagcctcacagttgtgattaaatgagggagtatgtgaagcttcatatgacaaatctatcccctttcttactacttgcaaagcagtatgttctcaaaaaccacatgaacataccattttttccccacaaaagcaagagtttcacagcagctcccaggattgtgtggaatgatagagtagtctatggtctcgacgttttttctggcctccgtgagaaaagttccactgttggaggtcggaagaaatgtagagatgatgggctattctatccatggtagaatagtggatgaatagcctaccttggatgaatatagtggatgaatattctgccagggtaaaatagtctatggtagaatagaatctctgagaaaagtttaaaattaaagaatgctgtttctttccttatactcaagattaataatactcggtgcgtgtatactgtacatcaaatgtgacaagcattgagagtttaaggataaatacatcatgggccctgcccacaaggaatttctagcttaattgagaagtctgaagattactgcatttcaggctggtgtacttaataacagagtatgataacttaggcactgtgccaacatatattggtaggtgtaagtgtgtctagctttgtcctgaggtcagagaaaaaaacttttttttggtggtgtgtccagaaaaccatagttatgattagctctttacctctcctgtattatcccttgatgcttgtacctatttctcacttctgtcatccctcctatggctgactctttcaggttcttttttttttttgagacagagtctcgcactgtcacccaggctagagtgcagtggcgtgatctcggcttactgcaagctccgtctcccgggttcacgccattctcctgcctcagcctcccgagtagctgggactacaggcacccgccaccacaccaggctaattttttttgtatttttagtagagatagggtttcaccatgttagccaggatggtcttgatctgctgacctcgtgatctgtccgcctcggcctcccaaagtgctgggattacaggcatgagccactgcgcccggccttccagacagttcttaatggatgggtaggaatttgccaaatatatctaggagagaaattcctggcgaagggagcaatttgtacaaatagatgagaaatgaagagtttgcagattaccagcaaggctttctaatttccacatgtagcttgaggcacatgttatcaattgtaggatgttacctcccttaactatccagtgccagccagcctagagtagatcatggggtaaagaaaagaaagctgctctttcccctaattatatattcagaggttgaaaattagtctttgatgtgaatatgtatttgtgtgatttgctagtaatttctgttggtcatcacgtcctagaggaaagtgacttcttcctaacccctcactggagtttacctccctcagacatctcaagccataagaaagaagtatgctgaattaagctgagggagctataattaaaatagtcaatagctgattttcctaggtaatccaatttgtattcatacttcagcataaaaatacatttaatttaaagcattctactcttgtgattgatcttgtaaactgcttattaaaaatataggctgggcacagtggctcactcctgtaatcccagcactttgggaggccgaggcaggcggatcacgaggtcgggagatcgagaccatcttggctaacacagtgaaaccctgtttctactaaaaaatacaaaaaaattagccaggcgtggtggcaggcgcctgtagtcccagctactcgggatgctgaggcaggagaatggagtgtatccaggaggcggagcttgcagtgagctgagatcgcgccactgcactccagcctgggccacagagcgagactccatctcaaaaaaaaaaaaaccaaaatatatatatatatatataaacatggggctgggtgcagtggctcatgcctgtaattccagcactttgggaggccgaggcgggtggatcatgaggtcaggagatctagaccattctggcctcccaagtagctgggactacaggcacgtgccaccatgcccagctaatttttgtatttttagtaaagacagggtttcaccatgttagccaggatggtcttgatctcttgacctcgtgattcacctgcctcggcctcccaaagtgctgggattacaggcgtgagccaccgcaccagccactacaatacaatttttatagtgaatttaaaacaccaaacaccacattccaaaaagaactctgagtcagacaccaacagtaaaagcttaccgtgatctcagtctgtctttagtaatgaagcccaatgactaacatataagaagacaattcaaactatactttgttcaggaaaaggaagataaagtcttccacatcttctggatggaacctgggaaagatattccacagtgtcttactgcttataaacaattttaacaaatcagcattagcttaatggagggaaggaacaattcatggcttcctgatgagaaattcagttcacatttatgtggcctgctttggagcaacttgtgctgttagctgatgatcttaagtttctctgttgagcactacctgtggaactgtccaaatctgggcttttaggaaaataatatcttggccgggcacagtggctcacgcctgtaatcccagcactttgggaggccgaagtgggcagatcatgaggttaggagttcgagacgagcctgaccaacatggtgaaaccctatctctactaaaaatacaaaaattagctgggtgtggtggctcacgcctgtaatcccagctactcaggagggtgaggcaggagaatcacttgaacccaggaggtggaggttgcagtgagccgagatcgtgccactgcactccagcccaggtgacagagcgagactctgtatcaaaaaaaaaagaatatctttggtatgcccagcaatttataggttatatgtggtaattagaaacagttctttaataaaacaaggaaggcttaggtcgggtgcagtggctcatgcctataatcccagcactttgggaagctgaggctagaggatctctctctctctttttttttttttttttgagtaaaactttaaatttttctcccactaggatctcttgagtccaggagtttgagactgcctggacaacatagtgtgaccctgtctctataaaaaaaaattaaaaaattagctgggtgggtggcacatgcctgatgttctagctactccggaggctgaggtgggaggattacttgaggccaggagttccagtgagctatgatcgcacctctgcactccagcctaagtgacagagcaagactctgtctgtaaaaaaaaataaaaatgaaaaaaggctctcattagagggctttaagtgctgtctaaatctcaatggtagcttcaattcctttgcctattaaatcttatttttctaaggtgttttattttttttgagacagggtctcactatcatccaggctggagttcaatagcacgatctcagctcactgcaacttcgcatcctgggctcaaacaatccttctgcctcagcttcccaagtagctgggatcactggcatgtgccaccatgcctgactaatttttgtattttttttttttgtagagatggggttttaccatgttacccaggctggtcttgaactcctggactcaagcaacccccgcttggcctcccaaagtgctgggattagaggcgtgagccactgcacctgacctaaggtttcttgttctttccctaagtaaaataggaagagaatcacaaattttaattctgctacttccccttgagggactaagctggggagaataagtactctaaaaagggagtatcttattagctaacaaataacaagagatagctgtctacttcttacaaagttaaagtgattcttccttttacatttctaaaacataatgcatggaagactaaaatgaactcaaggctttattgttaattttaatgtcattagtgtgccagtatcgtcctacctttctgcttgtctacttaccaattagcacagagtaaatactgattgttagaagaaaaatgaaacatgatggtcagggaacatgtagtgtcttggcacataggcaacagacttagcatttctttctttcttttttttctttttttctttttttttttttttgagacagtctcgccctgtcacccaggctggagtgcactggcacaatctcagctcactgcaacctctgcctcccaggttcaagcaattttcctgcctcagcctcctgtgtagctggtactacaggtgccagccaccacacccggctactttttgtatttttagtagagacggagtttttccatgttggccaggctggtctcaaactcctgaccccaggtgatccgcccgcctcggtttctgaaagtgctgggattacaggagtgagccactgcaccgggcctagacttagcatttcattttattttgttttttattttattttttgagacagtctcgctctgtcacccaggctagagtgcaatggtgcaatcttggtcactgcaacctccgcttcctggattcaagccattctcctgcctcagcctcctgagtagctgggattacaggctcccgccaccacgcccggctaatatttgtatttttagtagagaggggtttcaccatgttggtcaggctcttcttgaactcctaatctcatgatccgcccaccttggcctcccaaagtgctgggattacaggcgtgagccactgcacctgtctaaatttagcatttctaagagattagttgtagagcatggacttccttggaaaataaatatttcttttggagcttaaaaattcttggccatttatacaagagtttcagtaagtccgggagtcagactaaggatacctggattttagtcctggctctgagcaggcatttaacctctttgaacctcagtttcctccttctgcaaaaagtaggagattgaaattgagccaaaagattgctaagaatcctttcttttttttttttttgagatggagtttcactcttgtcaccccggctggaatgcagtagcgctatcttggctcactgcaacctctgcctcccaggttcaagtgattctcctgccacagcctcctgagtagctgggactacaggcacgtaccaccaagcccagctaatttttgtatttttagtagagacgggatttcaccatgttggccaagatgttctcaatctcctgaccttgcgatctgcctaccctggcctcccaaagtgctgggattacaggcatgagccactgtgcccagcccctttcattctttaagttttattgacactctcacaatatcgtagaatcagcagtgagccatgccaagatttggcttttattttattttatttattagagacagggccttactatattgcccaggctggtctcaaactcctaggctcgagggatcctcctaccttcgcctgtccaaatgctgggattataggaatgagccactgtgcctggccttttacatttggcaggtcgtttttattttggcatttaaatttggcagatggttttagcagctatacctagatccataaatctatcttgttatactcttgtatggtcatgtctacataaattagattagaaggtactgtttctgggctgtgtgtgtgtgtgtattttcaatgtgcccagtttgaacttacccaaatattcaaggtaatgcttttatctgggtccttccatttgcttaatatttctatacaccaactggttgtgttcagactttctctctggcctgcttcttccaacttgctccctggagtcatactcttgacctggcccctcctttctcgatttgcatttattgagaggttttcaggtaccaggaacattacaaagcactttatttctgttcatgtcatttaatccttacaaattccctgtattaacaatttttttttcttcgagacagagtctcgccctgttgcccaggctggagtgcggtggcatgatcatggctcactgcaacctctgcttcctgagttcaagcgattctcacgcctcagcctcctgagtatctgagattacaggcatgtgccaccactcccagctaatttttgtatttttagtagagccagggtttcaccatgttggccaggctggtctcaaactcctgacctcaggtgatctgcctgccttggcctcctaaagtgctgggattataggcgtgagccaccacgtccagccttgtactagtaattgttgtatacttttataatactagaaaactgagacttagagaggtgaagtaacttgtctagtgttaacacttaataagtggtagagctggaattaaaatttcaatctgactccaaagctcatgctcttaagcaatatactgtgttagttccatgatgatgatgatggtgataacgatgttgttaattacaatatgttgagcacctcctgagtgacaagcaatgcattgccaccttttgcattcccattttacaatagtggaaactgcttttgctcatggtctgcttttaggctaataagtataagtacctaggttccaaagtattgggcattattgaattgtgctttcagtgcatttttccttttactttctttcctgttttaatggtcaacatcataatgtttttctaattactaccagtattaacaatttaatgttgtctgaatgtttctgtacttttttcccttactgatgccttagcattgaggttttcttatttgttacctttgctgttttttctctatcaaaagcagataatggggctaagataatagagaagggattgtaccaaggacaagctaagtacaggaaagttcagatgctagaaatctttctgggatctcagtttggagaataaagatttaaatgaaaaactcccattttttggtagctgtctttttttaaaaaattattttaatttttttttttagagacagggctcactgtgttgccgaggctggactcaaactcttggtgtcaagtgatcctcccacctcagcctcctgagtaactgagactacaggtgcacgccactccacccagtggtagctgtcttttattgaaggaatattagggctttggtacttactagcttggtgatattagacacaggatttgaccttactagccctagttttcttacctgaaaatagggtaaataaatatacctcacaatgcatggttagttgtggtgatgattaaatgcagtaacaagtgtaaaactccttaatatattactcagaattgttagcttcctcttttaccttcagatgttagtggaataatccaggttatgtggaggttatgttaaggttgtgttatgtgtgtcttttttacatttagaaaatttagtgttagtatactaaataaaaatttatcaagctgtatccttaatatttatgtacttggctatatgtaagttagttacggataaaaaaggaaaaatcaatgtgcaaactggacgttcatttgctgcatgtgattagctgatctttccatgtattatgcccagcatgtagggctactctttgtaattttttattccccaagatcatatggaaattattgagttttagcaagaagagactgttatataataccttccaaatatttatttcgtttattgttttagtaagcagattttcagaaatatttgtttgtattctcagaaaaggtatattcaatcctaaaatactgtttctaatgttattaattcccagtacatagatctcaccttgctttaggcatgcccacctacaggtaggaaataaaattttagaataagcagcatgtcttagtctgttcaggctattataacagaatactatagactggggggcttaaacaacaaacatttctttctttcttttatttttatttatttatttttgagacagggtcttgcattgttgcctaggctggagtgcagtggtgtaatcacagctcacaactcacctcctgggctcaggcaatcctcccacctcacctcccctccctccagtagctgggactactggcacatgccaccatgcctggctaatttttaaattttttatagagacagagtctcattatgttacccacgctgatctcgagctcttgggcttaagtaatccttcagccttggcctcccaaagtgctaggattacaggcatgagtcaccaggcccagccacagacatttatttctaacagttctggatactgggaagtccaaggtcaaggtgccaggagactgggtatctgtgagggccttcttcctggtttccagacagttgtcttcttgcgtagcctcacatgatggaaaaagagaactctctgggtcttttttgataaagtactaatcctattagtgagggctttaaaaccctcaatgacctaattatctcccaaagaacccatttcctatcaccatcacattggtcattagaatttccatatataaattgtaaggggacacaaacattcagtccataacacagtgaaatctgatacttttgaggtaaacctgtgtctaaaacacacctttgaatggactactgctcctattagccttttactcaaaaccatcctggtgtttttgtgtgattaaatttgtaaattctttggtgtactcttgagcaggctccctttcttctgtgactcagagcctggagcgttgcagccaagctcaaaagtcaggaacgggggtgtggacttttgggctatgccagtcagcagccagaatgtggttggcagtctcctccccttcctgcacttcagctctacacagtgtgcattctggaatgacaggcattcctgtgtgaagagtgccagtgtgaagacagttttgtaagaactgcaagtgctcaggctgtatgggaaacagaaacttcagcagatgaactgaccttatgccatttcctgatgtttggcagtgacactgaaagaggaccgcatgtcccctctttatgtggatttatcttttatgaaaagtttgcttttgtccgggacagtttgttgtcgtgagatacatcagacaatataatcatgggacaagctgatgtctccagaccggtaaatccagatgcagttggtgagtaatagaaggcagagaaacagaaaatcttgacagaagcaaggcagatttacaggtgaacttgagtatttatgtgaagttaaacacgagaatgttgatgatcccaactttgaaatgtttatgtttgtgaagaatgaatgaagtcatgcggaacatggcgagaaactttaaaaaattaagttttttaaaacttaaaaacttaaattcagtttattaatttatcgctcacagttttgttttacttgatctctttgaagttttttatattatattgctaaggaattatctgttaatttcttgccgttactaaagataaatgctacagaaacttatttagaattcagagatattttgttagtattttacagaacttggaaaatagaactgttgacttctatagacagaaccacttttaagaattaagtttttagacttggttatacattttcctaataagtctcaggcattttccattgcactagtgtttccgtttctcttaagtcaacactttgatataaacttttctgaagttagtactttacatttgaaatgttactaagggatagctagagagcaagctgattgtgagtatagctcagagtttcaaatcttctatgtgaaatggtagtcacttgtcactgcaagctcattttcctaatcttgtagggttttatatgacaatcataaattgggaaaaacagttttaagcagatgttcattaaagggttgcttaagtataagcaaaactagggaaagcctgtgaatcatttctagacattataatatttaagaaagatttataccttcactttgatttatggagcagcagaaaacatgttcagtcctaggctgcattttttgttttttgtttttcagaaacaaaaaatgttggtgacttaaaaaaaaagcataaagtgtggaaacacaggtaacactcccaaatgtttcataatgtagtgagattttgtttctaaaggtagtattttcacctgagagcttcctagatgaaatatcttcagtatttttcatgtattattgaaactgaggcacatggatcacaaagtgagtcattcagcaacagattttcagaactgaagtcaggacttgactcactttaccttgatcactagggctgtgtctttatcaattcattaactcatttaaaaaaatgaaatgtttcataaatagaaaaaggtataaagaaaaatataaagaatcatctggggccactccccagcctaacagatgaaatttagaacataaagataaacctcacactatccttctcttctgcattcccttctgatgacattttgcttctttgtttccagaattaaacactctcctatatttgataaataactcacttttgggctgtaaattctcctgtggtttctacgccaaacattagttgtttgttagcaagtatagtaaggactcaatgctaggcatttatctatgagatggaaatgaaagggctttgacaaacaataaattgtaaagcaagtaaaatttagtggtgagtggtggtatttaagaagaatgcccatctaagatctatatactgtattaaaaacttcatctgaggccgggcgcggtggctcacgcctgtaatcccagcacgttgggaggccgaggcaggcggatcatgaggtcaggcgatcgagaccattctggctaacacggtgaaaccccgtctctactaaaaatacaaaaaaatcagctgggcgtggtggcgggcgcctgtagccccagctactcgggaggctgaggcaggagaatggcgtgaacccgggaggcggagcttgcagtgagccgagatcgtgccactgcactccagcctgggcgacagagcgaaactccgtctcaaaaagaaaaaaaaaaaaaaaaaaaagttcatctgagtaacgtttggtatttgtatgcttctgaaaaaaagtaagaatcaaattcatcaattctttttttttttttttttttgagacggagtcttactctgtcgcccaggctggagtgcagtggcttgatctcggctcactgaaagctccgcctcccgggttcacgccattctcctgcctcagcctcccgagtagctgaaattcatcaattctattcctaccagtagccctaataaaagacatttgaggaagaaatagaaatcaggagcttaactaagttttttatgtttcctctggatttaattttggggttttatttcctattacctagataataagtagttgactatcagcagttttcatggactgactccattattatgctatttataattcaggatgtattctgtttgagcagatcaggaccaggttatgaaggcttaactgaaaaccttgaggactataccaattccaataaaggttttcaccaaacaacagtttcttaatttaattttcaaagcctttatgtgggtagctgtttggaaaatctcaccattttacttggaatgataaatatacaaagtaaattaaaacctaaattatctgtttactattctaggcctataatacagcacttagttttgagctttgaaattaatagtactagatttagcaagtcaactgatgcaaaacacatgaatgaatatattgaattgatttattattactttcaggcactgtgaataacatagaggcccctatgtagatattattcatgtctatgccctcaagaagtttgtcttctagttgagaatttaaaatatgaaaaagtatccaaaatatttgtaaaatttttttaaagattaaggcatacttctttttttttaatttaattttattttttttttacttaaaaaatatttgtgtgtgtgaaaatggggtctcactgtcgtgaccaggctggtctcgaactctagcctcaattgatcctcccacctcgggctcccaaagtgctaggattacaggtgtgagccaccagtcctgcagttaaaaaaaggacccactcctttaagttaattgattcccttgacttgtaatggaaggccagcgctattaaccaaagagtctgctttcaaataaataacctttgcatgaggattcatatgcaaatttatgagatgttataaccatatccaaccagagtttctactgtaggatctttctaacaactggtgaactgagtatttgaatgtacattaggaatctatgctgtggtatccattcaaggaaataagttctcatcagttcattgaaaaaaattaaataaaatacgttcataggagaagcatgtagatttatctagataaaacattgcaatcagggcagagtgcattggttcgtgtctataatcccagcactttgggaggctgacgcaggagaatcacttgagtccaggagtttgggatcagcctgggcaacatagggcaacaccgtttctacaaaaataaaaatttagccactgtggtggtacttatctgtagtcccagctacttgggaagcttaggtgggaggatcgcttgagcctggtaggttgaggctgcagtgactcatgattgtacctctgcactccagcctgggtgtcagagggagacactgtctcaagaaaaagaaacacaaactttcaaatcctactttgtagttcttaatgaacataaaaactgtttttttgctcaccaaaattctttactatgtgtcatattaaaacaactagctaattatcacatatccttaaattaggcacaagaccgaagaattttttcaatttattttttattttttaaatgtatttttttggctgggcgcagtgtctcatgcctgtaatcccagcactttgggaggccaaggcgggtgaatcacgaggtcaggagatgagacaaccctggccaacatggtgaaaccctgtctctactaaaaatacaaaaattagctgagcatggtggcgcgtgcctgtagtcccagctactcaggaggctgagacaggagaatcgcttgaaacaaggaggcggaggatgcagtgagccgagatcgtgccactgcactccagcctggcgacagagtgagactctgtctcaaaaaaaaagaaaaaaaagtttttgtttgtttgtttgtgtatttatttatttacttttttttgagatgaagtctcactctgtcacccaagttggagtgcagtggcgtgatttcgactcactgcaacttctgctttccaggttcaagtgattctcctgtctcatcctcccgagtagctgggactacaggtgcccaccactaagcctggctaatttttgtatttttgtagagacggggtttcgccatgttggccaggttgctttcaaactcctgacctcaagtgatccgcctgccttggcttcccaaagtgctgggattacaagtgtgagccactgtgcctggcaaattttttttttaattgaaaataattgtacctgttcatgggctacataatggatatttccatatgtatgatgtgattagattagggtaattagcatattcatcatctccaacatgtatttatttatattgggaaggttgaaatcctcctcagctatttgaaactacatattattaactatagtcattctgcagtggcatagaacactagaactttttcctcttatctagctgtaattttgtattctttaacaaatctttccctacccatcccttcccattatctctcccagcctctagtagcctctgttgtactttttactcctatgagatcaacttttttttagcttctatgtatgagtgagaacatgtggtgttaaacttcctgttcctagcttatttaacttaaaataatgtccttagttccatccatgttgctgagaatgacaggatttcattgtctttctttctctctctctcttctttctttctttcgttctttcgtctcaactctgtcaccgaggctggagtgcagtggcgcgatctcggctcactgcaacctccacctcccaggttcaagcaattctcctgcctcagcctcccgagtagctgggactacgggtgcacactgtcatacccagctaattctttttttttttcttgagacagaatcccactctgtcacccaggctggagtacagtgacacaatcatagctcactgcagcttcagcctcctagattcaagcgatcctcccccctcagcctcctaagtagctgggactacaggcacatgccaccacacctggctagttttttttattttttgacgaaacgaggtctcactctctttccctggctggtctcaaactcctggacctggactcaagtgatcttcctgcctcagccttccaaagtgctgggattacagttgtgagctagtacacctggctcattcttttttatggctaaatagtattccattttgtatatataccacattttctttatccattcatctgttgttgaacacctaggttgattccatatcttggctgttgttgagtagtactacagtaaacatggaagtgcagatatctcttcagtataatgatttcctttcctttggatatattcccagtaatggtattgctggatcatatggtagcgctatttgtagtttttctttcttttgaggaccctccatactgttccccatagtggctatactagtttacattcccaccgacagtgtatagtgttccctttactctgtaccctcaccagcactggctactttttgtctttttgataatagcctcctaactggggtgagatgatacctcattgtggttttgatttgcattcacctgatgatttgttatgttgagcatttaaaaaaatatatttggcttttttttttttttttttttttttttttttgagacagagtcttgctctgtcgccaggctggaatgcagtggcgtgagcagtcttggctcactgcaacctccgactccctggttcaggctgttctcctgccccagcctcccgagtagctgggattacaggcacgtgccaccatgaccagctaatttttgtatttttaatacagacagggtttcaccatgttggccaggatggtcttgatctcctgaccttgtgatccgcccacttcagcctcccaaagtactgggactacaggcataagccacagcccttggcctatttgggcatttttatgtcttcttttgagaaatgtctcttcagatcatttggtctttcccatttttatattatttatttttttatttttattattattattttttgagacagagtctcgctgtgttggccaggctggagtgcagtggcgcgatctcggctcactgcaagctccacctcccgggttcacgccattctcctgcctcagcctcccaagtagctaggactacaggcgcctgccaccgcacccagctaattttttttttttttttttgtatttttagtagagacggggtttcaccgtgttagccaggatggtctcgatctcctgacctcgtgatccacttgcctcggcatcccaaagtgctgggattacaggtgtgagccactgcgcccagcctcccatttttatattatttaactatttatttatttattttatttttttgaggcagagtctttctctgttgcccaggcggagtgcagtggcacgatttcagctcactgcaacctccacctctcgggttcaagcaattctctgcctcagcctcctgagtagctgggattacaggcgcctgccagcatgcccgactaatttttgtattttaggtagagacggggtttcaccatcttggccaggctggtcctgaactcctgacctcatgatccacctgcctcagccccccaaagtgctgggattacaggcgtgagccacctcacctggccatatttaattattcttttttaagacagagtctcgctatgttgcccaggctggtcttgaactcctgggctcatgcgatcctcccactttggcctcccaaagtgctaggattacaaacataagtcactgcacccagcccttcctaattctaattagaaggaccaaagatttttaataaattctctccaaccatttggcttggaactttccttctctgtctttccattttacctctctttttttttcctttttgccccttcatttaccctaattcactaattaacttttccccccacttttcttttgcataataatatattgctataaaagatactgtatgttctctttcctacattccttttccataaccatttgatttattttctctgaaacttggagttatggggttctcacccttatgatactggaagcagttttggggaacgtgatttggaaatatatcatcccccatctctacaaaaaaaatgtaacaattagtcaggtgtggtggtgcacacctgcagtcccagctgttcaggaggctgagatgggaggatcacttgagcccaggaggttgaggctgcagtgagccatgatcatgtcactgcactgcagcctggctaacagagcgagactgtgtttgaaaaacaaaaaagaaaggaaaagaaatatattatcacttagaggcaaaatcctaaggagattgcaggatgaataaaatttaacatagctacataacaacaataaaactggagtaaataataggttaatttaaaataaagtacttcatgagattttggagaaaaaggcttagtagtatttggttatcagaattataaagacatttctcatacctgtctgctgtttatctaacagtaaatgctttcttttaaaaaaggagaaacaggcatactttcctcatgtaatccagtgttcaggaggaggtggcaatataggggtctgtcataaactccttaaaagattctctgttatcaaatttggactaccaaccaaaacttattgatccctctctctgctccagtggattttctaaataggccattaataaggtttggatctaggtccccaaccagatcccatgttaaattgtaatccccagtgttggaagtgggacctggtgggaggtgattggggtggatttctcacgaatggtttaacaccatccacttagtactgtcctcaagatagtaagttctcatgagatctggtcatttaaaagtgtgtggaggctgggtgcagtggctcatgcctgtaatcccagcactttgggaggccgaggcaggtggatcatgaggtcgggagttcaagaccagcctggccaacatggtgaaaccctgtctttactaaaactacaaaaattagccgggcatggtggcgtgtgcctgtagtcccagctattcaggaggctgaggcaggagaatcccttgaaccctggaggcggaggttgtcgtgagccaggattgcgccactgtactccagcctgggcaacagagtgaggctccatctcaaaaaaaaagaaaagtgtgtggcacctgcccccttgctctcttgctcctgttctgggccatgtgacgtgtctactcccccttcatcttccaccatgattgtaagttcctgcagcttcccccgaagccaggcagatactagcatcattcttcctatacagactgcagaaacatgagccaattaagcctcttttctttataaattacccagtctcaggtatttctttttatttatttatttatttatttatttagatagagtctcactttgttgcccaggctggagtccagtggtgcgatctcagctcactgcaacctctacctcctgggttcaaagtaattctcctgccttggcctcctgagtagctgggactacaggcgcgtgccaccaagcctggctactttttgtatttttagtagagacggggtttcgccgtattggccaggctggtcttgaactcctgacctcaggtgatcctcctgccttggcctcccaaagtgctgggattacaggtgtgagccactgtacctggcctcaggtaattctttatagcaatgcaagaatggactaatagacctattatcacaacctacatatgtatttcctctttcttttttcttttttttttttttgagacagtctcactctgtcgcccaggctggagtgcagtggcacgatctcgacttactacaacctctgcctcctggattcaggtgattctcctgcctcagcctcccaagtagctggcattacaggtgcccaccaccatgcctggctatgtatttcgtctttctacttgcaagtaaactttggaaagtttgaagttttttttccatgagtgaatagcttatattctggcccttcactataaaaacatacccttaacctggaattttttgtcagaacagtgtgcacattaagttgccagtggtaaagcaacttcacttcttgatacaatcataggcagaaaactatttttccagaggtagaatctcagacataactgtacctgcaagttcagagagagaccttccacctgactatcttctcctgacggctttaccgagttctttctaattcccaagggtcagatctatgcaatatttccacaggaagttgtgggccttctctatacaaagcctgctttgttcattagtggcaggtttattttctgtaattttgccgaagttttctgaaacagttgtttaaagccaataataatcctcttttagaaggcaaaaatgaataagtacagtagtgtaaataccataaatgaatgttctacgtttacaatgttctgatactgtgaaaaggttgtttatagcaaatctgtttccagctaggtgggcttaaaaacagactaaaccattatattatgaagatatttggtacttcttcacagtgaagtatgtataccttgttgaataaaatcatacattaaaattttggacaaataggctgggcacggtggctcatgcctgtaatcctagcactttgggaggtcgaagcggatagatcactgttggccaggctggctggaactcctgacctcaggtgatcacaccattgcactccagcctgggtgacagagcaagactttgtttcaaaaaaaaagaaaagaaaagaaaggaaaggaaaggggaaaggaaaaaggaaaggaaaggaaaggaaaggaaaggaaacctgataaggtggccgggcgctgtgtcttatgcctgtaatcccagcactgtgggaggccgaggagggcggatcatgaggtcaggagatcgagaccatcctggctaacacagtgaaatcccatctctacttaaaaaaaaaaaaaaaaaaaaaaattagctgggcatggtggtgggcgcctgtagtcccagctacttgggaggctgaggcaggagaatggcgtgaacccgggaggtggagcttgcagtgagccgagatcgtgccactgcactccagcctgggcgacagagcgagactccatctcaaaaaaaaaaaaaaaaaaaaaaaacctgataaggtgtaaaacatacagagagttcatacagatccaataactttgttacttattaccaagtcaagtaaagcggggggcgggggtggggggacaaggcatggtagctcacacactttgagaggctgaggcaggaggattgcttgagaccaggagttcgagaccagcctgggcaacatagcgaaacctgatctctactaaaaaaattagccagataaggtggtctgcacctgtagttctatcttctcagaggctgaggcaggaagattgcttgagcccaggagtccaaggttgcagtgagttatgatcatgccattgtattccaagctgggtgaaagagtgagacactgtctcaaaacaaaacaacaacaacaacaacaactggctgtgccaggtgcagtggtgcacccctagagccccagtgacttgagaggctgaagcagcaggattgcttgagaccaggagtttgaggctgcactgtgccatgatcgcgcccattaatagccactgtactctagcctgggtaacataccccatatctaaaaaataaaaatatatatgtataataaaataaataattggttgtaaatctaattctaaaattaacattatctttgacctagggcatattgtttaatcctgttttatctcatatctccatcaagttatgcaggtataatatgtatctatagcaaatagttaatgaatactttatccgaagatgaaaggtgctaagtggtttttataaatatcatacatttatttaaaaatcacagccaatggcccagtgctgtggctcacacctgtaatcccagcactttgggaggccaaagtgggtggatcacctgaggtcaggagtttgagaccagcctggccaacatggtgaaaccctgtctctactaaaaatacaaaagttagccaggcgtggtggtgggcacctgtaatcccagctacttgggaggctgagacaggagaatcccttgaacccaggaggcaggggttgcagtgagctgagatcgtgccattgccctccagccagggtgacagagtgacactctgtataaaaaaaaaaaaaatcacccctgaaattcatatgaaacaactacacttgcacttaaaaacttcaattaaatatttactaggaaaaatatggtggttgaagaaactactagaactctgcataattaatgatgtaagaaacaagcctatgatatgtgaggtgctacaacttgaatgagggagtaagtagtttaaataccaggcctggtttcagggtactactcaaacaggaaactccaaactgtaatttggttagttatcttccactcccagcctccaccccctccaaaaaacaccaagactgtcaactctgtgacgtgctttcctaatggcctgtagctacatgactcaaagaaaaaggtgttttctttggaacacacaattgtaaaactatacccagcatcctacaccctgatttctggcaaacaaaggaaaactacctttttttttttttttcactcatagaaaacagaatggggccataggccatttaaaatgccataactagtttaaacagaaacaacagtctatccaaatgtgactgcatgcctatatgttctctgtcaaattggaaattagagggagcattttataaaatcagatgctgagaacaaagatttatgtgcagaattggcgtatgaacagtttcaggcccatctttcttagtcctttattagtataaaacaaatttgggtgtacttatataattttttaaaaaacagtgatgatttctggatacctgagtatattttttgtttttgttttttttggttgtttgtttgtttgttttgaggcaggttctccctctgtcacccaggttgtagtacagtggtatgatcacagctcactgcaacctcaaccacctgagcttaagcagttccctcgccttagcctaccgagtatctgggactgcaggtgcatgccaccacgcccagccaattgttgtgtgtgtgtgtgtggttttcgttttgttttgtttttgagagggagtcttgctctgtggcccatgctggagtgcagtggagttgtctcagctcactgcagcctctgcctcccgggttcaagagattctcatgcctcagcctccccagtagctggaactacaggcatgtaccaccacacccagcttttttttttttttttttttgtatttttagtagaaacagggtttcatgttggccatgctggtctccaactcctgacctcaagtgacccgcccacctcggcctcccaaaatgctaggattataggcacgagccaccgcacccagcctaatttttgtatttttgtaaagatgatgtctcagtatgttgcccaggctggtcttgaactcctgggtttaagcaatccacccacctggccttccaatgtgctgggattacaggcgtgagccactgcatccagcctactctttgttctgtaatgtattcatctgtcagtttctctttgtttctattacagtttctaagcattgcaattgaatcctcctgtcaaacagaaattcatactaagaagcttgaagcttgaactattgtagcaggattttttttttttttaattttagatacagggtattgctgtgttgcccaggctggagtgcagtggctattcacaggtgcaatgatacatatcacaatacagcctcaactcctagactcaagcaatcttcctgcctcagcctcctgagtaactaggacaacaggtgcgcatcactgtgccctgcccagtgttattgtagcagttttagagataaatggcttaattagatctaatcagccactgctatgaagcacttatgcattaatttttttctttgagacagggtctcacttgttgcccaggctggagtgcagtggcacaatcacagctcactacagcctcaacctcctcagatcaaaggatcctcctgccccagcctcccaagtagctaagactataggcaagcaccacacttggctaattttttttttttgtagaggcagggtctccctatgttgctcaagctgatcttaaactcctgggctcaagtgatccccactacctcgacctcccagagtgctaggattaaaagcatgagccaccatgcctggcaaatttatgcattcttcaaaactctttattatacagctaaaacacttttacctggcatatttagatcttcattaaatttggtttctagctcctttagcacaatattttacttgtggcaaactaggagaatatacttaaaagaactcttagaatccagattacagttgacctttaaacaacacaggtttcaactgtgtgggttcttatgtgtggatgtttttcaataaatgtattgacagattgtttggagatttacaacaatttgaaaaaaaaaactcacaggcagaccagatgtggtggcttttgcctgtaatcccagcactttgggaatctgaggcaagaggattacttgaggccaggagttcaaggtcgacctgggcgacatagtgagaccccatctctacaaaaaattaaaaaattagccaggtgtggtggcacatgcctgttgtcccagctactcagacagctgaggtgggaggatcacttgatcccaccaggagttggaggctgcagtgagctctcatctcaccactgcactctagcctgggcaagagtgagatgctgtctcaaaaattttaaaaagaggctgggcacaatggctcatgcctgtaatcccagcactctgggaggccaaggtgggtagatcactttagatctggagttcaagaccagcctggccaacatgttgaaacctcatctctactaagattagctgggcgtggtggtacacgcctatagtcccagctactcaggaggctaaggcagaagaatcacttgaacctgggaggcggaggttgcagtgagccaagatcacaccactgcactccagcctgggagacagagtgagactccatctcaaaaaataaaaaatacaaacaaataataaaaataaaaataagtccgggcacagtggctcacgcctgtaatcccagcactttgggaggccaaggtgggtggatcacttgaggtcaggagctcgagaccagcctagccaacatggcgaaaccctatctctactaaaaatacaaaagttagccgggtgtggttttgcgtacctgtaatcccggctacttgggaggctgaggcaggagaatcgcttgaacccaggaggcagaggttgtggtgagccgagatcacgccattgcactccagcctgggcaacaagaatgaaactttgtctcaaaaaaataaataaataaaaataaaaatgaattaaattaactagcatatactgtactgctgtaatttcatagccacctcctattactattgaagtgagctcaagtattgccagtatccacttaaaatgctgtatgatgctaattttctagtgagcagttcttcatagcttagtgcaatatcataaatcttgaataacaccacgggacctacaacacgtgccactaatgatactggaattgctcttaagaagcagagaagagtcatgacattataagaaaaagttgaaaacgaaaaaaagagaaaacacaaggaaaagttgaatcgcctgatgtgatgcataccatagattgaggtctgtagctgcagttgcctgccatttttataagtatatatacataggtggtggctgggctggggaaatggcggcttcacgagagagtgggacttgggcagcagaggcagcacagtggatgcatttctgaccttctacagtgaggtgaaacaaatagagaagagagactcggttctaacatccaaaaatcagattgaaagatggacccgtcctggttcctcttacttcaatttgaacccatttgaggttcttcagttagatcctgaagttacagatgaagaaattaaaaaaagaggtttcagcagttatccacattggtgcgtcctgacaaaaatcatgatgctgacagagcacaaaaggcttttgaagctgtggacaaagcataaaagttgctactggatcaggaccaaaagaagaggaccctggatgtaattcaggcaggaaaagaatacatggaacacggccaggcacggtggcacacgcccgtaatcttagcactttggaaggccaaggtgggaggatcccttgagctcaggggtttgagaccagcctgggcaagatagcaagaccttgtctctattaaaaaaaaattttttttttaattagccaggtgtagtggcacacgcttttaatcccagctgctctggagactgaggccagaggattgattgaacccagaaagataaaaaagtccattcaaaaggaagatataataactctaaatttgtatatacctcataacagcttcaaagtatataaagcaaaaattaatagaactaagagagaaatcactttgtcttttttttttttttttttttttttgagacggagtctcgctctgtcgcccaggctggagtacagtggcgtgatctcggctctctgcaagctccacctcccgggttcacgccattctcctgcctcagcctccctagtagctgggactataggcacccgccactgcgcccggctaattttttgtatttttagtagagatggggtttcaccatggtctcgatctcctgacctcgtgatccgcccacctcggcctcccaaagtgctgggattacaggtgtgagccgccgcgcccggccatcactttcataattagagatgttaacatacctctctcagttactgatagagcaaacagacaacaaatcagaagggatcttaatgatttgtatatgattaaccaccttgacctaattggcatatttagaacaccatacccaacaattgcacaatacactttccaataacacataattggagataatgtattataaatttgggaagaaacaactgtaagcttctgttgtttatttgcaacttggaccatatttgagatatataggaaaagcattaaatataaatggcctaaacactccaattatcctaccacgttgggagactgaggtggaaggaccacttgaacccagcagtttgagaccagctcagctcactgtaacctccacctcccgcattcaagccattctcctgcctcagcctcccaagtagctgggattataggtgcctgccaccatactcagctaatttttttttgttgttgtatttttaatagagacagggtttcctcatgttggccaggctggtctcaacctcctgccctcaagtgatccacctgtctcggcctcccaaagtgttgggattacaggcatgagccaccgcatctggcctcatttttctttttctttttctttctttcttttttttttttttttttttgagacagagttttgctttcacccaggctggagtgcagtgatgtgatcttggctcactgcaacctccgcctcccaagttcaagattctcctgcctcagcctcccgagtagctgggattataggcgtgtaccaccacacccagctaatttttgtatttttagtagagacgaggtttcaccatgttggctaggctggtctcaaactcctgatctcaggtggtctgcctgcctcggcttcccaaagtgctgggattacaggcatgagtcaccatgcctggcccctaattcatttttcttcaacaaagaagcagcctatagccagaaaatgtctgcctctgtctcttttaacctccatgaggtttccagataataatctggtattgggtttaacacacctgactgaccttaggaccctaggctgacctggagagattttttaaaacagattctgaaagtcctacctcctggagattctgtattttgaaaaggcaattgggctgattccaagtatttggacagatttcggagtcttggaaataatgtactgtttgtcctggagagtaggaaaaagaggggaaggaaggagggagaatatgaggatatgaatatgtatgtgtgaatttgagataactgagtcagggccaggtgtggctctaccccaacacaggaggtaagaggaaagaaggacatctgcctctaaaagttttgtaaaagtgaaaatcaagcacatttgcatgagaagcaaagaaaatgttgctctgttttttgtattcagtggctttattttttttatacatattttgcttatgtatcaactattttttttttgagacaaggtccctgtattaagccattcttgcattgctataaagagatccctgggactggataatttataaagaaaagagctttatttgactcgtggttctgtaggctgtacaggaaacataatgcttgcaactgccctgcttctggggaggtctcaggaaacttacaatcatgaatcatgacagaaaaccaaccaggaataagcatgtcacgtgaccagagcaggaacaagagagcaaagagggagatgccacatacttttaaacgaccagatctcacgagaactcactcactattgctaaggcagcaccatatggatggtgctaaactattcatgagaaatccacccccatgatccagtcacctccaaccaggccccacttccagtactgaagattacaattcaacctgagatttgagcgggacacatatctaaactatatcagtatggctctgtcgcccaggctggagtgcagtggcacgatcacagctcattgcagcctggacctgctgagctcaagcgatcttcccacctcagcctcgcaagtagctgggactaggcacatggcaccctgcccaactaatttttttttttttttaagagacagggtttcttcatgttccccaggctggtctttctttacctaaaaaagaagagaagccagatgctgtagccagtgtctgtaatctgagacattctcataatttcaactatttgcctgtaatctcagctactcaggaggctgaggcagaggattgcttgagtcctggagttgaaggctcagtgagctgtgattgtgccactgcactccatgctgggcaacagaacgaaaccctgtctctaaaataactagataaatagatagagagacagatagatagatagatagatagatagatagataatcagattctagtgtatttcatgtaaagtgttaaagtaattgagacccagaatgtccttgtataagtcatgcaactaggaagagtcactgtcctcttgtcatttccatcttttgcactttagtaatgaggatgctattttgcctaagtcttctgggcatagcaaactaatgcatcagtagtcaccattgcatttactgtgataattacgattgtataaatctaacctttattgaaaaacttccctaaacctccatcaatcaagtgaaaaaaagattgaatttggcagttgtttcttttaaaaatttaatgctgttggttgtatattttctcttttgaaaatacctagttttaaaagagagagaggccaggtgtggtggtacacacctttaatcccagtgcttttgggaggccaagcagggaggatctcttgagaccaggcatttgagaccaccctgagcaatttggtgagaccctatctctacaaaacaaaattgtttttgtaattagccaggagtgatggtacatgcttatagtcctggctactcaggaggctgaggcaggaggatcatttgagatcgggaatttgaggctgcagtgagctgtgattacactactgcacttcatcctgggcaacagagtgagaccctgtttctaaaataataataataataataataaatttttttaaaaaagatgttttagtgactattatgacctttttaccctcctccaaaagtgttacttgcttcagatgtgaaattgtttacagtcaacatgttagcttatcatatgctgttccttgatgtatttctacaaagtagaggttccactttaatttcaggatggtttttccacatgactctttttttcttcctctctagacttctccagagaaccttggaacagtaggtggagtgcaaagctgcattgtgtaccttcctgcttttttttggttgccttcctgctggtttttttttttttcctttctttaaattcttggccccgccttggctctcctttctctgccattaaaactaactaactaaaccctgcatgcatggtcattatgaggggttcatggccttttatttcagttctgcacatgtatcatgtcagttatgttttatgtcaaatccttaatattatggtgtgtgtgtttgtgtgtgtgtgtgtgtgtgtgtgtgtgtgtgtgtgtgtgtgtgtgtgtttgagacaggctctcactctgttgcccaggctggagtgcagtatcttaatcacagccaactgcagcattgacctcccaggctcaagccatcttcccaactcagcctcctgagtagttgggactacaggtgcacaccaccatgcccagctaatttttgtttttgtattatttgtagagacagggtttcaccttactgccctggttgatctcaagctcctgagcttaagcgatctgcctgcctcagcctcccacagtgctgggattacagaaatgagccactgtgctcagcctatgattgtctctaaggcactactatggtaaacaaattggaatctcacctctactttctgaaaacatttccctccaatttaatgtacccgctttctaatgcttctgccccgcaaccctgagcactttccaatacctagggtccttttgtgaagggagaaaataatttgatgagcagatataagtaaggtactaacaatgtgttacctctccctgaactatttatatcctgaaaagggcagggaaagggcaatgtttaatagagaaaatgattcactcactaatgaggcaggaattccctgcctcagtaaggcaagatctcatgcatttgttaagatatccacattttgtatacatgcgcctttaaaagattttgagccggctctgatcatttcaccagattttgtcctaaaatgatgtcagcttggtttggttcctttttctccttagtagtttatctgttaatggattttgatgtttggtgtccatgtgatgtccaggagtctccctgtctgcatgattgtttatcgttgctccgatcctttccaactaccacaggaagagaggggaagggacattttagagattatgctgaaataatacatttgcttccttccctctcttcttttcatgtaacagaggaagcagaccagcccactacagagccaggcatggtcctggacagtgtggaagcaggagacacaacacctcctaccaaaaggaagagcaagttctcaggctttggcaagatcttcaagccctggaaatggaggaaaaaaaaaagtagtgataaatttaaagagacttcagaaggtgagatattaagggttaaatgtgtgttctgagttagaattctctatgttagatgtatttaatttttccttatcttcccaagtttctgtagtcctctatttgaagagggtatttaatgttttattctttccttcttctttttttttttttttttttttggtgagacaggatctccctctgttgcccaggctagagtacagtggcgcaatcacagttcactgcagattcaacctcctgggctcatgtaatcctcctgcctcagcctcccaagtagctggaagtacaagcatgagctactgtgcccagttaatttttaaattctttgtagagatggggtctccttatgtttcccaggctggtcttgaactcctgggctcaagcgatcctcccacctcagcctcccaaagtgctgggattacaagcatgagccactgtggctggccagagtttaatcttttagaattaaacatcaaaatggtcatgtactaaacctaatattgtataccctcattcccaggtttgtattttgatggcatataagtatctattgagtggtgaatggagttcctgaactgtcgcaaatctaagatgcttctttccatcagaacttggtgaagaaaatgactgaatgagttgatacatacataaataaaatgcttattttctactctgcccatccacacaaagttcatccgtaaataacttactaatgaaattttctcttaagttacaattatgtaaggctagttttttggaagtgatgctttcctgacagcacaggttataaaagaaatttaagagttttaatttgaagttagtctgctagttattttctttcctgagaatataaacttaaactactttattcttttacctgtagaattagaatgctaagtgtaaggttgactttcaactgtcacatttctgagtgccattttccaatttaatgttagttttagaacggaaaatatctatgcgaaagccaagagaagagctggttaaaagaggggttctgttggaagaccctgagcaaggtgagtttacaaataaatagcatatgcctgtctctgtgcacttggtctttgattgggtctgacgagatatttgaattttctttctttcttttatattgctatttttgggttggagggtggcctttaaaaaaaaaagttcacccttccttccttggggcaaacattcctttcctctgtgtacatcctcaactttgtgccagctacaatattgcgtgtcttttttttcccccccttgagacagagtcttgctctgttgcccaggctggagtgcagtggcacaatcttggctcactgcaacctctgcctcctgggttcaagcaattctcgtgcctcagcctcccaagtagctgggattacaggcacctgtcaccacccccagctaacttttgactttttagtagagatggggtttcaccatgttggtcaggctggtcttgaacttctaacctcaggtgatccgcccgccttggcctcccaaagttctgggactacaggtgtgagccactgtgcctggctaattttttcatttttagtagagatgaggtttcaccaagttggccaggctggtctcgaactcctgacctcaggtgttctgcccacctcggcctcccaaagtgctgggattacaggcttgagccaccgcgcccagctcattttcttttttgaacacatttgtccccatgcccatatcactgcaccagtctaccagtcattgtttgtttaataatgtcaagactttcttcaatgtgtgactctatgaagcaagttattgcaaatgtgaaagtatagtacattggttgcatctcatttctcttcatctgagttatgttgcatgaggcaaaatctgaaagccatattgtatactggccaggcatggtggctcacgcctgtaatcccagtattttaggaggccgagacgggcagaacacttaaggtcaggagtttgagaccagcctggccaaaatggtgaaaccccatctctactaaaaatacaaaaaattaggagggcatagtagcaggcacctgtagtaccagctacttgggaggctgaggcaggagaatcacttgaactcaggaggcagaggttgcagtgagctgagatggcgccactgcactccagcctgggcaacagagcaagactccttctcaaaaaaatttaaaaaatcatatcctttgaagaataggggaaaggaaccaaatagatggagtattactgtatactttttgggctttaaaccatgcgaatatattgcctattcaaaaaattaaattgtatgtattgaagatttattatctcaactgtataaaaactaaccagagacaacaagcttgaaggagcaatttgaaatattattacaattggttacctctgaagttgaggtgggaacatgggtgggctttttttttgttttttaattgagacagggtctccctatgttgcccaggctagtctcaaactcatgggcagcacaagcagtcttcctgcctcagcctcccaaagtgctgggattacaggcgtgagctgctgtgcccaggtgctatgcgatgttttctttctttctttttttttttttgtatgtgactagttatgagcatatataacttttgttttatataactctatttgtttttttacattaggacacaaaatcttctcagtatttaggtagttacgtactactttaatggtttcactgtagcacctctttggcccttgctttgctttcttttttgagacagagtctcactctctctcccaggctggagtgcagtggtgtgatcttggctcactgcaacctccatctgctgggttcaagcaattttccagcctcagcctcccgaggagctgtgattacaggcatccgccaccacacctggctaatttttgtatttttagtagagttggggttttcaccatgttggccagactggtctcgaactcctgacctcaagtgatccagccacctcagcctcccaaagtgctgggattacaggcgtgagccaccatgcctggcctggcccttgcttttttgatacagctgttccactttccatggcctttcttttcacctttcttgctcacttatcataaaccacatacattactcatttcttgtttttcaccttcagtctcttttgccctacactcacggcaacctctgcctcctgggttcaagcaattctccttcctcagcctcccgagtagctggaattataggcatgcatcaccacacccagctaatttttgtatttttaatagacagggtttcaccgttttggccaggctggtctcaaactcctgagctcaagtgatccacctgcctcggccttccaaagttctgggattataggcatgagccaccacgcctgatgatcttttgccctatactttctattagcccctaatccaagttgtttttagcctacaagttcacaggcccaattaataaacgagttgcagccattggacaagatgccattctgccaaccagataaatgacctaagctttattctgtatctaaaaacagggatgggcctcatgctggcttatagatctgcattttaggccaaaagtagtgtttgaaccttgaagtcctctgcatacttaaagggaacttttggctggcctggcgcggtggctcatgctgtaatcccagcactttgggaggccagtgtgggaggatcccttgaactcagtagttccagaccagcctgagcaacatagtgagacctcatctctataaaagattttttaaattagccaggtatggtagtgcaggcctgtagtcctagctacttgagcccaaaagatggaggatggcttgagcccagaagattgaaggctgcagtaagtattaattgcaccactgcactccagcctgggcgacagagtgagaccctgtttttttttttaaaaaaaggtggcttttggcttgattatagtgctaacttgactgtactgtaaaatatttaattgattttaattgattttctgggtttagggagaacattcagtgatgttaaagccccatagtactactccacttcattaacattgcagaaccctctatatttaatataagaaatgatactgcaaagtagacatccctgattaagtaacttgagataactgatcacttttgcatgtatttcactagtgtgtgctgagtagaaactaattaacactgtcttaaactttattatgttgttttcacaaagagcagcctttgttgactttgaaatcattgcttcagtattctagaaaatcttgtttttgttaaacatgggcagtaacttactatttttgtatagttgttgtcatcttacccccaccctgttttaaaaataaaaagtagttgtcagattactttggctttagaagtaccttttcacttgccttagaatcttcattactttgagcctacactccacctcttattggaacttcatgaagaatgatgttggatttcactctgtcacccaggctagagcacagtggtctgatcatggcttactgtacccttgacctcctgggttcaaacagtcctcccacctcagcctcccaggtagctgggactaggcatgtgccaccacacccagctagtttttttacttttttgtagagacagggtcttactatgtttcgcaggctgatctcaaactcttgggctcaacgatcctcccgcctcagcctcccaaattgttgggattacaggcatgagcaccactgtgcccagcccataaccatttcttttttttttttttttttgagatggagtctgttgcctcagcctcccgagtagctgggattacaggcacctgccaccacacccgaataatttttgtattgttagtaaagacggggtttcaccatgttggccaggctggtctcaaactcctgacctcagatgatccacccgcctcggcctcccagagtgttgggattacaggcgtgagccactacacccggccccccataaccatttcttatgtgaatctattctcctgccagaccaaactagttgccagtgccccaaacacgttgaataacttcacacctttatacatgctgtccttcttccaaacagactgtctttattcagtgtggtaggctcctactccttcaagatccagttcaaagcaaggcatggtggtgtgtgctatagtcccatctactagggagtctgagagaggaggactgtttgagcccaggagttcaaggcccattctggtaacatagcaagaccatctcaactccagctcagatactttctgtgatgccttcctaactctattctcactccaggaaaatgatttcttcttcattcctaccacagtacttcactaattagagctcttgacatttaacattgtagttacttatatataagtttgccctattcgtttgtctttttttttctttctttgagttggaagttttgctctgctgcccaggctggagtgcaatgacacaatcttggcttactgcaacctctgcctcctgggttcagttgattctcctgcctcagcctcctgaatagctgggattacaggcgcttgctaccatgcctggataatttttgtatttttagtagagacaaggttttaccatgttagacaggctggtctcgaactcttgacctcaggtgatccacctgcctcagcctcccaaagtgctgagattacaggtgtgagacactgcgcccggcttttatttgtcttattcatataacaacgtacttggcacatagtaggctatcaaacatgtattggaaaaagaaatcacttgtttctgtttaagcatccagataatctagatctcaataataaactaaaacaggaagacgagggaaagaagataagaaaggttagaaatcaccaaccctgggccgggcacggtggctcacgcctgtaatcccagcactttgggggctgaggcgggcagatcacgaggtcaggagatcgagaccatcctggctaacacggtgaaaccccgtctccactaaaaaatacaaaaaattagtcgggcgtggtggcaggcgtctagtcccagatactcaggaggctgaggcaggagaatggcgtgaacccgggaggcagaggctgcagcgagccaagatcatgccactgcactccagcctggtctgtgagaccctgtctcaaatcaccaactctggccaggcgcagtgattcatgccatttatcctagcacttcgggagaccaaggcgggctgattgcttgagcccaggagttcaagaccagcctgggcaacatagtgagaccctgtctcaatttaaaaaagagagagaaagaaaaaaagaaattactaactcttctttctatctgttcatgccaacttcatcactttgtactcttctttcaccttgcaggtggtgaggatccaggaaagccaagcgatgccatgttaaagaatggccataccacccccatagggaatgccagatcatctagtccagtccaagtagaggaagagccagtaagattagcaagtcttaggaaagctattccagaagaggacctaaagaaacgactaggtaagaaactctggatttttgagtttaagagccacgggccagttattctccttacataaggggtttgcaagagaacagggaaaagtgaaatctagagagaattacattctcctttaacaataccttaactagcaacttcaaggggaatttcctcccccaccccgcttttattcactaaatacctaaatttgtgatcctcaagaagggaagaggatgttaagtatcagatacctataggattttttccagctacacattccacttctttcacccaaggaattttgttgtggctctcctccagtagcctggcccttgtgtgaagaatcactaccacaatgagcatctcttagtgagcctttcttactgacatttcttaagtatggggaggttgggaggcattgagaatggtaacctataagctaatctataaattaattggtgaaattggccacaaattcatagatgtgttagctttttcagtttctcttgttactctctcttccctttttataccatacatgttattacacaggctcaactggaagccagcctaattctgaagcagagtctgttcctgagaatgtacccaaaccacctttacttcctcccaaaagacccttgtcctcttctcatgaagcaagtgaagggcaagcaaaggatgccacttcctctggcggcacggcaaggttcatcatctccacctccatcaccacagcacccgctgccaccactgctgccacaagccttgcaaagactgttaatctctctgtcaccccttccccagcacccaggactctgcctgctgctcctgccagcactaacactactgctaccccaagcctcactcatatggtccctgccaagcagccccctatccctccccctaaaccagctcacagaaatagcaaccctgtcattggtaagtaagtctttaggcttccagtgttttgggtttggtttgatgttggatggttattttatttgataactggtacaacattgatttggtctgtgagaattttccatatcttgtccctttgaatgacctcaatatggagaaaagtcttaggttaagaaaaaataggccaggtgcggtggctcacgcctgtaatcccagcactttgggaggccgaggtgggtggatcacaaggtcaggagattgagaccatcctggcaacatggtgaaaccccatctctactaaaaatacaaaaaattagccaggcgtggtggcacgtgcctgtagtcccagctacttgggaggctgaggcaagagaattgcttgaacccaggaggcggaggttgcagtgagccaagattgtgccaatgcaccccagcctaggcgacagagagagactccgtctcaaaaaaacaaaaacaaacaaacaaaaaaagtcatgaaactgaggcagatggccataaatgtaaacatcactaagattagatttaagttttgggggttttaacctattttttaatctaatatttaatctgtttttctaaaacaatgattccaaaacactatacatatttgtgtgtgtgtgtgtgtgtgtgtgtgtgtgtgtgtgtgtaattggactggatatgtgaaaaccataacagattccacctgcatggaattatctgtggcacttgctgaaaaattagaataatgcctcagctcacaaggggcaaggcaaacttttcaaatgaaaatttttaaatctacttaaaactacctatgccttccataagcattaatgagtctagtagataaaaggatgattctgtagatgccagtggaatttgggattcagtgtctggcatagttatcttcacagggaactgcagaagctattacttaaattgttctgataaaatcatgttttatcttgggagaattaagaatgctattcttatgttaaaataagtgatggtagagaaagcagggaatataatcagtaaaatttgtatgggtttagtaaattttttgcatttacccaaagttctatttaagtctactttctttatataaatgcacaatttcttagaagaattttcaagaaagggagaggaaagctaatgagtgcttcaaagctaataaaaatatagttttttcaggaaaaatgatactaggcttagtattgcttaaagttcttgttcacgattgaacgaatgaataaaaactatactcattaaatatttaatatcaccatgttgggtggagtgattcaaaccttgaaaaacaggcttagaatattttatgagtatgacagtttggagtagcttgatgaaaacaggatgaagttgttattaccaccactttggatggatagtgtcatgttgacttatctgtgaggaacttggggagctttcacatacttattttcaaaactaccttgtgctgcaggaaaccaattttatcttttccataggtagggcaattagaacatgaagacattgtgactcattcaaggttgtaggccaggcgcagtggctcatgcctgtaatcccagcactttgggaggcagaggcgggtggatcacctgaggtcaggagttcaagaccagcctggccaacatggtgaaacgccatctctactaaaaatacaaaaaattagccgggcatggtggtaggcacctgtaatcccagctactcgggaggctgaagcaggagaattgcttgcacgtgggaagcagacgttgcagtgagctgagattgtgccactgcattgcagcctgagcaacaagagcaaaactccatctcaaaaaaaaagaagaaggttgtagttagtgaaagatagaaactgaacataggcttttcaactctcaggtccagacctctgttccttacagtagtgtttgcaaactggtgttctcctcaggatcacctagaaagcttatgataacagactgctggacactacccgtagagtttctgattttagtaagcctgggatgggcttgagaatttgcctttctaataggttcccagatgacactgatgctgctctccagggagcacacattaagagcctctgctctacaccagtggcataccacccttttcaagttaaggcaacatataaaatgataatttgtgtatgataccctggactaaactgcagagctcattcttagcttgaggtaaatagcccaaaacaatagaccttgtaactgaggaatcagtattagtccatgaggggtcctcaacaaaagaagaaaaatagaacagttcacagagcatttcttagagctaaatagatttaatttaaaggactctcttttattctaaaattacaaccttcctaatcctttggtgttaaaatgccatttctttcacaaaaggattatgatcataaatggtttacttaatatcaagccttatttggaaatcttagaaaatgacaacctcaaaaaaacactagaaaaaaaaccaacaatctgaggttgatcaagatttttgttattgttttggtcactgaaatccaaaagtttggaaatcattgcttcagaagtactactgtcttctcatccatataacatggagtattacgactaaggaaaaaccaccagcaatagctgaacgggtgaaagggaattattacccatcccagaaacactctgaaatttttccacagaactacagccagatgctgttgtcagggtatatataccagaatttacttccttaacatatatgccttcctcaaattaccaaatagaatttattttattaattcaaaagtaaaaatattcatttatggtctcatcaggaatgagttttgttgtagatggaatagctaacagctatttttagagaatcagcaaaaatccaatctttccaaaaatatctctttcactgctcctaaaattcacatttttagaatctttttgtgtgtgtatgcagtgtttttctagaaagccttttttaaaatttatttatggggccaggcatggtggctcatgcctgtaatcccagcacttcgggaggccgaggtgggcagatcgcttgaggcccagagtttgagaccagcctgggcaacatggtgaaaccccatctctactaaaaatacaaaaaatgatctgggtatgatggtgcatgcctataatcccagctactcaggaggctgaggcaggagagaatcacttgaacccgggaagtggcggttgcagtgagccaaaattgcaccactgtactccaacctaggcaacagagcgagactctgtctcaaaaaaaaaaaaattatttatgatgagagacattaaaacattacaaaattaggccaggcacagtggctcaatgcctataatcccagcatttggggaggccgaggtgggaagatcacttgaggccaggagttcaagaccagcctgagcaacgtagcaagaccccatctctataaaatatttaaaaattagctgggcatggtgacatgtgcctgtaattctagctacttgggagattgaggtaagaggattgggtaagcacaggagttcaaggctgcagtgagttatgattgcaccactgcactctagcctgggtaacagagcaacatcctgtctctaaaaaaaaagaaaaggctaggtacagtggctcacacctgtagtaccaacactttgggaggctgaggcaggtagattacctgagcccaggagtttgagaccagcctaggcaacatggagaaacccatctctacaaaaaataccccccccaaaaattagccgggcatggtggcacatgcctatggtcccagctacttgggaggctgaggtgggaggatcacctgagcccagggaggtcaaaattgcagtgagccgtgactgcgccactgcactccagtgacacagtgtgagaccctgtctaaaataaattaatttaatttaaaaataaaaataaatttaaaaagaaaagaggctgggtgtggtggctcacatccataatcccagcactttgggaggctgagataggtgtatcactggagcccaggacctcaagaccagcctgggcagcatagtgagaccttgtctctactaaaaattaaaaaaattagtcaggcatgggggcatgggcctgtagtcctagctacttgggaggctgtagcaagaggatcacttgaacccaggagatcgaggctgcagtgagctattgttcatgccactgcactccagtctgggcaacagagggagaccttgtctcaaaagaaaaaaaaaaaaagaattataaaattagctagccttggccgggcaaagcggacatgcctgtaatcccagcactttgggaggccgaggcgggtggatcacctgaggtcgggagttcaagaccagcctgaccaacatggagaaaccccatctctactaaaaatacaaaaaattagccgggcgtggtggcacatgcctgtaatcccagctactcaggaggctgaggtaggagaatcacttgaacccaggaggtggaggttgcagttagccgagatggcgccattgcactccagcctgggcaacgagtgaaactccatctcaaaaaagaaaaaaataattagctagccttttactttgaacatctccaattttggagatttaggacaaatacagttttatttaagggaagtttttgagagtgtttgagaatactgagtgggatgaaactaaagggtttgagtagaaggttagaggttggtgatcaaaagaactactttttttttttttttcctgtcagcagggaaaaaataactaccctttaattactttaccagttttactcctgtgtgatctgatgatccacttcttacaggtcatctggagccctccaaagggactttgctgaaacaacaccaacacctttgctgagtcattgtgggctttggtgaaactataggaatatatactgtcatgatacagggtgaaggcttctcatctaataaacatatattgagggtccactagatgccaggtactgtgcacagccctgtggatgatatgttgatggagacaaggttgccctgccatcaaggagcccatgatatagtggagagtgaacatgggaagctgaggtgcaaagggaacataagaggtgtgcataccaataaaaattagagacagtaggccgggcgcggtggctcacgactgtaatcccagcactttgggaggccgaggcgggcggatcacgaggtcaggagattgagaccatcctggctaacatgatgaaaccccgtctttactaaaaatacacaaaaaattagccgggagtggtggtgggcgcctgtagtcccagctacttgggaggctgaggcaggcgaatggtgtgaacccgggaggcagagcttgcagtgagccgagatggcaccactgcactccagcctgggcgacaagactccgtctcaaaaaaaaaaaaaaattagagacagtaggatgcagtcaaatagtcagagacttggataccagctgagtccatgccagtttgtagtatgatcttgggcaaagtcacctagcttctgtggccttgccttttccttctgaaaaatggtaaagatgctatattttttcccctgtcacctcaggtggtataaggagaatatgacttcaaggacaaaaaacactttgatttcttcaaaggactttgcaattgctataaaaattcaagatgtcagtattgacagttttataacacagagctaagatatctagataccattatcaggatatggtaacaatacccactaatacttattttatgctatctgaatgtttaaattttttaatggagtactgttatacaaaataacttttttttttttgagtcagagtcttgtgctgtccagcctggagtgcagtggcatgaccttgactcactgcagcctccgcctcccaggttcaagagattctcgtgcctcagcctctcctgagtagctgggattataggtgcccaccaccacacctagctaatttttgtaattttttttttttttttttagtagagacggggtttcaccatgttggccaggctggtctcgaactcctgacctcaagtaatctgcccacctcggcctcccaaagtattgggattacaggtgtgagccaccgtgccagccacaagataactttttatcagattttttttgtctctattcatattaactacaccaagatcaagttacaaaaagttgtcagccgggtgccatggctcacgcctgtaatcccaacactttgagaggccaaggcaggtggatcatttgaggtcaggagttcgagaccagcctggccaacatggtgaaagcccgcctctactaaaaatacaaaaattagccgggccgtagtggcgtgcgcctgtaatctcagctacttggtagactgaggcaggagtatcgcttgagcccgggaggcagaggttgcggtaagccaagatcgcgccactgcactccagtctgggcgagagagtgagaccctgtctcaaaaaaaaaaaaaaaaaaaaaattgtcatatctgttgccatagcaatgaagtaagctactcatcagtcttcctacacctctgtacatttattaagccttctatttgaataaatataaacttcatttcaggataaaatatatagggaatggcaaaactatgaaattatttaacttgcttaaaagattaaaactgaactcaactttaattctaggccctgggccggcccttcaaagcattggaaagtcgtgaaattgatgtgttgctctctcttttccagctgaactgtcccaagcaataaacagtggtacattgttatcaaaaccgtccccacccttaccacctaagagaggcattccatcaacctcagtacccaccttggagtctgctgctgccatcaccacaaaaacaccaagtgatgaaagagagaagagcacgtgttctatgggctcggaactactaccaatgatctcacctcgctctccgtcccccccactgcctactcatatacctccagagcctccacgcacccctccattccctgctaagacttttcaagttgtgccagaaattgagtttccaccatccttagatctacaccaggagattccccagcaggaagatcagaaaaaggaagtccccaagaggatactggaccagaactttggggagccccatataccctctaggctgcctccactcccactgcatattcgaatccagcaggccctcaccagcccacttcccatgactcctattctggagggttctcacagagctcattcgttgctttttgaaaacagtgacagcttttctgaggacagcagtacgctgggtcggaccaggtctcttcccatcactattgaaatgctaaaagtgtaagtgcctttaaagcttgcctcttatttctcctttactctagatagccctgcttggaaaaaattacttataaaaagaaaatgtgggccgggcctagtggcccacacctgtaagcccagcactttgggaagctgaggcaaatggaccgatcacctgaggtcaggagttcaagaccagcctggccaatacagtaaaaccctgtctcgatgaaaataacaaaaattggccaggcgtggtggcacatacctgtaatcccagctactcgggaggctgaggcaggagaatcgctttaacagggaggtggaggttgcagtgagccaagactgtgccactgtactccagcctgggcgacaaagcgagtctctgtctcacagaaaaaaagaaaatgtgaataatttttttttttccgagatggagtcctgctctgtcacccgggctggagtgcagtggcacgatctccgctcactgtaacctctgccgcccaggttcaagcgattctcctgcctcagcctcccgagtagctgagactacaggcatgtgccaccacattcggctgatttttgtatttttagtggagatggggtttcaacatgttggccaggctggtctcgaactcctgacctcaggtgatccacctgcatcggtctcacaaagtgctgggattgcaagtgtgagccaccgcgcccagcattgtgaataaatttaaagtacaaagaatactctgccaaaagaataagttatagaatttggactctttctttttttaatcttaccttaaaactttatttttatttatttatttatttatttatgtttgagacaggttctcactctctcactcaagctggagtcagtggtgcagtcttggctcactgcaacctccatctcctgggctcaagcaattctccctcctcagcctcccgagtaactgtgactacaggcgcatgccatcacacccagctaatttttatattttttgttagagatgggattttgccatgttgcccaggctcaccctgaactcctgggctcaagcagtctgcctgcctcaacctcccagaatgctgggatcatgggtgtgagccactgcgcctggccaaattttgattttttactcttgtgattttttttttttcatggagatttttgtgatgacacaaaatttacaaaattatgtacatgaaaaattacaaccgctagttttatatactacagggaaggcattgtataatgttgtgcttaagagcattcaccttggagtgagatagccctgggttcaaattgcagcactaccactcttagcttatagtagtgttaagttactgaagccttctgctctttagttatatcatctctaaatgggaataatatttactctgtaggcttgtgagaatgacattagacaaattctggaaagcaccagtgcctaataagtggtaaagctgggatctgaacccttagattaatacctgctaaaaagtttcttagtaagattgttaaagttaagggagagaattaattataagttacttcatccatagatttttttgtatttatggttatttcagtcctttgtcttttttttttttttgagatagaatctcactcttgtcacccaggctggaatgtagtggcacaatctcggttcacttcaacctctgcctcctgggttcaagagattctcctgcctcagcctctcaagtagctgggattacaggcacctgccaccatgccaggctaatttttgtatttttagtagacacagggtttcaccatgttggccaggctggtctcaaactcctgacctcaggtgaatttgcccacctccatctcccaaagtgctgggattacagccatgagccaccacgcccagtctttatttcagtcctttgtcttaaaagtcagttatcctcttcatttctaaaaggaaaatataattatgttaatttgttagtccagacgatgaagaagaagaggagcaaacctgtccatccacattcagtgaagaaatgacacctacctcagtcattcctaaattaccacagtgtctacgggaggaagaagagaaggagagcgactctgattcagaaggtcccattcagtaccgagatgaagaagatgaagatgaaagctatcagagtaagaaagggagggaaaagcaaaacagagaattcttttccagataaaactatttgctgatcttagcaagtgtcaaaagagatatggaaacaggtaccttctcccattaagtcatctggctaactgatgttggaagccactgtgaaggactccttgtccctattatcacccctctgttaaaacaagccaagacagggatccaagtagattgagtcactcaggttttaggttttttgtttttttttgttttaatttttttttttttttttggacaaggttttgatctgtcacccagctggagtacagtggtgcaatcgtcgctcactgtagcctccaactcctggacttaagtgatccttacgcctcaacctcccaaatagctaggacagatgtgtgccacaactggttaggtttctttgattttttgttttgttttttgtttttgtagagacagggtctcgttaggttgcctagcctgttctttttttttttttttgagacggagttttgctcttgttgcccaggctggagtgcaatggtgcgatctcggctcagtttaacctccacctcccaggttcaagcaattctcctgtctcagcctcccaagtagctgggattacaggcatgtgccaccacacctggctaattttgtatttttagtagagatggggcttcaccatgttggtcagactggtctcaaactcccgacctcaggtgatctgcctgcctcggcctcccaaagtgctgggattataggtgtcagccaccgtgcctggccataaaagatatatatataattttttttttttttttagacagagtcttgctctgtcatccagactggagtgcaggggcacgatctcaactcactgcaacctccacctcccgggttcaagcaattctcctgcctcagcctcccaagtagctgggattacaggcgtctgccactaggcccagctaatttttttttatttttagtagaggcggcgcttcactgtgttggccaggctggtctcgaactcgacctcgtgatccgcccacctcccacagtgctgagattataggtgtgagccactgtgcccagctgcccaggctgttattgaactcctgacctcatgtgatccccctgccttgacctcccaaagctctaggattacaggcatgagccaccgtgcctagcctatttttaatttttatagatatataatagtaatatatatttatggggtacatgagatattttgatataagcatgtgtgtatgggtaattaggctatccatctcaagcacttatcatttgtttgtattgggattattccaaatctacctttctggttatcttgaaatatacaatgaattattgttaactatagtcaccctattgtgccaccgaacactagatcttattcctttttttttgagacagtgtctcactctgcaggctagagtgcagtggcacaatctcagctcaatggaacctccacttcctggctcaagcaatgctccaacctcagcctcccaagtagctgagaacacaggtgtgagccaccacgcccagctcatttttgtatttttttatagagacagcgtttcaccatgttgcccaggctggtctcgaacttgtgagctcaaagtgatctgcccacctcagctcccaaagtgctgcgattacaggcatgagccaccacgcccggcctagatcttatttcttctatctaattctgtttttatacccattaaccagtctctctctcccccatcccctctacccttccctgcctctggtaaccaccattttatttattacctccatgagatcaacttttttagctcccacgtaagagtgagaacatacaacatttatctttctgtgcctggcttatttcacttaacgtaattgtcctccagttccatccattttgttgcacataacaggatttctttctttttcatggcagaataatcttcaattgtgtatatacaccacgttttctttatcccttcatttattgatggacatttagtctgattccatatcttggggattataaatagtactgcaataagcatgactgattgatttgctgatttcctttcttttggatatgtacccaacagtgggattgctggatcgtatggtagttctattttttttttaatagacggaggctcactctgtcaccaggcaggagtgcagaggcacgatctcagctcactgtaacctccgcctcccaggttcaagcgattctcctgcctcagcctcccaagtagctgggattacaggtgtgtatcaccatgcccagctcattttagtttttgtttttgtttttgtttttgtttttttagtggagacagggtttcaccatattggctgggatggtcttgatctcttgacctcatgatccacctgccttggcctcccaaagtgctgggattacaggcatgagccaccgtgactggcccggtagttctatttttaagggtgttttgtttgttttgttttgttttttaagtagagacacagtcttgctgtgttgctcagactgatctgaaactcccagcctcaagcaatcctcctgccttggcctcccaatgtgctgcattacaagcatgagccacctcatttggcctattttcagttttttaaggaacctccatagtgttttccacaatggctgtactaatttcaggtttttgtttgcccccaattttaaaactattcacctaagtgcctctaatcccagcactttgggaggccgaggccggtgaggtcaggagcttgagaccagcctggccaacatggtgaaaccccatctcttctaaagatagaaaaaattagccaggcatggctggccacggtggctcacacctataatcccaacactttgggaggccgaggcaggcggatcacctgaggtcaggagttcgagatcagcctggccaatgtggtgaaaccccatctctactaaaaataaaaaattggctgagcatggtagcaggcgcctgtaatcccagctactcaggaggctgaggcaggagaattgcttgaacccaggagacggaagtcgcagtgagccaagactgtgccactacactccagccggggtcacagagcgagactctgtcgcaaaaaaaaaaaaaaaaagccaggcatggtgacaggcacctgtaaccccagctactcaggaggctgaggcaggagaattgcttgagcctgggaggcggaggttgcagtgagccgagatcttgccactgcactgcaacctgggcaacagagcaagactccgcctcagaaaaaaaaaaaaaaaaagaggccaggcgtggtggctcacgcctataatccctgcactttgggaggccgaggtgggtggatcacctgaggtcaggagttcaaaccagcctggccaacataacgaaacccgaaacccggtgtctactaaaaatacaaaaaattagctgggcgtggtgacccacgcctataatctcagctactcaggaggctaaggcaggagaatcacttgaacctgggaggcggaggttgcaatgagctgaaatcgtgacactgcactccagcctgggcaacaagagcaaaagctctgtctcaaacaaacaaacaaacaaaaaaaccaacaacaatatggagtagaggaaaggtggcacatgggctaaggtgaaaagataaaagtgatgttttccctttggtctaatgaacttattgccacagggcagagaaaaataaacattttcataccctcacatctttgcaaataattgagtcctgattaattgaagtagaaaggcagctttaaaaacagatagactatgaggtgttagtatgaaagcctttatgttttaattcagagggctgtcccatgcttagattctctctcctgtagcaactcttaccaaggaggaaaaatgtagaggcctgatagaagagaaaagataccttttaaccatcttagtccacctggctaaaaagatttttaggtgtctttagctttacccccacctcagtgttcagctggatcatttgaggccaggtgggaactgggaattaaatattgtatttgttcagactcttgactagctccaggtaaggttgaacctttggctttaagcctcaagttctacatttttttcttccccgtgtgcaaaggtgctctcgccaacaaagtgaagaggaaagacacactggcaatgaagttgaaccacagacccagtgaaccagagttgaacctgaattcttggccttgtaaaagcaaggaggagtggaatgaaatacggcaccagattggaaacacactgatccggtaggcctttgcttagatttgcttgattgatttggttatgccagtatttgtgttagatgttgttagatgtgttgtttttttgtgtgtgttttgtttcgttttctgagacagggtcttgctctgtcacccaggctggagtagtggcgcgatctcggctcactgtaacctccacctcccaggttcgagcaattctcctgcatcagtctcctgagtagctggcgttataggcacctgccaccacgccaggctaatttttgtattcttagcaaagacagcgtttcgccatgttggccgggctggtctcgaactgctggcctcaagtgatcacccaccttggcctccacaagtgctgggattacaggcatgagcccctatacctagtctatatgtttactttgttgtggagtattcatttatcttttttagtgtgatttttttttcttttcagacagagtcttgatctgtcacccaggctggagtgcagtggttcaatcatggctcaccacctccaactcttgggttcaaggcaccctcccacctcagcctcttgactagctgggtcctcaggcatgcgccaccatgcactgctaatttttgtaattttttgtagagacagggtctctctgtgtttcccaggctggtctcaaactcatggcctcaaacattcctcccacgttgccctccgaaagtcctgggattataggtgtaagccaccacacccatcactttgagtataattttaaaaaatacatattgggttttgcatgaaaggagagaaggttagcactccacttgacaaggatggaagaggccctttgggcctgacaacacacatacaaggcattgccacctactacgtggcatctaactatctttacaaaaaaagaaaaagaaaagaaaagaggctgggtgcagtggctcatgcctgtaatcctagaacttcgggaggctgaggtaggcagatcatctgaggtcaggagttcaagaccagcctgaccaatatgatgaaaccccatctctactaaaaatacaaaaattagccaggcatggtggcatgcgcctatagtcccagctactcgggaggctgagatcggagaattgcttgaacccaagaggcagaggctgcagtgagctgagatcgcgccactgtactgcagcctgggcaacagagtgagactccatctaaaaaaaaaaaaaagaaaagaaaagaaacaaaaaaatatatattggacacagttgggtatcctctaagaatttggaaattgaagatgtagctgcctgtgagagttttattttatttattttatttttgagatggagcctcgctctgtcacccaggctggagtgcaatggtgcaatctcggcttactgcaacctctgcctcccgggttcaagtgcttctcctgcctcagcctcctgagtagctgggactacaagctcataccaccacacctggctaatttttgtatttttagtaaagatggggtttcaccatgttggccaggctggtctcgatctcctgactcaggtgatctgcccgccttcgactcacaaagtgctgggattacaggtgtgagccaccacacctggccagcctgtgagagctttaaaccatgagatagacatatggttttgcaaaagtttctacataaatcagaatggttcccagaacagaaaggctcctctgtcactttttttatctggttgcttaaccataagatgccaacccaattaacagtcacacccatatttgcattatatctgtttcatatgttccgtgtaactgcctcctttcaaagtgttggtatatttttcaagtcaactggaaccaaaagtatagagaaactgaatgcaagccagctttctgcatatgtaacagtgtaagaatccaggttgtatagatgggtttttgtttgacacagatgtttctcccagtaaagagaggataaggagctggaactcgtggcacagttccctacaaaataattaattgatcatgtctactaattaaaatttctttttctgtactattgcagatacctggttttggctgggcaaggtggctcacacctataatcccaacattttgggaggctcacttgaggtgggaggctcacttgagcccaggagtttcagagcaacccgggcaacaaagtgagatcccatctgtacaaaaaattaaaaaattagctgggcatggtggcacatacctctagtccagctattctggaagcttaggtagaaggatcacttgagcctgagagatcaaggccgcagtatgctgtaattgcaccactgcactccaccctgggtgacagagcaaaaccctgtctcaaaaaaaaaaaaaaagagacacctggctttactgtgtatgctgtacctcagggcaagttttccctttgtcttctaatagacactttttggatccagaaattgttctctgcaatttctttacttaaacataattatcagcctgtatgacctctgtggtctgactactttgaaattaagggagaaggctgggcacggtggctcactcctgtaatcccagcactttgggaggctgaggtgggcggatcacttgagcccaggagttcgaggcaacatgacaagaccctgtctcgacaaaaaaacaaaaaacttagccagacatggtgacacacgtttatggtcccagctactcaagaggctgaggcagggggattgcttgagcccaggaggggctcaaggtcggcccaggaggtcaagacccaggcgatcaaggcccaggaggtcaagactgcagtgagctgtgctcatgccccactgcactccagcccagtcatcagagcaaaaccttgtctcaaaaaaaagtaaagaaagacatgtttattatatggtagtttgaaaaattacaaaaaaaagagataaatcatggccggacgcggtggctcacgcctgtaatctcagcactttgggaggccgaggcgggtggatcatgaggtcaggagatcaaggccatcctggctaacacgatgaaaccccgtctctactaaaaatacaaaaaaattagctgggtgtggtgctgggcctgtagcccagctactcgggaggctgaggcaggagaatggcatgaacctgggaggtggagcttgcagtgagctgacatcgtgccactgcactccagcctgggtgacagagcaagactccgtctcaaaaaaaaaaaaaaaaaaaaagagagagataaatcagccataatcctataccctataagccaggatttggcaaacttcttctgtaaagaaccaaatagtaaatattttaggatagggtgcagtggctcatgcctataatctccgtactttgggaggccagtgtggaagaattgcttgaggccaggagtttgagaccagcctgggtaacatagtaagactctatcactacaaaaataaaaataggtcaggcacagtggctcacacctgtaatcccagcacgtttgaaggccgaggcaggtggatcacatgagatcaggagttccagaccagcctggccaacatggtgaaaccccatctactaaaaatacaaaaattagccaggcgtggtggcgcccacctgtaatcccagctactcaggacactgaggcaagagaatcacttgaacccaggaggcagaggtttcagtgagctgagatcacaccatggcactccagtctggacgacagagtaagactccatctcaaaaaataataaataaaatagccaggcatggtagcatgcccctgtagtcctagctacgtgggaggctgtggcagcagaactacttaagcccagtagtctatatactagacagggcataaatatagttatatttaatatatttaatatatgtgtgtatgtgtatatatatgtgtgtatgtgtatatatatgtgtgtatgtgtatatatgtgtgtatgtgtatatatatgtgtgtatgtaatatatatgtgtgtatgtaatatatatgtgtacgtgtgtgtatatatgtccatatatatatatggatttgatggccatataaactctctctttttttttttcctacctttaaaaatataaaaacatgggtcgggcgcagtggctcatgcctgtaatcccagcactttgggaggccgaggcgggtggatcacgaggtcaggagacagagaccatcctggctaacacggtgaaaccccatctctactaaaattacaaaaaatttagccgggtggtggcaggcacctgtagtcccagctactcgggaggctgaggcaggagaatcgcttgaacccaggggacagaggttgcagtgagctgagttcacaccactgcactccagcctgggcaacaagagcaaaagaaactccgtttcaaaagaaaatatagtttatacatacagtggaatattatttaatcttaaaaaagaaggaaatcctccaatatgctaacaacatagtcaaaccttgaggacattaatatgagtaagccagtcacagaacaataaatactgcatgattccacttctgcgaggtatctgaaatagtcacatttatagaagcagagagtagaaagatagttgtcaggggctcgggattgaaggcaggggtgatagggagttgctaataaataagtataaagttttagttatgcatgatgagtaagttctagagatccactgtacaacattgtgtttatagttaatactgtagactgggcgcggtggctcacgcctgtaatcccaacactttgggacaccgaggcaggcagatcacgaggtcaggaggtcaagaccagcctggccaacgtgatgaaaccccatctctactaaaaatacaaaaattagccgggtgttgtggcaggcacctgtaatcccagctagtcaggaggctgaggcaggagaattgcttgaacccgggaggcagaggtttcagtgagccgggatcccgtgccactgcactccagcctgggcaacagagtgagactctgtctcaatcaatcagtcaatagttaatactgtattggccaggtgtggtggctcatgcctataatcccaatactttgggaggccgaggcaggcgtatcacgaggtcaggagttccagaccagcctgaccaacatggtgaaaccccatctctactaaaaatacaaaaattagccgggtgtggtggcgcatgcctgtaatcccagctactcaggaggctgaggcaggagaatcgcttgaacctgggaggcagaggttgcaatgagccaagatcacgccactgcactccagcctgggcaacagagtgagactctccatctcaaaaaaaataataataatactgtattgtacacttaaaagtctgttcaaaaggtagatctcatagtaagtgttatcactataaaataagattgaaatttaaaaaaacacacacaataagagaccaccacgagtacactaggatggctaaagttatgcaatttaaaagactgacaaggccgggtgtggtggctcacccctgtaatcccagcactttgggaggccgaggcaggcagatcacctgaggttgggagttcgagaccagcctgatcaacatggagaaacttcatctctactaaaaatacaaaattagctgggcgtggtagcacatgcctgtaatcccagctacttgggaggctgaggcaggagaatcacttgaaccggggaggcagaggttacagtgagccaagatcgggccactgcactccagcttgggcaacagtgcaaaactctgtctcaaaaagaaaggaaaggaaataaatacaggagtgatatgttcattcttgcaattgtgatgatgatttcacaggtgatatatggcaaaagtggccaaattgtacatgttaagtatgtacacagttgtacatatttacagtattattgtgtcagttatatcgtattaaagctggtttgttttttgttttttgttttttgtttttccgaagaacatttaaaaaggaaggcccaggccaggcatggtggctcatgcctgtaatcccaacactttgggaggctgaggtaggaagatcacttaacgtctggagttcaagaccagcctgaccaacatgctgaaaccccatctctattaaaagttagctgggcctagtggtgcatgcctgtagtctcagctactcaggaggctgaggcagggcaatcacttgaacccaggaggctgaggttgcagtgagccaaggtggcgccagtgcactccagcctgggcgacagagtgagactctgtctcaaaaaaaaaaacaggaaggtccagctgggtgtggtggctaacatctctaattccagccctttgggaggctgagctgggggaatcacttgagcccaggaatttgagaccagcctgggcaatatggcaaaactccatcactaccaaaaataaaaaaattagccagcccagtctctaaataaataaatacatacatacatacatacgtactttttaaaaaataaaatggggcggggcacagtggctcacgcctgtaatcccagcactttgggaggccgaggcaggcggatcacaaggtcaggagattgagaccatcctggctaacacggtgaaacgccatctctactaaaactacaaaaacttagccgggcatggtggcacgcgcctatagtcccagctactcgggaggctgcggcaggagaatctcttgaacctgggaggcggaggttgcagtgagccgagatcaagccactgtattccagcctgggcggcagagcaagattctgcctaaaaaaaaataaaaataaaataaaaataaataaataaaatggaagatccttgaggtaggaggatcatttgagcctaggaggtggagctgcagtgagctgtgatcgcaccactgcactctagcctgggtacagagtgagaccctgacacacacacaaaaaaaaaaaaaaaaaaaggaaggtcttgttcagaaagaaaagttgtatatagaatgggactggaagttccttatgcaagcaacagaagagttgaaaattttgcaagtactagctaattagcccaaatactgtctgagaagtataaattaaaagtaagaaatgaataactttctgatttcaaaaatgacaaattgtagttttttgttgttttttttttttttttttttttttttgagatggaatctcactctgtcgcccaagcaggagtgcagtagcatgagcttcagctcactgcaacctccatctcccaggttcaagcattctcctgcctcagcctcccgagtagctgggactacaggagcacgccacaacatccggctaatttttgtatttttcagtagagacagggtttcaccatgttggccaggctggttttgagttcctgacctcaggtgatccacctgcttcagcttcccaaagtgctggggattacatgcatgagccaccacacctggccaacaaattgttattggtgaataacatctcagaactgtgatgaggtgagataactttatcaaatgcttcacagagaagactgagatttaaatcatagaattatagaatatcacacagaaagagacaaacttaaattccagtggttcctaaaccactgatttaaaaacctagctgggcatggccaggcgtggtggctcacgcctgtaatcccagcactttgggaggccgaggcaggcggatcacaaggtcaggagatcgagaccatcctggctaacacggtgaaaccccgtctctactaaaaatacaaaaaattagccaggcgtggtggcaggcgcctgtagtcccagctacttggaaggctgaggcaggagaatgtcatgaacccgggaggcggagcttgtagtgagccgagattgcaccactgcactccagcctaggtgacagagcaagactccatctcaaaaataacctagctggacataatggcttgcgcctataatcccagcagtttggggggccaaggcgggaagatagcttgagcccaggaggagttcaagactatcctgggcaacagagtgagaccctcatctctattttcaaaaaattgtaaaaaaaaaaaatctaaagaggggcatctgagtcatagaagaagttttgtgaaaaaaaaaatctatatatagatatatgtaatttcatttttcatcctgattttctgaatcagaatttctgttaacgtttcttgggaatctgtgttttctaaaaagtctctaatgcttctgaaggagcaaatttgtttaggagccaccagttcggtccaaaccttcgcttcacggatgaggacactcaaggtctaactgaacttttttgtgctaatagctcttatcaaggtctagaactagaatcctggccacttgtttgcatatacagttcctttttataatgtgatatctgtgttaacacttttaatgtgaaattgttttataaacaatcataaataaatgaaatatatcagtttgaaaatttgttgatttcttacttatataggggctaatatatactgtgaccaaaaaaatctttataaacaagattgggaggtttaacataaacattacctttatttatctcatttttaggcgactgagtcaaagaccaacaccagaagaactagaacaacgcaatatattgcaacgtgagtccagttatggaaataaagttgtatagattttctttgtatgtttctgactttaatatacataaaagaaaaaagaagcgtttgctacaagggctaagggagagtgttccagccaggcaaggactatttatttccccatgaaggaacagagcttaccaagcttcctttggaagatgctattatggtattgtttagtgtgctgtgatactctagaaagctttgtttcagtgttctcactgtatcctggaactgccttgggcatttgggaggctttgacagtatatgggagatgtgcccaatttttctgttttcagggagctaaggaggtagctgtgcatatggagaccttcctattcctagaatgtgagggctggggcccaaagcaagtcccaaatgcagcagcttttctcttggtttaatcccttaagactttcttacctctgtagttaccaaatgggaccatatatttaatttgctgtctgtgtacataattaatttcctgaaatagcattctaatctagtacatatttcatttgtttttccagaatatagagtgaaatttggccttaaaagtctcctcactgagaaggtttgggcttccttggggctatttgtgagcatgttcagtctgaccaatccatcccctgttctctcagcactacttgggtatacacaacttaataacttagtacattttctagtgtgggagcccttataacgtatcacacaaaactcagtgtgatcaccattgtccattcttagcagttactcttgagcaagaatctgcaggcttttccttaaagcatacatagtaaacattttgggttttgcaggccaaaaagcaaatgaacaactatacgtaataggtccttacaaaaccatttaaaaatgtgaagactattcttagttcatgggcaggaaaaatacaggcaactggcgagatgtggtgccatagtttgctgactcttgcttttaagtatttgtatcgttgacaagaaaattgttttgtttagccatccccaaagttagtattttattctgatttgggcctataagaaatatctgggccgaggcgagtggatcacaaggtcaggagatcgagaccatcctggctaacatggtgaaaccccgtctctactaaaaatacaaaaaaattagccgggcatggtggcgggcgcctgtagtcccagctactcgggaggctgaggcaggagaatggcgtgaacccgggaagcggagcttgcagtgagccgagattgcgccactgcactccagcatgggcgacaaagcaagactccatctcaaaaaaaaaaaagaaaaaaaaagaaatatctgggctgggcacggtggctcacgcctgtaatcccagcactttggaaggccgaggcgggtggatcacctgaggtcaggagtttgagaccagcctgaccaatatgatgaaactctgtctctactaaaaatacaaaaatcagctgtgcatggcatgtgcctgtaatcccagctactcgggaggctgagacaggagaatcgcttgaactcgggaggccgaggttgcagtgagccaagattgtaccattgcactccagcctgggcaacaagagcaaaactccgtctcaaaaaaaaaaaacaaaaaagaaatatctgtaatgtaattactaaaacgtttgatatgcaaattgtcatttgtgagtaatattccttccttctgattgtcaactgtagctaaaaatgaagctgatcgtcaggcagaaaaacgagaaattaaacgtcggctcactagaaaggtactactgcctgtgtgttcagttaactatatgtgttatatttggatggcctatttgattggaaatgaattcacagctgggcacagtggcttgcgcctgtaatcccagcactttggaaggccatggcaggaggattgcttgagcccaggagttcaagaccagcctggggaaaacagtgaaaccttgtgtctacattaaaaaaaaaaaaaagaagaagaaagaaaagaaaaagaaaaaaatgaatttgcagcctgggcaacatggcaagaccccacctctacaaaaaaaaatatatattagccaggcatggtggtatgcgcctgtaatatcagctacttgggaggctgaggtaggaggatcatttgagcttgggaggttgaggctgcagtgagctgtgattgtgccactgcactccagcctgggtgacagggcaagaccctgtctcaaaaaaaaaaacaaaacaaaaaaccacctgataaccataatcactgggggtgggacctccagggatcaatagtgtctaaagctcccccaggtgattccaatgaagattgaagcactgggttagaggcaatttgaatgcatgattgatgcctaattattggcttggtgaactaagaggctccgtttccttcagctcagtcaaaggccaactgtcgctgaactccttgccaggaagattctgaggtttaatgaatatgtagaggtaacagatgctcaagattatgaccggcgagccgacaaaccttggaccaaactgacccctgctgacaaggtacctggaaagcactctcttgctttttttctctttctctttttctctttatttggaggatccaagatactaactagaagggagaaccataaacaaaacttctagttttaatataatattaaatttcaaatcaagatacaaaatgccaagttgaacaagtcaaaatgttatactaactcagtatgttttggtaactccaccaccaatactgaaagaaagaaaatccctgctatctcacagagtaaaaatactggaaggaataaatacatttcaaacagtggttgtttggttagagggagtttgggctatatattttagtaattaccaatatttcatttttataatgctgtgaaaaactataaaagctggccaggcgtggtggcttatgcctgtaatcctagcactttgggaggccaatgcagagggatcactcgaggtaaggagttcgagaccagcctggccaacatggtgaaaccccatctctactaaaaatacaaaaattagctgggtgtgatggcatgcacctgtaataccagctacttggaaggctgaagcaggagaattgcttgaacctaggaggtggaggttgcagtgagccaagatcatgccaatgcactccagcctgggcagcagagtgagactccacctcaaaaataaaaataaaaaattaaaattaaaaaaaaaacaaaactagccaggtgcagtggctcacacctgtaatcccagcactttgggaggccgaagcaggtagatctcttgaggtcaggagttcaagaccagcctggccaacatggtgaaaccctgtctgtactaaaaatacaaaatagccggacgtggtagtgcgcacctgtaatcccagctattcgggaggctgaggcaggagaatcgcctgaacccaggagctgaaggttgcagtgagctgagattgcaccactgcactccagccccagcaacggagcgagattccatctcagggaaaaacaaaaataaaaacaaaactataaaagctacaatatatctttcaagattttcaagtattttgattaaactaaaaattttaggtttattatgagacagatgggtatcattgtgttgacctggtgtctgggttgcctgtgaggggttgcagtgacttacaaagttaaacacagtacagaaaaatgacaagttacactgctgtgcaaagcagccagaagaagctgaaacatttttgtctctactccacaggctgccataagaaaagaattaaatgaatttaaaagctccgagatggaggttcatgaagagagcaaacattttacacggtaagacccaaaagacccaatcatatatgtgctaggtagagttttccaaaaaattgttcagatatgaagggctctaatgacatcagtaaaaaggaaaacactcagtgttgattgcaagactgcattcaaagggatgaaaagtaagaagcaatagtaaatgcctaggccaggtgcggtggctcacgcctgtaatcccagtactttgggaggctgaggcaggtggatcacctgaggtcaggagtttgagaccagccggaccaacatggcaaaaccccatctctactaaaaatacaaaaattagctgggcctggtagcaggcgcctgtaatcccaactattagggaggatgatgcgggagaatcacttgaacccgggagatggaggttgtagtgagctgagatcatgccattgcactccagcctgggtgacaagagcaaaactccatctcaaaaaaaaaaaaaaaataagtaaatgtgtattctgattatggcatttcatgtatattatttaatccttgtaataaacatgcaagatgtgttaacatccccattttatcactgaggaaatggaggctcacaatggttaagtaacttggttgacttgctagtaaattgcagaaccaggattcggagaaagaaatcaatgacttcaaggatgtgaggtgctctcttccttgtaccttactctctcaggttataaatgaggagactgtgctaagttagacaagatcttgccctctctggttcagttctgtctagcacagttgatcttaccaacttaatgtataaacaacattttaattagctgtcttcatgaaacaagccaagaaatccaacaaagccaacaagccaacaaatcaagtgttttgatttggaattacggttgtgattaaggacccacccatatccaaagaatcagctagccacaaatggaatcagtgaaagtatctttacatgattcttagaacatttacaaaaagaggcaaatgaggctgagtgcagtggttcatgcctgtaatctcgacactttgagtggctgaggcgggaggatcgcttgagcacaggagtttgacaccagcctgagcaacatagtaagactccatccctacaaaaaaaaaaaaaatctattttttgatttaggcaggggcctggtgcagtggtacacacctgtaatcctagcactttgggaggccgaggtgggaggatcactttgagaccagcctgggaaacacggtgagccccatctctacaaaaaataaacttaaaaaaaaaataagcaaggtgcagccaggcgcagtggctcacacctgtaatcccagcactttgggaggctgaggcaggtggatcacttgaggccagttggagaccagcctggtcaacatggtgaaaccctgtctctactaaaaatacaaaaattagccgggcatggtggcatgcctgtagtcccagatacttgggaggctgaagcaggagaatcacttgaaccccggaagcagaggttgcagtgagccgagatcgcgcaactgcgctccaacctgggcaacagagcaagactgtctctcaaaaaaagaaaaagaaggaccagcttaagcaagacgatgggagagaggaaaacacatggtgtttctgggtaacagaaaatgtagctggatcagaggatgtttggggcagtgtggtgaaaataaactagaaaatgggttgcagtccctcgcaatgctttgactgttatgctaggatgttggaaccattggcagttcataagcaggaaattctgtgtatttcagaacaagctctgatgcaaacaacaaagatgatatggaaggatgaagagactagcagcaaggaaaacaggaagtatctgaaataatcttagtgagcatagtggtagctcacaccagagatagtgagaatgcaaaggtgatagatttgtaagacatttcaagcatagaatcaacaagatgtggcaatttgttggattccagagatgaaataaaggagtagtcaaaatgactctgatatttttaacttgtattttttgaggtctttgaaggtgataagtttagctgaacagtttagtttattcaacaaatactgagcacctaccacgataggtatagtgctaggtccttgggctacagcaggaaataagataaagtctctgtcctcaatgaggctttattctttttttttctttttttaatagagatggggtctcactatgtttcccaggctggtcttgaattcctggcctcaagtgatcctcccatcttggcctcccgaagtgttgggattacaagtgtgagccactatgcctggccaagcttttattctaaaagaagaaggcagacaatgaacaagctagaaaataaattgcatgtgtttagtttgaggagcctatgacacatggagatacctagaagaccattagatatgcagcctagaatccagaaagaaagcaaagtctcaagatacaaatgaaagaagatagtggacctttaggggggattttatttttatttatttattttttttttttttattttttgagacaaggtctcactctgtcacccaggctggagtgcagtggcatgatcgtggctcactgcagcctcaacctctcatgttcaagccatcctcccacctcagcctcctcagtagctgtgactacaggcacaggccaccacacctggctaactttttgatcatttgtagagacagggtctccgtatgttgcccaggctgctctcaaactcctggtctcaaatgatcttctcaccttggcctcccaaagtgttgggattgattacaggcatgagccaccgtgactggccaaggaaagttgttttttatttaaagggtagacagaggaaaatgaaccaggacagcatactgagaaagatcaattgaagaagagagaaaattatggaaaagatagtgttacagaagccaagagaagagttcttttttttttttttttttttttttgagacggagtctcgctgtgtcacccaggctggagtgcagtggcgcgatctcggctcactgcaaactccacctcccaggttcacgccattctcctgcctcagcctcgcgagtagctgggactacaggtgcgcgccaccacgcccagctaattttttgtatttttagtagagacagggtttcaccgtgttagccaggatggtctcaatctcctgacctcttgatccgcccgcctcggcctcccaaagtgctgggattacaggtgtgaaccattgcgcccagccgagaagagttttaagaaggaagcagatgaggagtatcagatgcaacagaaaggtcaggtcgaattagagcagaggaaaggcagtgttaattaggtataacatttcattactactgatacattaatagcaaagcaatgtacatcatgtggtaacttgtctcttttttaatctcttttagctaccatcgtccatgatgccaaaggttgagagaggaatcaacatggctgctttgctgcttccttctccaaagtgacatatggagggaactttagcacttcccagcacagccagaattgcatcctctgggatcttctgaggtggacagcactttgaatgtagcatttcactggaacagagtcttatgtgctgcaccgggggcaaaacaacactttgtcagtgcttttgaacctttcaatattgtagcatgcttgaggagtttttcccttactggccaccaaagttctgaaccacttgcaggttccaggttttactggctgcaccacaccccttcccctagatgactgcctgtgcagagacacagtttgcaccattagccttacctgccctgccctgattgtgagacccaaatgtgtaggctctaaattccagccatcaaatccaattcctggtggggaaaaccttctggagacccccaaccttctgataaaagagtctctacctccagggaaagccttcttaccacactggcatatcagatgaaagcattgcactgtacctctcgtaacacagcaatacagtcctcttgaggcactcaagcctgagaggaagctcaggatctgacatgttcttccttttcctcacaagtcatcatgattttttattttaaaataatctggaagtaatgggaacttagtttttcctgaactccaaccagaatccaaattggttagatgaggccaggcgcggtggctcacgcctgtaatcccagcactttgggaggccgaggtgggtggatcacctgaggtcaggagttcaagaccagcctggccaacatggtgaaaccccatctctactaaaaatacaaaaattagccaggtgtggtggcgcctggttgaggcatgagaatcgcttgaacccaggaggtggaggttgcagtgagccaagatcatgcctactgcactccagcctgggcaacaaagtgggactctgtcttaaaaaaaaaaaaaaaaaaaaaatcggttagatgagaaagcatgtatattttctatatacaaaaacaagaaaggcgttttgagcccctgtgctcaggcccactcccacactgtggagtgtactttcattttcaataaatccccttattccttccttgcaaaaaaaaaaaaaaaaaaagccttagccagattcagtggctcacgcctgtaatcccaacactttgggaggctgaggcgggtggatcacctgagttcaggagttcaagaccagcctggccaacatggcaaaaccctgtctctactaaaaagtaaaaaaaattagccgggcatggtggcttgtgccttgtagtcccagccactggggaggctgaggcgggagaattgcttgaacctgggaggtggagattgcagtgagccgagatcgcgccactgcactccagcctgggtgacagagcgagactccgtctcaaaaaaaaaaaaaaagccttaatattaatgctaacgtggcagaaaactagcaggttacattttataggctattgtagttttatttaccaaatgatattctctaaatcacttcgaccaataaatgtattctcctccttaaagcagagttgtatcaactctgtgggagcatttatgagctgtcagtccccacacttctagccagaatcacaataaggtctggctgggtgtggggtgctgcataggaaagggtctctggagaagcaagaagggcacaatcatggcccactgctcccctcttcttctcagtgctctttgccctctcctgctgcgtgcttcctcttcactccagtgctgatcctcctgctctctctggcagcttccacctcacccgcccctcttccacactataaccagtatggttggtgctggggcattgactcagcccccctgctttctgcatttgtaatagatattaatatgatttcctaaaacagaagattttgttgctttctttgaacttgtattgaaaaccatacagtctcactgttttgctttaattcctatccacactataaatggaagaaaaaaattaatagcttctgtttaatctgatgaatgtggctttttttcccttcactttaatgttcaagaagttgtggctatttcatagatttcttctgatttattctgtgggtccctgttatctgttctttatgtaatctttcagtagattttcatcctttcatatccacattcttatgtggacttgctgaagaaacagaatatcagttcaaaacaaaacctaggccaggcatggtggttcacgcctataatctcagcactttgggaagccaaggcggtcaggagtttgagaccagcctgaccaacatgatgaaaccctgtctctactaaaaatacaaaaattagcctggcgtggtggcacgcatctgtaatcccaactactcaggacgctgaggcaggagagtcgcttgaacccaggaggcggagattgcagtgagccaagattgcaccactgcactccagcctgggcaacagagcgagactccatcaaaaaaaaaaaaaaaaaagaaggaaggaaggaaagcaagccctgaatccacatctccttgaagttttttttgttttattttgtttttgagacagaattttgctcttgttgcccaggccggagtgcaatggtgcaatctcagctcactgcaacctccgcctcccgggttgaggcgattctcctacctcagcctcccaagtagctaggattacaggcatgagccaccacgcctggctaattttatatttctagtagagatgaggtttctccatgttggtcaggctggtctcaaactcccgacctcaggtgatccacccacctcagcctcccaaagtggtgggattacaggcatgagccaccgtgccgagccttccttgaagttttttgtttggttttgatttgttttgttttgttttgttttgttttgtttttggagatagggtctcactctgttacccatgctggagtgcagtggcacaatcttggctcagagcaacctctgcctcccaggctcaagcaatcctcccacttcagtctaagtagctgggactacaggcacgtgccaccaggcccagctaatttttgtgttttgttagagatgaggttttgccatattgcccaggctcgtcttgaacaccggggctcaaggaatctgcccatcttcgcctcccaaagttctgagatagcaggtgtgagtcatcatgcccagcctccttgaagtttactaacaattgggataactgagggaagagaagtgacaattccactcagtctattagaggtctggatataaggtagccacacaataactctaacttgacttctaaccattctatcttattgatttggaggctgtcttctgccagattttttgtggcttgagatgatattttcgaacccttctttcactacctttcttacccttaatgtgccaagcttgaaacaggatttgatttcctgagctacttgttcgccttctgtgcgtcaccaagtaatctggttcatctttcgtctcattcatgttattttcaagtgaaacaagacattttgggggtcaagtctctttgggtgttttgtttttatgtatataaaaatggattttgtgttccctttccatgtaagtaccaacttatatggaaactcacaatcataatgtaaagaagaaatgaaagcctggtgtattgtacttcaagatgcctccctgatgtatagaatctccttgtaaaataaataattgcattgtatatcagtcttcccatcaatattaattattaaatattttagaatttttaaataccaactata

SEQ ID NO: 189 - DNA, 62221 bp, Homo sapiens
attcctgtgtgaagagtgccagtgtgaagacagttttgtaagaactgcaagtgctcaggctgtatgggaaacagaaacttcagcagatgaactgaccttatgccatttcctgatgtttggcagtgacactgaaagaggaccgcatgtcccctctttatgtggatttatcttttatgaaaagtttgcttttgtccgggacagtttgttgtcgtgagatacatcagacaatataatcatgggacaagctgatgtctccagaccggtaaatccagatgcagttggtgagtaatagaaggcagagaaacagaaaatcttgacagaagcaaggcagatttacaggtgaacttgagtatttatgtgaagttaaacacgagaatgttgatgatcccaactttgaaatgtttatgtttgtgaagaatgaatgaagtcatgcggaacatggcgagaaactttaaaaaattaagttttttaaaacttaaaaacttaaattcagtttattaatttatcgctcacagttttgttttacttgatctctttgaagttttttatattatattgctaaggaattatctgttaatttcttgccgttactaaagataaatgctacagaaacttatttagaattcagagatattttgttagtattttacagaacttggaaaatagaactgttgacttctatagacagaaccacttttaagaattaagtttttagacttggttatacattttcctaataagtctcaggcattttccattgcactagtgtttccgtttctcttaagtcaacactttgatataaacttttctgaagttagtactttacatttgaaatgttactaagggatagctagagagcaagctgattgtgagtatagctcagagtttcaaatcttctatgtgaaatggtagtcacttgtcactgcaagctcattttcctaatcttgtagggttttatatgacaatcataaattgggaaaaacagttttaagcagatgttcattaaagggttgcttaagtataagcaaaactagggaaagcctgtgaatcatttctagacattataatatttaagaaagatttataccttcactttgatttatggagcagcagaaaacatgttcagtcctaggctgcattttttgttttttgtttttcagaaacaaaaaatgttggtgacttaaaaaaaaagcataaagtgtggaaacacaggtaacactcccaaatgtttcataatgtagtgagattttgtttctaaaggtagtattttcacctgagagcttcctagatgaaatatcttcagtatttttcatgtattattgaaactgaggcacatggatcacaaagtgagtcattcagcaacagattttcagaactgaagtcaggacttgactcactttaccttgatcactagggctgtgtctttatcaattcattaactcatttaaaaaaatgaaatgtttcataaatagaaaaaggtataaagaaaaatataaagaatcatctggggccactccccagcctaacagatgaaatttagaacataaagataaacctcacactatccttctcttctgcattcccttctgatgacattttgcttctttgtttccagaattaaacactctcctatatttgataaataactcacttttgggctgtaaattctcctgtggtttctacgccaaacattagttgtttgttagcaagtatagtaaggactcaatgctaggcatttatctatgagatggaaatgaaagggctttgacaaacaataaattgtaaagcaagtaaaatttagtggtgagtggtggtatttaagaagaatgcccatctaagatctatatactgtattaaaaacttcatctgaggccgggcgcggtggctcacgcctgtaatcccagcacgttgggaggccgaggcaggcggatcatgaggtcaggcgatcgagaccattctggctaacacggtgaaaccccgtctctactaaaaatacaaaaaaatcagctgggcgtggtggcgggcgcctgtagccccagctactcgggaggctgaggcaggagaatggcgtgaacccgggaggcggagcttgcagtgagccgagatcgtgccactgcactccagcctgggcgacagagcgaaactccgtctcaaaaagaaaaaaaaaaaaaaaaaaaagttcatctgagtaacgtttggtatttgtatgcttctgaaaaaaagtaagaatcaaattcatcaattctttttttttttttttttttgagacggagtcttactctgtcgcccaggctggagtgcagtggcttgatctcggctcactgaaagctccgcctcccgggttcacgccattctcctgcctcagcctcccgagtagctgaaattcatcaattctattcctaccagtagccctaataaaagacatttgaggaagaaatagaaatcaggagcttaactaagttttttatgtttcctctggatttaattttggggttttatttcctattacctagataataagtagttgactatcagcagttttcatggactgactccattattatgctatttataattcaggatgtattctgtttgagcagatcaggaccaggttatgaaggcttaactgaaaaccttgaggactataccaattccaataaaggttttcaccaaacaacagtttcttaatttaattttcaaagcctttatgtgggtagctgtttggaaaatctcaccattttacttggaatgataaatatacaaagtaaattaaaacctaaattatctgtttactattctaggcctataatacagcacttagttttgagctttgaaattaatagtactagatttagcaagtcaactgatgcaaaacacatgaatgaatatattgaattgatttattattactttcaggcactgtgaataacatagaggcccctatgtagatattattcatgtctatgccctcaagaagtttgtcttctagttgagaatttaaaatatgaaaaagtatccaaaatatttgtaaaatttttttaaagattaaggcatacttctttttttttaatttaattttattttttttttacttaaaaaatatttgtgtgtgtgaaaatggggtctcactgtcgtgaccaggctggtctcgaactctagcctcaattgatcctcccacctcgggctcccaaagtgctaggattacaggtgtgagccaccagtcctgcagttaaaaaaaggacccactcctttaagttaattgattcccttgacttgtaatggaaggccagcgctattaaccaaagagtctgctttcaaataaataacctttgcatgaggattcatatgcaaatttatgagatgttataaccatatccaaccagagtttctactgtaggatctttctaacaactggtgaactgagtatttgaatgtacattaggaatctatgctgtggtatccattcaaggaaataagttctcatcagttcattgaaaaaaattaaataaaatacgttcataggagaagcatgtagatttatctagataaaacattgcaatcagggcagagtgcattggttcgtgtctataatcccagcactttgggaggctgacgcaggagaatcacttgagtccaggagtttgggatcagcctgggcaacatagggcaacaccgtttctacaaaaataaaaatttagccactgtggtggtacttatctgtagtcccagctacttgggaagcttaggtgggaggatcgcttgagcctggtaggttgaggctgcagtgactcatgattgtacctctgcactccagcctgggtgtcagagggagacactgtctcaagaaaaagaaacacaaactttcaaatcctactttgtagttcttaatgaacataaaaactgtttttttgctcaccaaaattctttactatgtgtcatattaaaacaactagctaattatcacatatccttaaattaggcacaagaccgaagaattttttcaatttattttttattttttaaatgtatttttttggctgggcgcagtgtctcatgcctgtaatcccagcactttgggaggccaaggcgggtgaatcacgaggtcaggagatgagacaaccctggccaacatggtgaaaccctgtctctactaaaaatacaaaaattagctgagcatggtggcgcgtgcctgtagtcccagctactcaggaggctgagacaggagaatcgcttgaaacaaggaggcggaggatgcagtgagccgagatcgtgccactgcactccagcctggcgacagagtgagactctgtctcaaaaaaaaagaaaaaaaagtttttgtttgtttgtttgtgtatttatttatttacttttttttgagatgaagtctcactctgtcacccaagttggagtgcagtggcgtgatttcgactcactgcaacttctgctttccaggttcaagtgattctcctgtctcatcctcccgagtagctgggactacaggtgcccaccactaagcctggctaatttttgtatttttgtagagacggggtttcgccatgttggccaggttgctttcaaactcctgacctcaagtgatccgcctgccttggcttcccaaagtgctgggattacaagtgtgagccactgtgcctggcaaattttttttttaattgaaaataattgtacctgttcatgggctacataatggatatttccatatgtatgatgtgattagattagggtaattagcatattcatcatctccaacatgtatttatttatattgggaaggttgaaatcctcctcagctatttgaaactacatattattaactatagtcattctgcagtggcatagaacactagaactttttcctcttatctagctgtaattttgtattctttaacaaatctttccctacccatcccttcccattatctctcccagcctctagtagcctctgttgtactttttactcctatgagatcaacttttttttagcttctatgtatgagtgagaacatgtggtgttaaacttcctgttcctagcttatttaacttaaaataatgtccttagttccatccatgttgctgagaatgacaggatttcattgtctttctttctctctctctcttctttctttctttcgttctttcgtctcaactctgtcaccgaggctggagtgcagtggcgcgatctcggctcactgcaacctccacctcccaggttcaagcaattctcctgcctcagcctcccgagtagctgggactacgggtgcacactgtcatacccagctaattctttttttttttcttgagacagaatcccactctgtcacccaggctggagtacagtgacacaatcatagctcactgcagcttcagcctcctagattcaagcgatcctcccccctcagcctcctaagtagctgggactacaggcacatgccaccacacctggctagttttttttattttttgacgaaacgaggtctcactctctttccctggctggtctcaaactcctggacctggactcaagtgatcttcctgcctcagccttccaaagtgctgggattacagttgtgagctagtacacctggctcattcttttttatggctaaatagtattccattttgtatatataccacattttctttatccattcatctgttgttgaacacctaggttgattccatatcttggctgttgttgagtagtactacagtaaacatggaagtgcagatatctcttcagtataatgatttcctttcctttggatatattcccagtaatggtattgctggatcatatggtagcgctatttgtagtttttctttcttttgaggaccctccatactgttccccatagtggctatactagtttacattcccaccgacagtgtatagtgttccctttactctgtaccctcaccagcactggctactttttgtctttttgataatagcctcctaactggggtgagatgatacctcattgtggttttgatttgcattcacctgatgatttgttatgttgagcatttaaaaaaatatatttggcttttttttttttttttttttttttttttttgagacagagtcttgctctgtcgccaggctggaatgcagtggcgtgagcagtcttggctcactgcaacctccgactccctggttcaggctgttctcctgccccagcctcccgagtagctgggattacaggcacgtgccaccatgaccagctaatttttgtatttttaatacagacagggtttcaccatgttggccaggatggtcttgatctcctgaccttgtgatccgcccacttcagcctcccaaagtactgggactacaggcataagccacagcccttggcctatttgggcatttttatgtcttcttttgagaaatgtctcttcagatcatttggtctttcccatttttatattatttatttttttatttttattattattattttttgagacagagtctcgctgtgttggccaggctggagtgcagtggcgcgatctcggctcactgcaagctccacctcccgggttcacgccattctcctgcctcagcctcccaagtagctaggactacaggcgcctgccaccgcacccagctaattttttttttttttttttgtatttttagtagagacggggtttcaccgtgttagccaggatggtctcgatctcctgacctcgtgatccacttgcctcggcatcccaaagtgctgggattacaggtgtgagccactgcgcccagcctcccatttttatattatttaactatttatttatttattttatttttttgaggcagagtctttctctgttgcccaggcggagtgcagtggcacgatttcagctcactgcaacctccacctctcgggttcaagcaattctctgcctcagcctcctgagtagctgggattacaggcgcctgccagcatgcccgactaatttttgtattttaggtagagacggggtttcaccatcttggccaggctggtcctgaactcctgacctcatgatccacctgcctcagccccccaaagtgctgggattacaggcgtgagccacctcacctggccatatttaattattcttttttaagacagagtctcgctatgttgcccaggctggtcttgaactcctgggctcatgcgatcctcccactttggcctcccaaagtgctaggattacaaacataagtcactgcacccagcccttcctaattctaattagaaggaccaaagatttttaataaattctctccaaccatttggcttggaactttccttctctgtctttccattttacctctctttttttttcctttttgccccttcatttaccctaattcactaattaacttttccccccacttttcttttgcataataatatattgctataaaagatactgtatgttctctttcctacattccttttccataaccatttgatttattttctctgaaacttggagttatggggttctcacccttatgatactggaagcagttttggggaacgtgatttggaaatatatcatcccccatctctacaaaaaaaatgtaacaattagtcaggtgtggtggtgcacacctgcagtcccagctgttcaggaggctgagatgggaggatcacttgagcccaggaggttgaggctgcagtgagccatgatcatgtcactgcactgcagcctggctaacagagcgagactgtgtttgaaaaacaaaaaagaaaggaaaagaaatatattatcacttagaggcaaaatcctaaggagattgcaggatgaataaaatttaacatagctacataacaacaataaaactggagtaaataataggttaatttaaaataaagtacttcatgagattttggagaaaaaggcttagtagtatttggttatcagaattataaagacatttctcatacctgtctgctgtttatctaacagtaaatgctttcttttaaaaaaggagaaacaggcatactttcctcatgtaatccagtgttcaggaggaggtggcaatataggggtctgtcataaactccttaaaagattctctgttatcaaatttggactaccaaccaaaacttattgatccctctctctgctccagtggattttctaaataggccattaataaggtttggatctaggtccccaaccagatcccatgttaaattgtaatccccagtgttggaagtgggacctggtgggaggtgattggggtggatttctcacgaatggtttaacaccatccacttagtactgtcctcaagatagtaagttctcatgagatctggtcatttaaaagtgtgtggaggctgggtgcagtggctcatgcctgtaatcccagcactttgggaggccgaggcaggtggatcatgaggtcgggagttcaagaccagcctggccaacatggtgaaaccctgtctttactaaaactacaaaaattagccgggcatggtggcgtgtgcctgtagtcccagctattcaggaggctgaggcaggagaatcccttgaaccctggaggcggaggttgtcgtgagccaggattgcgccactgtactccagcctgggcaacagagtgaggctccatctcaaaaaaaaagaaaagtgtgtggcacctgcccccttgctctcttgctcctgttctgggccatgtgacgtgtctactcccccttcatcttccaccatgattgtaagttcctgcagcttcccccgaagccaggcagatactagcatcattcttcctatacagactgcagaaacatgagccaattaagcctcttttctttataaattacccagtctcaggtatttctttttatttatttatttatttatttatttagatagagtctcactttgttgcccaggctggagtccagtggtgcgatctcagctcactgcaacctctacctcctgggttcaaagtaattctcctgccttggcctcctgagtagctgggactacaggcgcgtgccaccaagcctggctactttttgtatttttagtagagacggggtttcgccgtattggccaggctggtcttgaactcctgacctcaggtgatcctcctgccttggcctcccaaagtgctgggattacaggtgtgagccactgtacctggcctcaggtaattctttatagcaatgcaagaatggactaatagacctattatcacaacctacatatgtatttcctctttcttttttcttttttttttttttgagacagtctcactctgtcgcccaggctggagtgcagtggcacgatctcgacttactacaacctctgcctcctggattcaggtgattctcctgcctcagcctcccaagtagctggcattacaggtgcccaccaccatgcctggctatgtatttcgtctttctacttgcaagtaaactttggaaagtttgaagttttttttccatgagtgaatagcttatattctggcccttcactataaaaacatacccttaacctggaattttttgtcagaacagtgtgcacattaagttgccagtggtaaagcaacttcacttcttgatacaatcataggcagaaaactatttttccagaggtagaatctcagacataactgtacctgcaagttcagagagagaccttccacctgactatcttctcctgacggctttaccgagttctttctaattcccaagggtcagatctatgcaatatttccacaggaagttgtgggccttctctatacaaagcctgctttgttcattagtggcaggtttattttctgtaattttgccgaagttttctgaaacagttgtttaaagccaataataatcctcttttagaaggcaaaaatgaataagtacagtagtgtaaataccataaatgaatgttctacgtttacaatgttctgatactgtgaaaaggttgtttatagcaaatctgtttccagctaggtgggcttaaaaacagactaaaccattatattatgaagatatttggtacttcttcacagtgaagtatgtataccttgttgaataaaatcatacattaaaattttggacaaataggctgggcacggtggctcatgcctgtaatcctagcactttgggaggtcgaagcggatagatcactgttggccaggctggctggaactcctgacctcaggtgatcacaccattgcactccagcctgggtgacagagcaagactttgtttcaaaaaaaaagaaaagaaaagaaaggaaaggaaaggggaaaggaaaaaggaaaggaaaggaaaggaaaggaaaggaaacctgataaggtggccgggcgctgtgtcttatgcctgtaatcccagcactgtgggaggccgaggagggcggatcatgaggtcaggagatcgagaccatcctggctaacacagtgaaatcccatctctacttaaaaaaaaaaaaaaaaaaaaaaattagctgggcatggtggtgggcgcctgtagtcccagctacttgggaggctgaggcaggagaatggcgtgaacccgggaggtggagcttgcagtgagccgagatcgtgccactgcactccagcctgggcgacagagcgagactccatctcaaaaaaaaaaaaaaaaaaaaaaaacctgataaggtgtaaaacatacagagagttcatacagatccaataactttgttacttattaccaagtcaagtaaagcggggggcgggggtggggggacaaggcatggtagctcacacactttgagaggctgaggcaggaggattgcttgagaccaggagttcgagaccagcctgggcaacatagcgaaacctgatctctactaaaaaaattagccagataaggtggtctgcacctgtagttctatcttctcagaggctgaggcaggaagattgcttgagcccaggagtccaaggttgcagtgagttatgatcatgccattgtattccaagctgggtgaaagagtgagacactgtctcaaaacaaaacaacaacaacaacaacaactggctgtgccaggtgcagtggtgcacccctagagccccagtgacttgagaggctgaagcagcaggattgcttgagaccaggagtttgaggctgcactgtgccatgatcgcgcccattaatagccactgtactctagcctgggtaacataccccatatctaaaaaataaaaatatatatgtataataaaataaataattggttgtaaatctaattctaaaattaacattatctttgacctagggcatattgtttaatcctgttttatctcatatctccatcaagttatgcaggtataatatgtatctatagcaaatagttaatgaatactttatccgaagatgaaaggtgctaagtggtttttataaatatcatacatttatttaaaaatcacagccaatggcccagtgctgtggctcacacctgtaatcccagcactttgggaggccaaagtgggtggatcacctgaggtcaggagtttgagaccagcctggccaacatggtgaaaccctgtctctactaaaaatacaaaagttagccaggcgtggtggtgggcacctgtaatcccagctacttgggaggctgagacaggagaatcccttgaacccaggaggcaggggttgcagtgagctgagatcgtgccattgccctccagccagggtgacagagtgacactctgtataaaaaaaaaaaaaatcacccctgaaattcatatgaaacaactacacttgcacttaaaaacttcaattaaatatttactaggaaaaatatggtggttgaagaaactactagaactctgcataattaatgatgtaagaaacaagcctatgatatgtgaggtgctacaacttgaatgagggagtaagtagtttaaataccaggcctggtttcagggtactactcaaacaggaaactccaaactgtaatttggttagttatcttccactcccagcctccaccccctccaaaaaacaccaagactgtcaactctgtgacgtgctttcctaatggcctgtagctacatgactcaaagaaaaaggtgttttctttggaacacacaattgtaaaactatacccagcatcctacaccctgatttctggcaaacaaaggaaaactacctttttttttttttttcactcatagaaaacagaatggggccataggccatttaaaatgccataactagtttaaacagaaacaacagtctatccaaatgtgactgcatgcctatatgttctctgtcaaattggaaattagagggagcattttataaaatcagatgctgagaacaaagatttatgtgcagaattggcgtatgaacagtttcaggcccatctttcttagtcctttattagtataaaacaaatttgggtgtacttatataattttttaaaaaacagtgatgatttctggatacctgagtatattttttgtttttgttttttttggttgtttgtttgtttgttttgaggcaggttctccctctgtcacccaggttgtagtacagtggtatgatcacagctcactgcaacctcaaccacctgagcttaagcagttccctcgccttagcctaccgagtatctgggactgcaggtgcatgccaccacgcccagccaattgttgtgtgtgtgtgtgtggttttcgttttgttttgtttttgagagggagtcttgctctgtggcccatgctggagtgcagtggagttgtctcagctcactgcagcctctgcctcccgggttcaagagattctcatgcctcagcctccccagtagctggaactacaggcatgtaccaccacacccagcttttttttttttttttttttgtatttttagtagaaacagggtttcatgttggccatgctggtctccaactcctgacctcaagtgacccgcccacctcggcctcccaaaatgctaggattataggcacgagccaccgcacccagcctaatttttgtatttttgtaaagatgatgtctcagtatgttgcccaggctggtcttgaactcctgggtttaagcaatccacccacctggccttccaatgtgctgggattacaggcgtgagccactgcatccagcctactctttgttctgtaatgtattcatctgtcagtttctctttgtttctattacagtttctaagcattgcaattgaatcctcctgtcaaacagaaattcatactaagaagcttgaagcttgaactattgtagcaggattttttttttttttaattttagatacagggtattgctgtgttgcccaggctggagtgcagtggctattcacaggtgcaatgatacatatcacaatacagcctcaactcctagactcaagcaatcttcctgcctcagcctcctgagtaactaggacaacaggtgcgcatcactgtgccctgcccagtgttattgtagcagttttagagataaatggcttaattagatctaatcagccactgctatgaagcacttatgcattaatttttttctttgagacagggtctcacttgttgcccaggctggagtgcagtggcacaatcacagctcactacagcctcaacctcctcagatcaaaggatcctcctgccccagcctcccaagtagctaagactataggcaagcaccacacttggctaattttttttttttgtagaggcagggtctccctatgttgctcaagctgatcttaaactcctgggctcaagtgatccccactacctcgacctcccagagtgctaggattaaaagcatgagccaccatgcctggcaaatttatgcattcttcaaaactctttattatacagctaaaacacttttacctggcatatttagatcttcattaaatttggtttctagctcctttagcacaatattttacttgtggcaaactaggagaatatacttaaaagaactcttagaatccagattacagttgacctttaaacaacacaggtttcaactgtgtgggttcttatgtgtggatgtttttcaataaatgtattgacagattgtttggagatttacaacaatttgaaaaaaaaaactcacaggcagaccagatgtggtggcttttgcctgtaatcccagcactttgggaatctgaggcaagaggattacttgaggccaggagttcaaggtcgacctgggcgacatagtgagaccccatctctacaaaaaattaaaaaattagccaggtgtggtggcacatgcctgttgtcccagctactcagacagctgaggtgggaggatcacttgatcccaccaggagttggaggctgcagtgagctctcatctcaccactgcactctagcctgggcaagagtgagatgctgtctcaaaaattttaaaaagaggctgggcacaatggctcatgcctgtaatcccagcactctgggaggccaaggtgggtagatcactttagatctggagttcaagaccagcctggccaacatgttgaaacctcatctctactaagattagctgggcgtggtggtacacgcctatagtcccagctactcaggaggctaaggcagaagaatcacttgaacctgggaggcggaggttgcagtgagccaagatcacaccactgcactccagcctgggagacagagtgagactccatctcaaaaaataaaaaatacaaacaaataataaaaataaaaataagtccgggcacagtggctcacgcctgtaatcccagcactttgggaggccaaggtgggtggatcacttgaggtcaggagctcgagaccagcctagccaacatggcgaaaccctatctctactaaaaatacaaaagttagccgggtgtggttttgcgtacctgtaatcccggctacttgggaggctgaggcaggagaatcgcttgaacccaggaggcagaggttgtggtgagccgagatcacgccattgcactccagcctgggcaacaagaatgaaactttgtctcaaaaaaataaataaataaaaataaaaatgaattaaattaactagcatatactgtactgctgtaatttcatagccacctcctattactattgaagtgagctcaagtattgccagtatccacttaaaatgctgtatgatgctaattttctagtgagcagttcttcatagcttagtgcaatatcataaatcttgaataacaccacgggacctacaacacgtgccactaatgatactggaattgctcttaagaagcagagaagagtcatgacattataagaaaaagttgaaaacgaaaaaaagagaaaacacaaggaaaagttgaatcgcctgatgtgatgcataccatagattgaggtctgtagctgcagttgcctgccatttttataagtatatatacataggtggtggctgggctggggaaatggcggcttcacgagagagtgggacttgggcagcagaggcagcacagtggatgcatttctgaccttctacagtgaggtgaaacaaatagagaagagagactcggttctaacatccaaaaatcagattgaaagatggacccgtcctggttcctcttacttcaatttgaacccatttgaggttcttcagttagatcctgaagttacagatgaagaaattaaaaaaagaggtttcagcagttatccacattggtgcgtcctgacaaaaatcatgatgctgacagagcacaaaaggcttttgaagctgtggacaaagcataaaagttgctactggatcaggaccaaaagaagaggaccctggatgtaattcaggcaggaaaagaatacatggaacacggccaggcacggtggcacacgcccgtaatcttagcactttggaaggccaaggtgggaggatcccttgagctcaggggtttgagaccagcctgggcaagatagcaagaccttgtctctattaaaaaaaaattttttttttaattagccaggtgtagtggcacacgcttttaatcccagctgctctggagactgaggccagaggattgattgaacccagaaagataaaaaagtccattcaaaaggaagatataataactctaaatttgtatatacctcataacagcttcaaagtatataaagcaaaaattaatagaactaagagagaaatcactttgtcttttttttttttttttttttttttgagacggagtctcgctctgtcgcccaggctggagtacagtggcgtgatctcggctctctgcaagctccacctcccgggttcacgccattctcctgcctcagcctccctagtagctgggactataggcacccgccactgcgcccggctaattttttgtatttttagtagagatggggtttcaccatggtctcgatctcctgacctcgtgatccgcccacctcggcctcccaaagtgctgggattacaggtgtgagccgccgcgcccggccatcactttcataattagagatgttaacatacctctctcagttactgatagagcaaacagacaacaaatcagaagggatcttaatgatttgtatatgattaaccaccttgacctaattggcatatttagaacaccatacccaacaattgcacaatacactttccaataacacataattggagataatgtattataaatttgggaagaaacaactgtaagcttctgttgtttatttgcaacttggaccatatttgagatatataggaaaagcattaaatataaatggcctaaacactccaattatcctaccacgttgggagactgaggtggaaggaccacttgaacccagcagtttgagaccagctcagctcactgtaacctccacctcccgcattcaagccattctcctgcctcagcctcccaagtagctgggattataggtgcctgccaccatactcagctaatttttttttgttgttgtatttttaatagagacagggtttcctcatgttggccaggctggtctcaacctcctgccctcaagtgatccacctgtctcggcctcccaaagtgttgggattacaggcatgagccaccgcatctggcctcatttttctttttctttttctttctttcttttttttttttttttttttgagacagagttttgctttcacccaggctggagtgcagtgatgtgatcttggctcactgcaacctccgcctcccaagttcaagattctcctgcctcagcctcccgagtagctgggattataggcgtgtaccaccacacccagctaatttttgtatttttagtagagacgaggtttcaccatgttggctaggctggtctcaaactcctgatctcaggtggtctgcctgcctcggcttcccaaagtgctgggattacaggcatgagtcaccatgcctggcccctaattcatttttcttcaacaaagaagcagcctatagccagaaaatgtctgcctctgtctcttttaacctccatgaggtttccagataataatctggtattgggtttaacacacctgactgaccttaggaccctaggctgacctggagagattttttaaaacagattctgaaagtcctacctcctggagattctgtattttgaaaaggcaattgggctgattccaagtatttggacagatttcggagtcttggaaataatgtactgtttgtcctggagagtaggaaaaagaggggaaggaaggagggagaatatgaggatatgaatatgtatgtgtgaatttgagataactgagtcagggccaggtgtggctctaccccaacacaggaggtaagaggaaagaaggacatctgcctctaaaagttttgtaaaagtgaaaatcaagcacatttgcatgagaagcaaagaaaatgttgctctgttttttgtattcagtggctttattttttttatacatattttgcttatgtatcaactattttttttttgagacaaggtccctgtattaagccattcttgcattgctataaagagatccctgggactggataatttataaagaaaagagctttatttgactcgtggttctgtaggctgtacaggaaacataatgcttgcaactgccctgcttctggggaggtctcaggaaacttacaatcatgaatcatgacagaaaaccaaccaggaataagcatgtcacgtgaccagagcaggaacaagagagcaaagagggagatgccacatacttttaaacgaccagatctcacgagaactcactcactattgctaaggcagcaccatatggatggtgctaaactattcatgagaaatccacccccatgatccagtcacctccaaccaggccccacttccagtactgaagattacaattcaacctgagatttgagcgggacacatatctaaactatatcagtatggctctgtcgcccaggctggagtgcagtggcacgatcacagctcattgcagcctggacctgctgagctcaagcgatcttcccacctcagcctcgcaagtagctgggactaggcacatggcaccctgcccaactaatttttttttttttttaagagacagggtttcttcatgttccccaggctggtctttctttacctaaaaaagaagagaagccagatgctgtagccagtgtctgtaatctgagacattctcataatttcaactatttgcctgtaatctcagctactcaggaggctgaggcagaggattgcttgagtcctggagttgaaggctcagtgagctgtgattgtgccactgcactccatgctgggcaacagaacgaaaccctgtctctaaaataactagataaatagatagagagacagatagatagatagatagatagatagatagataatcagattctagtgtatttcatgtaaagtgttaaagtaattgagacccagaatgtccttgtataagtcatgcaactaggaagagtcactgtcctcttgtcatttccatcttttgcactttagtaatgaggatgctattttgcctaagtcttctgggcatagcaaactaatgcatcagtagtcaccattgcatttactgtgataattacgattgtataaatctaacctttattgaaaaacttccctaaacctccatcaatcaagtgaaaaaaagattgaatttggcagttgtttcttttaaaaatttaatgctgttggttgtatattttctcttttgaaaatacctagttttaaaagagagagaggccaggtgtggtggtacacacctttaatcccagtgcttttgggaggccaagcagggaggatctcttgagaccaggcatttgagaccaccctgagcaatttggtgagaccctatctctacaaaacaaaattgtttttgtaattagccaggagtgatggtacatgcttatagtcctggctactcaggaggctgaggcaggaggatcatttgagatcgggaatttgaggctgcagtgagctgtgattacactactgcacttcatcctgggcaacagagtgagaccctgtttctaaaataataataataataataataaatttttttaaaaaagatgttttagtgactattatgacctttttaccctcctccaaaagtgttacttgcttcagatgtgaaattgtttacagtcaacatgttagcttatcatatgctgttccttgatgtatttctacaaagtagaggttccactttaatttcaggatggtttttccacatgactctttttttcttcctctctagacttctccagagaaccttggaacagtaggtggagtgcaaagctgcattgtgtaccttcctgcttttttttggttgccttcctgctggtttttttttttttcctttctttaaattcttggccccgccttggctctcctttctctgccattaaaactaactaactaaaccctgcatgcatggtcattatgaggggttcatggccttttatttcagttctgcacatgtatcatgtcagttatgttttatgtcaaatccttaatattatggtgtgtgtgtttgtgtgtgtgtgtgtgtgtgtgtgtgtgtgtgtgtgtgtgtgtgtgtgtttgagacaggctctcactctgttgcccaggctggagtgcagtatcttaatcacagccaactgcagcattgacctcccaggctcaagccatcttcccaactcagcctcctgagtagttgggactacaggtgcacaccaccatgcccagctaatttttgtttttgtattatttgtagagacagggtttcaccttactgccctggttgatctcaagctcctgagcttaagcgatctgcctgcctcagcctcccacagtgctgggattacagaaatgagccactgtgctcagcctatgattgtctctaaggcactactatggtaaacaaattggaatctcacctctactttctgaaaacatttccctccaatttaatgtacccgctttctaatgcttctgccccgcaaccctgagcactttccaatacctagggtccttttgtgaagggagaaaataatttgatgagcagatataagtaaggtactaacaatgtgttacctctccctgaactatttatatcctgaaaagggcagggaaagggcaatgtttaatagagaaaatgattcactcactaatgaggcaggaattccctgcctcagtaaggcaagatctcatgcatttgttaagatatccacattttgtatacatgcgcctttaaaagattttgagccggctctgatcatttcaccagattttgtcctaaaatgatgtcagcttggtttggttcctttttctccttagtagtttatctgttaatggattttgatgtttggtgtccatgtgatgtccaggagtctccctgtctgcatgattgtttatcgttgctccgatcctttccaactaccacaggaagagaggggaagggacattttagagattatgctgaaataatacatttgcttccttccctctcttcttttcatgtaacagaggaagcagaccagcccactacagagccaggcatggtcctggacagtgtggaagcaggagacacaacacctcctaccaaaaggaagagcaagttctcaggctttggcaagatcttcaagccctggaaatggaggaaaaaaaaaagtagtgataaatttaaagagacttcagaaggtgagatattaagggttaaatgtgtgttctgagttagaattctctatgttagatgtatttaatttttccttatcttcccaagtttctgtagtcctctatttgaagagggtatttaatgttttattctttccttcttctttttttttttttttttttttggtgagacaggatctccctctgttgcccaggctagagtacagtggcgcaatcacagttcactgcagattcaacctcctgggctcatgtaatcctcctgcctcagcctcccaagtagctggaagtacaagcatgagctactgtgcccagttaatttttaaattctttgtagagatggggtctccttatgtttcccaggctggtcttgaactcctgggctcaagcgatcctcccacctcagcctcccaaagtgctgggattacaagcatgagccactgtggctggccagagtttaatcttttagaattaaacatcaaaatggtcatgtactaaacctaatattgtataccctcattcccaggtttgtattttgatggcatataagtatctattgagtggtgaatggagttcctgaactgtcgcaaatctaagatgcttctttccatcagaacttggtgaagaaaatgactgaatgagttgatacatacataaataaaatgcttattttctactctgcccatccacacaaagttcatccgtaaataacttactaatgaaattttctcttaagttacaattatgtaaggctagttttttggaagtgatgctttcctgacagcacaggttataaaagaaatttaagagttttaatttgaagttagtctgctagttattttctttcctgagaatataaacttaaactactttattcttttacctgtagaattagaatgctaagtgtaaggttgactttcaactgtcacatttctgagtgccattttccaatttaatgttagttttagaacggaaaatatctatgcgaaagccaagagaagagctggttaaaagaggggttctgttggaagaccctgagcaaggtgagtttacaaataaatagcatatgcctgtctctgtgcacttggtctttgattgggtctgacgagatatttgaattttctttctttcttttatattgctatttttgggttggagggtggcctttaaaaaaaaaagttcacccttccttccttggggcaaacattcctttcctctgtgtacatcctcaactttgtgccagctacaatattgcgtgtcttttttttcccccccttgagacagagtcttgctctgttgcccaggctggagtgcagtggcacaatcttggctcactgcaacctctgcctcctgggttcaagcaattctcgtgcctcagcctcccaagtagctgggattacaggcacctgtcaccacccccagctaacttttgactttttagtagagatggggtttcaccatgttggtcaggctggtcttgaacttctaacctcaggtgatccgcccgccttggcctcccaaagttctgggactacaggtgtgagccactgtgcctggctaattttttcatttttagtagagatgaggtttcaccaagttggccaggctggtctcgaactcctgacctcaggtgttctgcccacctcggcctcccaaagtgctgggattacaggcttgagccaccgcgcccagctcattttcttttttgaacacatttgtccccatgcccatatcactgcaccagtctaccagtcattgtttgtttaataatgtcaagactttcttcaatgtgtgactctatgaagcaagttattgcaaatgtgaaagtatagtacattggttgcatctcatttctcttcatctgagttatgttgcatgaggcaaaatctgaaagccatattgtatactggccaggcatggtggctcacgcctgtaatcccagtattttaggaggccgagacgggcagaacacttaaggtcaggagtttgagaccagcctggccaaaatggtgaaaccccatctctactaaaaatacaaaaaattaggagggcatagtagcaggcacctgtagtaccagctacttgggaggctgaggcaggagaatcacttgaactcaggaggcagaggttgcagtgagctgagatggcgccactgcactccagcctgggcaacagagcaagactccttctcaaaaaaatttaaaaaatcatatcctttgaagaataggggaaaggaaccaaatagatggagtattactgtatactttttgggctttaaaccatgcgaatatattgcctattcaaaaaattaaattgtatgtattgaagatttattatctcaactgtataaaaactaaccagagacaacaagcttgaaggagcaatttgaaatattattacaattggttacctctgaagttgaggtgggaacatgggtgggctttttttttgttttttaattgagacagggtctccctatgttgcccaggctagtctcaaactcatgggcagcacaagcagtcttcctgcctcagcctcccaaagtgctgggattacaggcgtgagctgctgtgcccaggtgctatgcgatgttttctttctttctttttttttttttgtatgtgactagttatgagcatatataacttttgttttatataactctatttgtttttttacattaggacacaaaatcttctcagtatttaggtagttacgtactactttaatggtttcactgtagcacctctttggcccttgctttgctttcttttttgagacagagtctcactctctctcccaggctggagtgcagtggtgtgatcttggctcactgcaacctccatctgctgggttcaagcaattttccagcctcagcctcccgaggagctgtgattacaggcatccgccaccacacctggctaatttttgtatttttagtagagttggggttttcaccatgttggccagactggtctcgaactcctgacctcaagtgatccagccacctcagcctcccaaagtgctgggattacaggcgtgagccaccatgcctggcctggcccttgcttttttgatacagctgttccactttccatggcctttcttttcacctttcttgctcacttatcataaaccacatacattactcatttcttgtttttcaccttcagtctcttttgccctacactcacggcaacctctgcctcctgggttcaagcaattctccttcctcagcctcccgagtagctggaattataggcatgcatcaccacacccagctaatttttgtatttttaatagacagggtttcaccgttttggccaggctggtctcaaactcctgagctcaagtgatccacctgcctcggccttccaaagttctgggattataggcatgagccaccacgcctgatgatcttttgccctatactttctattagcccctaatccaagttgtttttagcctacaagttcacaggcccaattaataaacgagttgcagccattggacaagatgccattctgccaaccagataaatgacctaagctttattctgtatctaaaaacagggatgggcctcatgctggcttatagatctgcattttaggccaaaagtagtgtttgaaccttgaagtcctctgcatacttaaagggaacttttggctggcctggcgcggtggctcatgctgtaatcccagcactttgggaggccagtgtgggaggatcccttgaactcagtagttccagaccagcctgagcaacatagtgagacctcatctctataaaagattttttaaattagccaggtatggtagtgcaggcctgtagtcctagctacttgagcccaaaagatggaggatggcttgagcccagaagattgaaggctgcagtaagtattaattgcaccactgcactccagcctgggcgacagagtgagaccctgtttttttttttaaaaaaaggtggcttttggcttgattatagtgctaacttgactgtactgtaaaatatttaattgattttaattgattttctgggtttagggagaacattcagtgatgttaaagccccatagtactactccacttcattaacattgcagaaccctctatatttaatataagaaatgatactgcaaagtagacatccctgattaagtaacttgagataactgatcacttttgcatgtatttcactagtgtgtgctgagtagaaactaattaacactgtcttaaactttattatgttgttttcacaaagagcagcctttgttgactttgaaatcattgcttcagtattctagaaaatcttgtttttgttaaacatgggcagtaacttactatttttgtatagttgttgtcatcttacccccaccctgttttaaaaataaaaagtagttgtcagattactttggctttagaagtaccttttcacttgccttagaatcttcattactttgagcctacactccacctcttattggaacttcatgaagaatgatgttggatttcactctgtcacccaggctagagcacagtggtctgatcatggcttactgtacccttgacctcctgggttcaaacagtcctcccacctcagcctcccaggtagctgggactaggcatgtgccaccacacccagctagtttttttacttttttgtagagacagggtcttactatgtttcgcaggctgatctcaaactcttgggctcaacgatcctcccgcctcagcctcccaaattgttgggattacaggcatgagcaccactgtgcccagcccataaccatttcttttttttttttttttttgagatggagtctgttgcctcagcctcccgagtagctgggattacaggcacctgccaccacacccgaataatttttgtattgttagtaaagacggggtttcaccatgttggccaggctggtctcaaactcctgacctcagatgatccacccgcctcggcctcccagagtgttgggattacaggcgtgagccactacacccggccccccataaccatttcttatgtgaatctattctcctgccagaccaaactagttgccagtgccccaaacacgttgaataacttcacacctttatacatgctgtccttcttccaaacagactgtctttattcagtgtggtaggctcctactccttcaagatccagttcaaagcaaggcatggtggtgtgtgctatagtcccatctactagggagtctgagagaggaggactgtttgagcccaggagttcaaggcccattctggtaacatagcaagaccatctcaactccagctcagatactttctgtgatgccttcctaactctattctcactccaggaaaatgatttcttcttcattcctaccacagtacttcactaattagagctcttgacatttaacattgtagttacttatatataagtttgccctattcgtttgtctttttttttctttctttgagttggaagttttgctctgctgcccaggctggagtgcaatgacacaatcttggcttactgcaacctctgcctcctgggttcagttgattctcctgcctcagcctcctgaatagctgggattacaggcgcttgctaccatgcctggataatttttgtatttttagtagagacaaggttttaccatgttagacaggctggtctcgaactcttgacctcaggtgatccacctgcctcagcctcccaaagtgctgagattacaggtgtgagacactgcgcccggcttttatttgtcttattcatataacaacgtacttggcacatagtaggctatcaaacatgtattggaaaaagaaatcacttgtttctgtttaagcatccagataatctagatctcaataataaactaaaacaggaagacgagggaaagaagataagaaaggttagaaatcaccaaccctgggccgggcacggtggctcacgcctgtaatcccagcactttgggggctgaggcgggcagatcacgaggtcaggagatcgagaccatcctggctaacacggtgaaaccccgtctccactaaaaaatacaaaaaattagtcgggcgtggtggcaggcgtctagtcccagatactcaggaggctgaggcaggagaatggcgtgaacccgggaggcagaggctgcagcgagccaagatcatgccactgcactccagcctggtctgtgagaccctgtctcaaatcaccaactctggccaggcgcagtgattcatgccatttatcctagcacttcgggagaccaaggcgggctgattgcttgagcccaggagttcaagaccagcctgggcaacatagtgagaccctgtctcaatttaaaaaagagagagaaagaaaaaaagaaattactaactcttctttctatctgttcatgccaacttcatcactttgtactcttctttcaccttgcaggtggtgaggatccaggaaagccaagcgatgccatgttaaagaatggccataccacccccatagggaatgccagatcatctagtccagtccaagtagaggaagagccagtaagattagcaagtcttaggaaagctattccagaagaggacctaaagaaacgactaggtaagaaactctggatttttgagtttaagagccacgggccagttattctccttacataaggggtttgcaagagaacagggaaaagtgaaatctagagagaattacattctcctttaacaataccttaactagcaacttcaaggggaatttcctcccccaccccgcttttattcactaaatacctaaatttgtgatcctcaagaagggaagaggatgttaagtatcagatacctataggattttttccagctacacattccacttctttcacccaaggaattttgttgtggctctcctccagtagcctggcccttgtgtgaagaatcactaccacaatgagcatctcttagtgagcctttcttactgacatttcttaagtatggggaggttgggaggcattgagaatggtaacctataagctaatctataaattaattggtgaaattggccacaaattcatagatgtgttagctttttcagtttctcttgttactctctcttccctttttataccatacatgttattacacaggctcaactggaagccagcctaattctgaagcagagtctgttcctgagaatgtacccaaaccacctttacttcctcccaaaagacccttgtcctcttctcatgaagcaagtgaagggcaagcaaaggatgccacttcctctggcggcacggcaaggttcatcatctccacctccatcaccacagcacccgctgccaccactgctgccacaagccttgcaaagactgttaatctctctgtcaccccttccccagcacccaggactctgcctgctgctcctgccagcactaacactactgctaccccaagcctcactcatatggtccctgccaagcagccccctatccctccccctaaaccagctcacagaaatagcaaccctgtcattggtaagtaagtctttaggcttccagtgttttgggtttggtttgatgttggatggttattttatttgataactggtacaacattgatttggtctgtgagaattttccatatcttgtccctttgaatgacctcaatatggagaaaagtcttaggttaagaaaaaataggccaggtgcggtggctcacgcctgtaatcccagcactttgggaggccgaggtgggtggatcacaaggtcaggagattgagaccatcctggcaacatggtgaaaccccatctctactaaaaatacaaaaaattagccaggcgtggtggcacgtgcctgtagtcccagctacttgggaggctgaggcaagagaattgcttgaacccaggaggcggaggttgcagtgagccaagattgtgccaatgcaccccagcctaggcgacagagagagactccgtctcaaaaaaacaaaaacaaacaaacaaaaaaagtcatgaaactgaggcagatggccataaatgtaaacatcactaagattagatttaagttttgggggttttaacctattttttaatctaatatttaatctgtttttctaaaacaatgattccaaaacactatacatatttgtgtgtgtgtgtgtgtgtgtgtgtgtgtgtgtgtgtgtaattggactggatatgtgaaaaccataacagattccacctgcatggaattatctgtggcacttgctgaaaaattagaataatgcctcagctcacaaggggcaaggcaaacttttcaaatgaaaatttttaaatctacttaaaactacctatgccttccataagcattaatgagtctagtagataaaaggatgattctgtagatgccagtggaatttgggattcagtgtctggcatagttatcttcacagggaactgcagaagctattacttaaattgttctgataaaatcatgttttatcttgggagaattaagaatgctattcttatgttaaaataagtgatggtagagaaagcagggaatataatcagtaaaatttgtatgggtttagtaaattttttgcatttacccaaagttctatttaagtctactttctttatataaatgcacaatttcttagaagaattttcaagaaagggagaggaaagctaatgagtgcttcaaagctaataaaaatatagttttttcaggaaaaatgatactaggcttagtattgcttaaagttcttgttcacgattgaacgaatgaataaaaactatactcattaaatatttaatatcaccatgttgggtggagtgattcaaaccttgaaaaacaggcttagaatattttatgagtatgacagtttggagtagcttgatgaaaacaggatgaagttgttattaccaccactttggatggatagtgtcatgttgacttatctgtgaggaacttggggagctttcacatacttattttcaaaactaccttgtgctgcaggaaaccaattttatcttttccataggtagggcaattagaacatgaagacattgtgactcattcaaggttgtaggccaggcgcagtggctcatgcctgtaatcccagcactttgggaggcagaggcgggtggatcacctgaggtcaggagttcaagaccagcctggccaacatggtgaaacgccatctctactaaaaatacaaaaaattagccgggcatggtggtaggcacctgtaatcccagctactcgggaggctgaagcaggagaattgcttgcacgtgggaagcagacgttgcagtgagctgagattgtgccactgcattgcagcctgagcaacaagagcaaaactccatctcaaaaaaaaagaagaaggttgtagttagtgaaagatagaaactgaacataggcttttcaactctcaggtccagacctctgttccttacagtagtgtttgcaaactggtgttctcctcaggatcacctagaaagcttatgataacagactgctggacactacccgtagagtttctgattttagtaagcctgggatgggcttgagaatttgcctttctaataggttcccagatgacactgatgctgctctccagggagcacacattaagagcctctgctctacaccagtggcataccacccttttcaagttaaggcaacatataaaatgataatttgtgtatgataccctggactaaactgcagagctcattcttagcttgaggtaaatagcccaaaacaatagaccttgtaactgaggaatcagtattagtccatgaggggtcctcaacaaaagaagaaaaatagaacagttcacagagcatttcttagagctaaatagatttaatttaaaggactctcttttattctaaaattacaaccttcctaatcctttggtgttaaaatgccatttctttcacaaaaggattatgatcataaatggtttacttaatatcaagccttatttggaaatcttagaaaatgacaacctcaaaaaaacactagaaaaaaaaccaacaatctgaggttgatcaagatttttgttattgttttggtcactgaaatccaaaagtttggaaatcattgcttcagaagtactactgtcttctcatccatataacatggagtattacgactaaggaaaaaccaccagcaatagctgaacgggtgaaagggaattattacccatcccagaaacactctgaaatttttccacagaactacagccagatgctgttgtcagggtatatataccagaatttacttccttaacatatatgccttcctcaaattaccaaatagaatttattttattaattcaaaagtaaaaatattcatttatggtctcatcaggaatgagttttgttgtagatggaatagctaacagctatttttagagaatcagcaaaaatccaatctttccaaaaatatctctttcactgctcctaaaattcacatttttagaatctttttgtgtgtgtatgcagtgtttttctagaaagccttttttaaaatttatttatggggccaggcatggtggctcatgcctgtaatcccagcacttcgggaggccgaggtgggcagatcgcttgaggcccagagtttgagaccagcctgggcaacatggtgaaaccccatctctactaaaaatacaaaaaatgatctgggtatgatggtgcatgcctataatcccagctactcaggaggctgaggcaggagagaatcacttgaacccgggaagtggcggttgcagtgagccaaaattgcaccactgtactccaacctaggcaacagagcgagactctgtctcaaaaaaaaaaaaattatttatgatgagagacattaaaacattacaaaattaggccaggcacagtggctcaatgcctataatcccagcatttggggaggccgaggtgggaagatcacttgaggccaggagttcaagaccagcctgagcaacgtagcaagaccccatctctataaaatatttaaaaattagctgggcatggtgacatgtgcctgtaattctagctacttgggagattgaggtaagaggattgggtaagcacaggagttcaaggctgcagtgagttatgattgcaccactgcactctagcctgggtaacagagcaacatcctgtctctaaaaaaaaagaaaaggctaggtacagtggctcacacctgtagtaccaacactttgggaggctgaggcaggtagattacctgagcccaggagtttgagaccagcctaggcaacatggagaaacccatctctacaaaaaataccccccccaaaaattagccgggcatggtggcacatgcctatggtcccagctacttgggaggctgaggtgggaggatcacctgagcccagggaggtcaaaattgcagtgagccgtgactgcgccactgcactccagtgacacagtgtgagaccctgtctaaaataaattaatttaatttaaaaataaaaataaatttaaaaagaaaagaggctgggtgtggtggctcacatccataatcccagcactttgggaggctgagataggtgtatcactggagcccaggacctcaagaccagcctgggcagcatagtgagaccttgtctctactaaaaattaaaaaaattagtcaggcatgggggcatgggcctgtagtcctagctacttgggaggctgtagcaagaggatcacttgaacccaggagatcgaggctgcagtgagctattgttcatgccactgcactccagtctgggcaacagagggagaccttgtctcaaaagaaaaaaaaaaaaagaattataaaattagctagccttggccgggcaaagcggacatgcctgtaatcccagcactttgggaggccgaggcgggtggatcacctgaggtcgggagttcaagaccagcctgaccaacatggagaaaccccatctctactaaaaatacaaaaaattagccgggcgtggtggcacatgcctgtaatcccagctactcaggaggctgaggtaggagaatcacttgaacccaggaggtggaggttgcagttagccgagatggcgccattgcactccagcctgggcaacgagtgaaactccatctcaaaaaagaaaaaaataattagctagccttttactttgaacatctccaattttggagatttaggacaaatacagttttatttaagggaagtttttgagagtgtttgagaatactgagtgggatgaaactaaagggtttgagtagaaggttagaggttggtgatcaaaagaactactttttttttttttttcctgtcagcagggaaaaaataactaccctttaattactttaccagttttactcctgtgtgatctgatgatccacttcttacaggtcatctggagccctccaaagggactttgctgaaacaacaccaacacctttgctgagtcattgtgggctttggtgaaactataggaatatatactgtcatgatacagggtgaaggcttctcatctaataaacatatattgagggtccactagatgccaggtactgtgcacagccctgtggatgatatgttgatggagacaaggttgccctgccatcaaggagcccatgatatagtggagagtgaacatgggaagctgaggtgcaaagggaacataagaggtgtgcataccaataaaaattagagacagtaggccgggcgcggtggctcacgactgtaatcccagcactttgggaggccgaggcgggcggatcacgaggtcaggagattgagaccatcctggctaacatgatgaaaccccgtctttactaaaaatacacaaaaaattagccgggagtggtggtgggcgcctgtagtcccagctacttgggaggctgaggcaggcgaatggtgtgaacccgggaggcagagcttgcagtgagccgagatggcaccactgcactccagcctgggcgacaagactccgtctcaaaaaaaaaaaaaaattagagacagtaggatgcagtcaaatagtcagagacttggataccagctgagtccatgccagtttgtagtatgatcttgggcaaagtcacctagcttctgtggccttgccttttccttctgaaaaatggtaaagatgctatattttttcccctgtcacctcaggtggtataaggagaatatgacttcaaggacaaaaaacactttgatttcttcaaaggactttgcaattgctataaaaattcaagatgtcagtattgacagttttataacacagagctaagatatctagataccattatcaggatatggtaacaatacccactaatacttattttatgctatctgaatgtttaaattttttaatggagtactgttatacaaaataacttttttttttttgagtcagagtcttgtgctgtccagcctggagtgcagtggcatgaccttgactcactgcagcctccgcctcccaggttcaagagattctcgtgcctcagcctctcctgagtagctgggattataggtgcccaccaccacacctagctaatttttgtaattttttttttttttttttagtagagacggggtttcaccatgttggccaggctggtctcgaactcctgacctcaagtaatctgcccacctcggcctcccaaagtattgggattacaggtgtgagccaccgtgccagccacaagataactttttatcagattttttttgtctctattcatattaactacaccaagatcaagttacaaaaagttgtcagccgggtgccatggctcacgcctgtaatcccaacactttgagaggccaaggcaggtggatcatttgaggtcaggagttcgagaccagcctggccaacatggtgaaagcccgcctctactaaaaatacaaaaattagccgggccgtagtggcgtgcgcctgtaatctcagctacttggtagactgaggcaggagtatcgcttgagcccgggaggcagaggttgcggtaagccaagatcgcgccactgcactccagtctgggcgagagagtgagaccctgtctcaaaaaaaaaaaaaaaaaaaaaattgtcatatctgttgccatagcaatgaagtaagctactcatcagtcttcctacacctctgtacatttattaagccttctatttgaataaatataaacttcatttcaggataaaatatatagggaatggcaaaactatgaaattatttaacttgcttaaaagattaaaactgaactcaactttaattctaggccctgggccggcccttcaaagcattggaaagtcgtgaaattgatgtgttgctctctcttttccagctgaactgtcccaagcaataaacagtggtacattgttatcaaaaccgtccccacccttaccacctaagagaggcattccatcaacctcagtacccaccttggagtctgctgctgccatcaccacaaaaacaccaagtgatgaaagagagaagagcacgtgttctatgggctcggaactactaccaatgatctcacctcgctctccgtcccccccactgcctactcatatacctccagagcctccacgcacccctccattccctgctaagacttttcaagttgtgccagaaattgagtttccaccatccttagatctacaccaggagattccccagcaggaagatcagaaaaaggaagtccccaagaggatactggaccagaactttggggagccccatataccctctaggctgcctccactcccactgcatattcgaatccagcaggccctcaccagcccacttcccatgactcctattctggagggttctcacagagctcattcgttgctttttgaaaacagtgacagcttttctgaggacagcagtacgctgggtcggaccaggtctcttcccatcactattgaaatgctaaaagtgtaagtgcctttaaagcttgcctcttatttctcctttactctagatagccctgcttggaaaaaattacttataaaaagaaaatgtgggccgggcctagtggcccacacctgtaagcccagcactttgggaagctgaggcaaatggaccgatcacctgaggtcaggagttcaagaccagcctggccaatacagtaaaaccctgtctcgatgaaaataacaaaaattggccaggcgtggtggcacatacctgtaatcccagctactcgggaggctgaggcaggagaatcgctttaacagggaggtggaggttgcagtgagccaagactgtgccactgtactccagcctgggcgacaaagcgagtctctgtctcacagaaaaaaagaaaatgtgaataatttttttttttccgagatggagtcctgctctgtcacccgggctggagtgcagtggcacgatctccgctcactgtaacctctgccgcccaggttcaagcgattctcctgcctcagcctcccgagtagctgagactacaggcatgtgccaccacattcggctgatttttgtatttttagtggagatggggtttcaacatgttggccaggctggtctcgaactcctgacctcaggtgatccacctgcatcggtctcacaaagtgctgggattgcaagtgtgagccaccgcgcccagcattgtgaataaatttaaagtacaaagaatactctgccaaaagaataagttatagaatttggactctttctttttttaatcttaccttaaaactttatttttatttatttatttatttatttatgtttgagacaggttctcactctctcactcaagctggagtcagtggtgcagtcttggctcactgcaacctccatctcctgggctcaagcaattctccctcctcagcctcccgagtaactgtgactacaggcgcatgccatcacacccagctaatttttatattttttgttagagatgggattttgccatgttgcccaggctcaccctgaactcctgggctcaagcagtctgcctgcctcaacctcccagaatgctgggatcatgggtgtgagccactgcgcctggccaaattttgattttttactcttgtgattttttttttttcatggagatttttgtgatgacacaaaatttacaaaattatgtacatgaaaaattacaaccgctagttttatatactacagggaaggcattgtataatgttgtgcttaagagcattcaccttggagtgagatagccctgggttcaaattgcagcactaccactcttagcttatagtagtgttaagttactgaagccttctgctctttagttatatcatctctaaatgggaataatatttactctgtaggcttgtgagaatgacattagacaaattctggaaagcaccagtgcctaataagtggtaaagctgggatctgaacccttagattaatacctgctaaaaagtttcttagtaagattgttaaagttaagggagagaattaattataagttacttcatccatagatttttttgtatttatggttatttcagtcctttgtcttttttttttttttgagatagaatctcactcttgtcacccaggctggaatgtagtggcacaatctcggttcacttcaacctctgcctcctgggttcaagagattctcctgcctcagcctctcaagtagctgggattacaggcacctgccaccatgccaggctaatttttgtatttttagtagacacagggtttcaccatgttggccaggctggtctcaaactcctgacctcaggtgaatttgcccacctccatctcccaaagtgctgggattacagccatgagccaccacgcccagtctttatttcagtcctttgtcttaaaagtcagttatcctcttcatttctaaaaggaaaatataattatgttaatttgttagtccagacgatgaagaagaagaggagcaaacctgtccatccacattcagtgaagaaatgacacctacctcagtcattcctaaattaccacagtgtctacgggaggaagaagagaaggagagcgactctgattcagaaggtcccattcagtaccgagatgaagaagatgaagatgaaagctatcagagtaagaaagggagggaaaagcaaaacagagaattcttttccagataaaactatttgctgatcttagcaagtgtcaaaagagatatggaaacaggtaccttctcccattaagtcatctggctaactgatgttggaagccactgtgaaggactccttgtccctattatcacccctctgttaaaacaagccaagacagggatccaagtagattgagtcactcaggttttaggttttttgtttttttttgttttaatttttttttttttttttggacaaggttttgatctgtcacccagctggagtacagtggtgcaatcgtcgctcactgtagcctccaactcctggacttaagtgatccttacgcctcaacctcccaaatagctaggacagatgtgtgccacaactggttaggtttctttgattttttgttttgttttttgtttttgtagagacagggtctcgttaggttgcctagcctgttctttttttttttttttgagacggagttttgctcttgttgcccaggctggagtgcaatggtgcgatctcggctcagtttaacctccacctcccaggttcaagcaattctcctgtctcagcctcccaagtagctgggattacaggcatgtgccaccacacctggctaattttgtatttttagtagagatggggcttcaccatgttggtcagactggtctcaaactcccgacctcaggtgatctgcctgcctcggcctcccaaagtgctgggattataggtgtcagccaccgtgcctggccataaaagatatatatataattttttttttttttttagacagagtcttgctctgtcatccagactggagtgcaggggcacgatctcaactcactgcaacctccacctcccgggttcaagcaattctcctgcctcagcctcccaagtagctgggattacaggcgtctgccactaggcccagctaatttttttttatttttagtagaggcggcgcttcactgtgttggccaggctggtctcgaactcgacctcgtgatccgcccacctcccacagtgctgagattataggtgtgagccactgtgcccagctgcccaggctgttattgaactcctgacctcatgtgatccccctgccttgacctcccaaagctctaggattacaggcatgagccaccgtgcctagcctatttttaatttttatagatatataatagtaatatatatttatggggtacatgagatattttgatataagcatgtgtgtatgggtaattaggctatccatctcaagcacttatcatttgtttgtattgggattattccaaatctacctttctggttatcttgaaatatacaatgaattattgttaactatagtcaccctattgtgccaccgaacactagatcttattcctttttttttgagacagtgtctcactctgcaggctagagtgcagtggcacaatctcagctcaatggaacctccacttcctggctcaagcaatgctccaacctcagcctcccaagtagctgagaacacaggtgtgagccaccacgcccagctcatttttgtatttttttatagagacagcgtttcaccatgttgcccaggctggtctcgaacttgtgagctcaaagtgatctgcccacctcagctcccaaagtgctgcgattacaggcatgagccaccacgcccggcctagatcttatttcttctatctaattctgtttttatacccattaaccagtctctctctcccccatcccctctacccttccctgcctctggtaaccaccattttatttattacctccatgagatcaacttttttagctcccacgtaagagtgagaacatacaacatttatctttctgtgcctggcttatttcacttaacgtaattgtcctccagttccatccattttgttgcacataacaggatttctttctttttcatggcagaataatcttcaattgtgtatatacaccacgttttctttatcccttcatttattgatggacatttagtctgattccatatcttggggattataaatagtactgcaataagcatgactgattgatttgctgatttcctttcttttggatatgtacccaacagtgggattgctggatcgtatggtagttctattttttttttaatagacggaggctcactctgtcaccaggcaggagtgcagaggcacgatctcagctcactgtaacctccgcctcccaggttcaagcgattctcctgcctcagcctcccaagtagctgggattacaggtgtgtatcaccatgcccagctcattttagtttttgtttttgtttttgtttttgtttttttagtggagacagggtttcaccatattggctgggatggtcttgatctcttgacctcatgatccacctgccttggcctcccaaagtgctgggattacaggcatgagccaccgtgactggcccggtagttctatttttaagggtgttttgtttgttttgttttgttttttaagtagagacacagtcttgctgtgttgctcagactgatctgaaactcccagcctcaagcaatcctcctgccttggcctcccaatgtgctgcattacaagcatgagccacctcatttggcctattttcagttttttaaggaacctccatagtgttttccacaatggctgtactaatttcaggtttttgtttgcccccaattttaaaactattcacctaagtgcctctaatcccagcactttgggaggccgaggccggtgaggtcaggagcttgagaccagcctggccaacatggtgaaaccccatctcttctaaagatagaaaaaattagccaggcatggctggccacggtggctcacacctataatcccaacactttgggaggccgaggcaggcggatcacctgaggtcaggagttcgagatcagcctggccaatgtggtgaaaccccatctctactaaaaataaaaaattggctgagcatggtagcaggcgcctgtaatcccagctactcaggaggctgaggcaggagaattgcttgaacccaggagacggaagtcgcagtgagccaagactgtgccactacactccagccggggtcacagagcgagactctgtcgcaaaaaaaaaaaaaaaaagccaggcatggtgacaggcacctgtaaccccagctactcaggaggctgaggcaggagaattgcttgagcctgggaggcggaggttgcagtgagccgagatcttgccactgcactgcaacctgggcaacagagcaagactccgcctcagaaaaaaaaaaaaaaaaagaggccaggcgtggtggctcacgcctataatccctgcactttgggaggccgaggtgggtggatcacctgaggtcaggagttcaaaccagcctggccaacataacgaaacccgaaacccggtgtctactaaaaatacaaaaaattagctgggcgtggtgacccacgcctataatctcagctactcaggaggctaaggcaggagaatcacttgaacctgggaggcggaggttgcaatgagctgaaatcgtgacactgcactccagcctgggcaacaagagcaaaagctctgtctcaaacaaacaaacaaacaaaaaaaccaacaacaatatggagtagaggaaaggtggcacatgggctaaggtgaaaagataaaagtgatgttttccctttggtctaatgaacttattgccacagggcagagaaaaataaacattttcataccctcacatctttgcaaataattgagtcctgattaattgaagtagaaaggcagctttaaaaacagatagactatgaggtgttagtatgaaagcctttatgttttaattcagagggctgtcccatgcttagattctctctcctgtagcaactcttaccaaggaggaaaaatgtagaggcctgatagaagagaaaagataccttttaaccatcttagtccacctggctaaaaagatttttaggtgtctttagctttacccccacctcagtgttcagctggatcatttgaggccaggtgggaactgggaattaaatattgtatttgttcagactcttgactagctccaggtaaggttgaacctttggctttaagcctcaagttctacatttttttcttccccgtgtgcaaaggtgctctcgccaacaaagtgaagaggaaagacacactggcaatgaagttgaaccacagacccagtgaaccagagttgaacctgaattcttggccttgtaaaagcaaggaggagtggaatgaaatacggcaccagattggaaacacactgatccggtaggcctttgcttagatttgcttgattgatttggttatgccagtatttgtgttagatgttgttagatgtgttgtttttttgtgtgtgttttgtttcgttttctgagacagggtcttgctctgtcacccaggctggagtagtggcgcgatctcggctcactgtaacctccacctcccaggttcgagcaattctcctgcatcagtctcctgagtagctggcgttataggcacctgccaccacgccaggctaatttttgtattcttagcaaagacagcgtttcgccatgttggccgggctggtctcgaactgctggcctcaagtgatcacccaccttggcctccacaagtgctgggattacaggcatgagcccctatacctagtctatatgtttactttgttgtggagtattcatttatcttttttagtgtgatttttttttcttttcagacagagtcttgatctgtcacccaggctggagtgcagtggttcaatcatggctcaccacctccaactcttgggttcaaggcaccctcccacctcagcctcttgactagctgggtcctcaggcatgcgccaccatgcactgctaatttttgtaattttttgtagagacagggtctctctgtgtttcccaggctggtctcaaactcatggcctcaaacattcctcccacgttgccctccgaaagtcctgggattataggtgtaagccaccacacccatcactttgagtataattttaaaaaatacatattgggttttgcatgaaaggagagaaggttagcactccacttgacaaggatggaagaggccctttgggcctgacaacacacatacaaggcattgccacctactacgtggcatctaactatctttacaaaaaaagaaaaagaaaagaaaagaggctgggtgcagtggctcatgcctgtaatcctagaacttcgggaggctgaggtaggcagatcatctgaggtcaggagttcaagaccagcctgaccaatatgatgaaaccccatctctactaaaaatacaaaaattagccaggcatggtggcatgcgcctatagtcccagctactcgggaggctgagatcggagaattgcttgaacccaagaggcagaggctgcagtgagctgagatcgcgccactgtactgcagcctgggcaacagagtgagactccatctaaaaaaaaaaaaaagaaaagaaaagaaacaaaaaaatatatattggacacagttgggtatcctctaagaatttggaaattgaagatgtagctgcctgtgagagttttattttatttattttatttttgagatggagcctcgctctgtcacccaggctggagtgcaatggtgcaatctcggcttactgcaacctctgcctcccgggttcaagtgcttctcctgcctcagcctcctgagtagctgggactacaagctcataccaccacacctggctaatttttgtatttttagtaaagatggggtttcaccatgttggccaggctggtctcgatctcctgactcaggtgatctgcccgccttcgactcacaaagtgctgggattacaggtgtgagccaccacacctggccagcctgtgagagctttaaaccatgagatagacatatggttttgcaaaagtttctacataaatcagaatggttcccagaacagaaaggctcctctgtcactttttttatctggttgcttaaccataagatgccaacccaattaacagtcacacccatatttgcattatatctgtttcatatgttccgtgtaactgcctcctttcaaagtgttggtatatttttcaagtcaactggaaccaaaagtatagagaaactgaatgcaagccagctttctgcatatgtaacagtgtaagaatccaggttgtatagatgggtttttgtttgacacagatgtttctcccagtaaagagaggataaggagctggaactcgtggcacagttccctacaaaataattaattgatcatgtctactaattaaaatttctttttctgtactattgcagatacctggttttggctgggcaaggtggctcacacctataatcccaacattttgggaggctcacttgaggtgggaggctcacttgagcccaggagtttcagagcaacccgggcaacaaagtgagatcccatctgtacaaaaaattaaaaaattagctgggcatggtggcacatacctctagtccagctattctggaagcttaggtagaaggatcacttgagcctgagagatcaaggccgcagtatgctgtaattgcaccactgcactccaccctgggtgacagagcaaaaccctgtctcaaaaaaaaaaaaaaagagacacctggctttactgtgtatgctgtacctcagggcaagttttccctttgtcttctaatagacactttttggatccagaaattgttctctgcaatttctttacttaaacataattatcagcctgtatgacctctgtggtctgactactttgaaattaagggagaaggctgggcacggtggctcactcctgtaatcccagcactttgggaggctgaggtgggcggatcacttgagcccaggagttcgaggcaacatgacaagaccctgtctcgacaaaaaaacaaaaaacttagccagacatggtgacacacgtttatggtcccagctactcaagaggctgaggcagggggattgcttgagcccaggaggggctcaaggtcggcccaggaggtcaagacccaggcgatcaaggcccaggaggtcaagactgcagtgagctgtgctcatgccccactgcactccagcccagtcatcagagcaaaaccttgtctcaaaaaaaagtaaagaaagacatgtttattatatggtagtttgaaaaattacaaaaaaaagagataaatcatggccggacgcggtggctcacgcctgtaatctcagcactttgggaggccgaggcgggtggatcatgaggtcaggagatcaaggccatcctggctaacacgatgaaaccccgtctctactaaaaatacaaaaaaattagctgggtgtggtgctgggcctgtagcccagctactcgggaggctgaggcaggagaatggcatgaacctgggaggtggagcttgcagtgagctgacatcgtgccactgcactccagcctgggtgacagagcaagactccgtctcaaaaaaaaaaaaaaaaaaaaagagagagataaatcagccataatcctataccctataagccaggatttggcaaacttcttctgtaaagaaccaaatagtaaatattttaggatagggtgcagtggctcatgcctataatctccgtactttgggaggccagtgtggaagaattgcttgaggccaggagtttgagaccagcctgggtaacatagtaagactctatcactacaaaaataaaaataggtcaggcacagtggctcacacctgtaatcccagcacgtttgaaggccgaggcaggtggatcacatgagatcaggagttccagaccagcctggccaacatggtgaaaccccatctactaaaaatacaaaaattagccaggcgtggtggcgcccacctgtaatcccagctactcaggacactgaggcaagagaatcacttgaacccaggaggcagaggtttcagtgagctgagatcacaccatggcactccagtctggacgacagagtaagactccatctcaaaaaataataaataaaatagccaggcatggtagcatgcccctgtagtcctagctacgtgggaggctgtggcagcagaactacttaagcccagtagtctatatactagacagggcataaatatagttatatttaatatatttaatatatgtgtgtatgtgtatatatatgtgtgtatgtgtatatatatgtgtgtatgtgtatatatgtgtgtatgtgtatatatatgtgtgtatgtaatatatatgtgtgtatgtaatatatatgtgtacgtgtgtgtatatatgtccatatatatatatggatttgatggccatataaactctctctttttttttttcctacctttaaaaatataaaaacatgggtcgggcgcagtggctcatgcctgtaatcccagcactttgggaggccgaggcgggtggatcacgaggtcaggagacagagaccatcctggctaacacggtgaaaccccatctctactaaaattacaaaaaatttagccgggtggtggcaggcacctgtagtcccagctactcgggaggctgaggcaggagaatcgcttgaacccaggggacagaggttgcagtgagctgagttcacaccactgcactccagcctgggcaacaagagcaaaagaaactccgtttcaaaagaaaatatagtttatacatacagtggaatattatttaatcttaaaaaagaaggaaatcctccaatatgctaacaacatagtcaaaccttgaggacattaatatgagtaagccagtcacagaacaataaatactgcatgattccacttctgcgaggtatctgaaatagtcacatttatagaagcagagagtagaaagatagttgtcaggggctcgggattgaaggcaggggtgatagggagttgctaataaataagtataaagttttagttatgcatgatgagtaagttctagagatccactgtacaacattgtgtttatagttaatactgtagactgggcgcggtggctcacgcctgtaatcccaacactttgggacaccgaggcaggcagatcacgaggtcaggaggtcaagaccagcctggccaacgtgatgaaaccccatctctactaaaaatacaaaaattagccgggtgttgtggcaggcacctgtaatcccagctagtcaggaggctgaggcaggagaattgcttgaacccgggaggcagaggtttcagtgagccgggatcccgtgccactgcactccagcctgggcaacagagtgagactctgtctcaatcaatcagtcaatagttaatactgtattggccaggtgtggtggctcatgcctataatcccaatactttgggaggccgaggcaggcgtatcacgaggtcaggagttccagaccagcctgaccaacatggtgaaaccccatctctactaaaaatacaaaaattagccgggtgtggtggcgcatgcctgtaatcccagctactcaggaggctgaggcaggagaatcgcttgaacctgggaggcagaggttgcaatgagccaagatcacgccactgcactccagcctgggcaacagagtgagactctccatctcaaaaaaaataataataatactgtattgtacacttaaaagtctgttcaaaaggtagatctcatagtaagtgttatcactataaaataagattgaaatttaaaaaaacacacacaataagagaccaccacgagtacactaggatggctaaagttatgcaatttaaaagactgacaaggccgggtgtggtggctcacccctgtaatcccagcactttgggaggccgaggcaggcagatcacctgaggttgggagttcgagaccagcctgatcaacatggagaaacttcatctctactaaaaatacaaaattagctgggcgtggtagcacatgcctgtaatcccagctacttgggaggctgaggcaggagaatcacttgaaccggggaggcagaggttacagtgagccaagatcgggccactgcactccagcttgggcaacagtgcaaaactctgtctcaaaaagaaaggaaaggaaataaatacaggagtgatatgttcattcttgcaattgtgatgatgatttcacaggtgatatatggcaaaagtggccaaattgtacatgttaagtatgtacacagttgtacatatttacagtattattgtgtcagttatatcgtattaaagctggtttgttttttgttttttgttttttgtttttccgaagaacatttaaaaaggaaggcccaggccaggcatggtggctcatgcctgtaatcccaacactttgggaggctgaggtaggaagatcacttaacgtctggagttcaagaccagcctgaccaacatgctgaaaccccatctctattaaaagttagctgggcctagtggtgcatgcctgtagtctcagctactcaggaggctgaggcagggcaatcacttgaacccaggaggctgaggttgcagtgagccaaggtggcgccagtgcactccagcctgggcgacagagtgagactctgtctcaaaaaaaaaaacaggaaggtccagctgggtgtggtggctaacatctctaattccagccctttgggaggctgagctgggggaatcacttgagcccaggaatttgagaccagcctgggcaatatggcaaaactccatcactaccaaaaataaaaaaattagccagcccagtctctaaataaataaatacatacatacatacatacgtactttttaaaaaataaaatggggcggggcacagtggctcacgcctgtaatcccagcactttgggaggccgaggcaggcggatcacaaggtcaggagattgagaccatcctggctaacacggtgaaacgccatctctactaaaactacaaaaacttagccgggcatggtggcacgcgcctatagtcccagctactcgggaggctgcggcaggagaatctcttgaacctgggaggcggaggttgcagtgagccgagatcaagccactgtattccagcctgggcggcagagcaagattctgcctaaaaaaaaataaaaataaaataaaaataaataaataaaatggaagatccttgaggtaggaggatcatttgagcctaggaggtggagctgcagtgagctgtgatcgcaccactgcactctagcctgggtacagagtgagaccctgacacacacacaaaaaaaaaaaaaaaaaaaggaaggtcttgttcagaaagaaaagttgtatatagaatgggactggaagttccttatgcaagcaacagaagagttgaaaattttgcaagtactagctaattagcccaaatactgtctgagaagtataaattaaaagtaagaaatgaataactttctgatttcaaaaatgacaaattgtagttttttgttgttttttttttttttttttttttttttgagatggaatctcactctgtcgcccaagcaggagtgcagtagcatgagcttcagctcactgcaacctccatctcccaggttcaagcattctcctgcctcagcctcccgagtagctgggactacaggagcacgccacaacatccggctaatttttgtatttttcagtagagacagggtttcaccatgttggccaggctggttttgagttcctgacctcaggtgatccacctgcttcagcttcccaaagtgctggggattacatgcatgagccaccacacctggccaacaaattgttattggtgaataacatctcagaactgtgatgaggtgagataactttatcaaatgcttcacagagaagactgagatttaaatcatagaattatagaatatcacacagaaagagacaaacttaaattccagtggttcctaaaccactgatttaaaaacctagctgggcatggccaggcgtggtggctcacgcctgtaatcccagcactttgggaggccgaggcaggcggatcacaaggtcaggagatcgagaccatcctggctaacacggtgaaaccccgtctctactaaaaatacaaaaaattagccaggcgtggtggcaggcgcctgtagtcccagctacttggaaggctgaggcaggagaatgtcatgaacccgggaggcggagcttgtagtgagccgagattgcaccactgcactccagcctaggtgacagagcaagactccatctcaaaaataacctagctggacataatggcttgcgcctataatcccagcagtttggggggccaaggcgggaagatagcttgagcccaggaggagttcaagactatcctgggcaacagagtgagaccctcatctctattttcaaaaaattgtaaaaaaaaaaaatctaaagaggggcatctgagtcatagaagaagttttgtgaaaaaaaaaatctatatatagatatatgtaatttcatttttcatcctgattttctgaatcagaatttctgttaacgtttcttgggaatctgtgttttctaaaaagtctctaatgcttctgaaggagcaaatttgtttaggagccaccagttcggtccaaaccttcgcttcacggatgaggacactcaaggtctaactgaacttttttgtgctaatagctcttatcaaggtctagaactagaatcctggccacttgtttgcatatacagttcctttttataatgtgatatctgtgttaacacttttaatgtgaaattgttttataaacaatcataaataaatgaaatatatcagtttgaaaatttgttgatttcttacttatataggggctaatatatactgtgaccaaaaaaatctttataaacaagattgggaggtttaacataaacattacctttatttatctcatttttaggcgactgagtcaaagaccaacaccagaagaactagaacaacgcaatatattgcaacgtgagtccagttatggaaataaagttgtatagattttctttgtatgtttctgactttaatatacataaaagaaaaaagaagcgtttgctacaagggctaagggagagtgttccagccaggcaaggactatttatttccccatgaaggaacagagcttaccaagcttcctttggaagatgctattatggtattgtttagtgtgctgtgatactctagaaagctttgtttcagtgttctcactgtatcctggaactgccttgggcatttgggaggctttgacagtatatgggagatgtgcccaatttttctgttttcagggagctaaggaggtagctgtgcatatggagaccttcctattcctagaatgtgagggctggggcccaaagcaagtcccaaatgcagcagcttttctcttggtttaatcccttaagactttcttacctctgtagttaccaaatgggaccatatatttaatttgctgtctgtgtacataattaatttcctgaaatagcattctaatctagtacatatttcatttgtttttccagaatatagagtgaaatttggccttaaaagtctcctcactgagaaggtttgggcttccttggggctatttgtgagcatgttcagtctgaccaatccatcccctgttctctcagcactacttgggtatacacaacttaataacttagtacattttctagtgtgggagcccttataacgtatcacacaaaactcagtgtgatcaccattgtccattcttagcagttactcttgagcaagaatctgcaggcttttccttaaagcatacatagtaaacattttgggttttgcaggccaaaaagcaaatgaacaactatacgtaataggtccttacaaaaccatttaaaaatgtgaagactattcttagttcatgggcaggaaaaatacaggcaactggcgagatgtggtgccatagtttgctgactcttgcttttaagtatttgtatcgttgacaagaaaattgttttgtttagccatccccaaagttagtattttattctgatttgggcctataagaaatatctgggccgaggcgagtggatcacaaggtcaggagatcgagaccatcctggctaacatggtgaaaccccgtctctactaaaaatacaaaaaaattagccgggcatggtggcgggcgcctgtagtcccagctactcgggaggctgaggcaggagaatggcgtgaacccgggaagcggagcttgcagtgagccgagattgcgccactgcactccagcatgggcgacaaagcaagactccatctcaaaaaaaaaaaagaaaaaaaaagaaatatctgggctgggcacggtggctcacgcctgtaatcccagcactttggaaggccgaggcgggtggatcacctgaggtcaggagtttgagaccagcctgaccaatatgatgaaactctgtctctactaaaaatacaaaaatcagctgtgcatggcatgtgcctgtaatcccagctactcgggaggctgagacaggagaatcgcttgaactcgggaggccgaggttgcagtgagccaagattgtaccattgcactccagcctgggcaacaagagcaaaactccgtctcaaaaaaaaaaaacaaaaaagaaatatctgtaatgtaattactaaaacgtttgatatgcaaattgtcatttgtgagtaatattccttccttctgattgtcaactgtagctaaaaatgaagctgatcgtcaggcagaaaaacgagaaattaaacgtcggctcactagaaaggtactactgcctgtgtgttcagttaactatatgtgttatatttggatggcctatttgattggaaatgaattcacagctgggcacagtggcttgcgcctgtaatcccagcactttggaaggccatggcaggaggattgcttgagcccaggagttcaagaccagcctggggaaaacagtgaaaccttgtgtctacattaaaaaaaaaaaaaagaagaagaaagaaaagaaaaagaaaaaaatgaatttgcagcctgggcaacatggcaagaccccacctctacaaaaaaaaatatatattagccaggcatggtggtatgcgcctgtaatatcagctacttgggaggctgaggtaggaggatcatttgagcttgggaggttgaggctgcagtgagctgtgattgtgccactgcactccagcctgggtgacagggcaagaccctgtctcaaaaaaaaaaacaaaacaaaaaaccacctgataaccataatcactgggggtgggacctccagggatcaatagtgtctaaagctcccccaggtgattccaatgaagattgaagcactgggttagaggcaatttgaatgcatgattgatgcctaattattggcttggtgaactaagaggctccgtttccttcagctcagtcaaaggccaactgtcgctgaactccttgccaggaagattctgaggtttaatgaatatgtagaggtaacagatgctcaagattatgaccggcgagccgacaaaccttggaccaaactgacccctgctgacaaggtacctggaaagcactctcttgctttttttctctttctctttttctctttatttggaggatccaagatactaactagaagggagaaccataaacaaaacttctagttttaatataatattaaatttcaaatcaagatacaaaatgccaagttgaacaagtcaaaatgttatactaactcagtatgttttggtaactccaccaccaatactgaaagaaagaaaatccctgctatctcacagagtaaaaatactggaaggaataaatacatttcaaacagtggttgtttggttagagggagtttgggctatatattttagtaattaccaatatttcatttttataatgctgtgaaaaactataaaagctggccaggcgtggtggcttatgcctgtaatcctagcactttgggaggccaatgcagagggatcactcgaggtaaggagttcgagaccagcctggccaacatggtgaaaccccatctctactaaaaatacaaaaattagctgggtgtgatggcatgcacctgtaataccagctacttggaaggctgaagcaggagaattgcttgaacctaggaggtggaggttgcagtgagccaagatcatgccaatgcactccagcctgggcagcagagtgagactccacctcaaaaataaaaataaaaaattaaaattaaaaaaaaaacaaaactagccaggtgcagtggctcacacctgtaatcccagcactttgggaggccgaagcaggtagatctcttgaggtcaggagttcaagaccagcctggccaacatggtgaaaccctgtctgtactaaaaatacaaaatagccggacgtggtagtgcgcacctgtaatcccagctattcgggaggctgaggcaggagaatcgcctgaacccaggagctgaaggttgcagtgagctgagattgcaccactgcactccagccccagcaacggagcgagattccatctcagggaaaaacaaaaataaaaacaaaactataaaagctacaatatatctttcaagattttcaagtattttgattaaactaaaaattttaggtttattatgagacagatgggtatcattgtgttgacctggtgtctgggttgcctgtgaggggttgcagtgacttacaaagttaaacacagtacagaaaaatgacaagttacactgctgtgcaaagcagccagaagaagctgaaacatttttgtctctactccacaggctgccataagaaaagaattaaatgaatttaaaagctccgagatggaggttcatgaagagagcaaacattttacacggtaagacccaaaagacccaatcatatatgtgctaggtagagttttccaaaaaattgttcagatatgaagggctctaatgacatcagtaaaaaggaaaacactcagtgttgattgcaagactgcattcaaagggatgaaaagtaagaagcaatagtaaatgcctaggccaggtgcggtggctcacgcctgtaatcccagtactttgggaggctgaggcaggtggatcacctgaggtcaggagtttgagaccagccggaccaacatggcaaaaccccatctctactaaaaatacaaaaattagctgggcctggtagcaggcgcctgtaatcccaactattagggaggatgatgcgggagaatcacttgaacccgggagatggaggttgtagtgagctgagatcatgccattgcactccagcctgggtgacaagagcaaaactccatctcaaaaaaaaaaaaaaaataagtaaatgtgtattctgattatggcatttcatgtatattatttaatccttgtaataaacatgcaagatgtgttaacatccccattttatcactgaggaaatggaggctcacaatggttaagtaacttggttgacttgctagtaaattgcagaaccaggattcggagaaagaaatcaatgacttcaaggatgtgaggtgctctcttccttgtaccttactctctcaggttataaatgaggagactgtgctaagttagacaagatcttgccctctctggttcagttctgtctagcacagttgatcttaccaacttaatgtataaacaacattttaattagctgtcttcatgaaacaagccaagaaatccaacaaagccaacaagccaacaaatcaagtgttttgatttggaattacggttgtgattaaggacccacccatatccaaagaatcagctagccacaaatggaatcagtgaaagtatctttacatgattcttagaacatttacaaaaagaggcaaatgaggctgagtgcagtggttcatgcctgtaatctcgacactttgagtggctgaggcgggaggatcgcttgagcacaggagtttgacaccagcctgagcaacatagtaagactccatccctacaaaaaaaaaaaaaatctattttttgatttaggcaggggcctggtgcagtggtacacacctgtaatcctagcactttgggaggccgaggtgggaggatcactttgagaccagcctgggaaacacggtgagccccatctctacaaaaaataaacttaaaaaaaaaataagcaaggtgcagccaggcgcagtggctcacacctgtaatcccagcactttgggaggctgaggcaggtggatcacttgaggccagttggagaccagcctggtcaacatggtgaaaccctgtctctactaaaaatacaaaaattagccgggcatggtggcatgcctgtagtcccagatacttgggaggctgaagcaggagaatcacttgaaccccggaagcagaggttgcagtgagccgagatcgcgcaactgcgctccaacctgggcaacagagcaagactgtctctcaaaaaaagaaaaagaaggaccagcttaagcaagacgatgggagagaggaaaacacatggtgtttctgggtaacagaaaatgtagctggatcagaggatgtttggggcagtgtggtgaaaataaactagaaaatgggttgcagtccctcgcaatgctttgactgttatgctaggatgttggaaccattggcagttcataagcaggaaattctgtgtatttcagaacaagctctgatgcaaacaacaaagatgatatggaaggatgaagagactagcagcaaggaaaacaggaagtatctgaaataatcttagtgagcatagtggtagctcacaccagagatagtgagaatgcaaaggtgatagatttgtaagacatttcaagcatagaatcaacaagatgtggcaatttgttggattccagagatgaaataaaggagtagtcaaaatgactctgatatttttaacttgtattttttgaggtctttgaaggtgataagtttagctgaacagtttagtttattcaacaaatactgagcacctaccacgataggtatagtgctaggtccttgggctacagcaggaaataagataaagtctctgtcctcaatgaggctttattctttttttttctttttttaatagagatggggtctcactatgtttcccaggctggtcttgaattcctggcctcaagtgatcctcccatcttggcctcccgaagtgttgggattacaagtgtgagccactatgcctggccaagcttttattctaaaagaagaaggcagacaatgaacaagctagaaaataaattgcatgtgtttagtttgaggagcctatgacacatggagatacctagaagaccattagatatgcagcctagaatccagaaagaaagcaaagtctcaagatacaaatgaaagaagatagtggacctttaggggggattttatttttatttatttattttttttttttttattttttgagacaaggtctcactctgtcacccaggctggagtgcagtggcatgatcgtggctcactgcagcctcaacctctcatgttcaagccatcctcccacctcagcctcctcagtagctgtgactacaggcacaggccaccacacctggctaactttttgatcatttgtagagacagggtctccgtatgttgcccaggctgctctcaaactcctggtctcaaatgatcttctcaccttggcctcccaaagtgttgggattgattacaggcatgagccaccgtgactggccaaggaaagttgttttttatttaaagggtagacagaggaaaatgaaccaggacagcatactgagaaagatcaattgaagaagagagaaaattatggaaaagatagtgttacagaagccaagagaagagttcttttttttttttttttttttttttgagacggagtctcgctgtgtcacccaggctggagtgcagtggcgcgatctcggctcactgcaaactccacctcccaggttcacgccattctcctgcctcagcctcgcgagtagctgggactacaggtgcgcgccaccacgcccagctaattttttgtatttttagtagagacagggtttcaccgtgttagccaggatggtctcaatctcctgacctcttgatccgcccgcctcggcctcccaaagtgctgggattacaggtgtgaaccattgcgcccagccgagaagagttttaagaaggaagcagatgaggagtatcagatgcaacagaaaggtcaggtcgaattagagcagaggaaaggcagtgttaattaggtataacatttcattactactgatacattaatagcaaagcaatgtacatcatgtggtaacttgtctcttttttaatctcttttagctaccatcgtccatgatgccaaaggttgagagaggaatcaacatggctgctttgctgcttccttctccaaagtgacatatggagggaactttagcacttcccagcacagccagaattgcatcctctgggatcttctgaggtggacagcactttgaatgtagcatttcactggaacagagtcttatgtgctgcaccgggggcaaaacaacactttgtcagtgcttttgaacctttcaatattgtagcatgcttgaggagtttttcccttactggccaccaaagttctgaaccacttgcaggttccaggttttactggctgcaccacaccccttcccctagatgactgcctgtgcagagacacagtttgcaccattagccttacctgccctgccctgattgtgagacccaaatgtgtaggctctaaattccagccatcaaatccaattcctggtggggaaaaccttctggagacccccaaccttctgataaaagagtctctacctccagggaaagccttcttaccacactggcatatcagatgaaagcattgcactgtacctctcgtaacacagcaatacagtcctcttgaggcactcaagcctgagaggaagctcaggatctgacatgttcttccttttcctcacaagtcatcatgattttttattttaaaataatctggaagtaatgggaacttagtttttcctgaactccaaccagaatccaaattggttagatgaggccaggcgcggtggctcacgcctgtaatcccagcactttgggaggccgaggtgggtggatcacctgaggtcaggagttcaagaccagcctggccaacatggtgaaaccccatctctactaaaaatacaaaaattagccaggtgtggtggcgcctggttgaggcatgagaatcgcttgaacccaggaggtggaggttgcagtgagccaagatcatgcctactgcactccagcctgggcaacaaagtgggactctgtcttaaaaaaaaaaaaaaaaaaaaaatcggttagatgagaaagcatgtatattttctatatacaaaaacaagaaaggcgttttgagcccctgtgctcaggcccactcccacactgtggagtgtactttcattttcaataaatccccttattccttccttgcaaaaaaaaaaaaaaaaaaagccttagccagattcagtggctcacgcctgtaatcccaacactttgggaggctgaggcgggtggatcacctgagttcaggagttcaagaccagcctggccaacatggcaaaaccctgtctctactaaaaagtaaaaaaaattagccgggcatggtggcttgtgccttgtagtcccagccactggggaggctgaggcgggagaattgcttgaacctgggaggtggagattgcagtgagccgagatcgcgccactgcactccagcctgggtgacagagcgagactccgtctcaaaaaaaaaaaaaaagccttaatattaatgctaacgtggcagaaaactagcaggttacattttataggctattgtagttttatttaccaaatgatattctctaaatcacttcgaccaataaatgtattctcctccttaaagcagagttgtatcaactctgtgggagcatttatgagctgtcagtccccacacttctagccagaatcacaataaggtctggctgggtgtggggtgctgcataggaaagggtctctggagaagcaagaagggcacaatcatggcccactgctcccctcttcttctcagtgctctttgccctctcctgctgcgtgcttcctcttcactccagtgctgatcctcctgctctctctggcagcttccacctcacccgcccctcttccacactataaccagtatggttggtgctggggcattgactcagcccccctgctttctgcatttgtaatagatattaatatgatttcctaaaacagaagattttgttgctttctttgaacttgtattgaaaaccatacagtctcactgttttgctttaattcctatccacactataaatggaagaaaaaaattaatagcttctgtttaatctgatgaatgtggctttttttcccttcactttaatgttcaagaagttgtggctatttcatagatttcttctgatttattctgtgggtccctgttatctgttctttatgtaatctttcagtagattttcatcctttcatatccacattcttatgtggacttgctgaagaaacagaatatcagttcaaaacaaaacctaggccaggcatggtggttcacgcctataatctcagcactttgggaagccaaggcggtcaggagtttgagaccagcctgaccaacatgatgaaaccctgtctctactaaaaatacaaaaattagcctggcgtggtggcacgcatctgtaatcccaactactcaggacgctgaggcaggagagtcgcttgaacccaggaggcggagattgcagtgagccaagattgcaccactgcactccagcctgggcaacagagcgagactccatcaaaaaaaaaaaaaaaaaagaaggaaggaaggaaagcaagccctgaatccacatctccttgaagttttttttgttttattttgtttttgagacagaattttgctcttgttgcccaggccggagtgcaatggtgcaatctcagctcactgcaacctccgcctcccgggttgaggcgattctcctacctcagcctcccaagtagctaggattacaggcatgagccaccacgcctggctaattttatatttctagtagagatgaggtttctccatgttggtcaggctggtctcaaactcccgacctcaggtgatccacccacctcagcctcccaaagtggtgggattacaggcatgagccaccgtgccgagccttccttgaagttttttgtttggttttgatttgttttgttttgttttgttttgttttgtttttggagatagggtctcactctgttacccatgctggagtgcagtggcacaatcttggctcagagcaacctctgcctcccaggctcaagcaatcctcccacttcagtctaagtagctgggactacaggcacgtgccaccaggcccagctaatttttgtgttttgttagagatgaggttttgccatattgcccaggctcgtcttgaacaccggggctcaaggaatctgcccatcttcgcctcccaaagttctgagatagcaggtgtgagtcatcatgcccagcctccttgaagtttactaacaattgggataactgagggaagagaagtgacaattccactcagtctattagaggtctggatataaggtagccacacaataactctaacttgacttctaaccattctatcttattgatttggaggctgtcttctgccagattttttgtggcttgagatgatattttcgaacccttctttcactacctttcttacccttaatgtgccaagcttgaaacaggatttgatttcctgagctacttgttcgccttctgtgcgtcaccaagtaatctggttcatctttcgtctcattcatgttattttcaagtgaaacaagacattttgggggtcaagtctctttgggtgttttgtttttatgtatataaaaatggattttgtgttccctttccatgtaagtaccaacttatatggaaactcacaatcataatgtaaagaagaaatgaaagcctggtgtattgtacttcaagatgcctccctgatgtatagaatctccttgtaaaataaataattgcattgtatatcagtcttcccatcaatattaattattaaatattttagaatttttaaataccaactata

SEQ ID NO: 190 - DNA, 4950 bp, Homo sapiens
gattctctaactgcgcatgcttctgcgcacgcgcaatagacattccaggacttccgggcacttcgtaaggtttaaaaaggatgcttcgcgttttctctctcctttttggagacagattcgcagtggtcgcttcttctccttggtaagtgtgatccttggtaagtgtgatcagatgcttgccaccggagttgtgggtctaatgctatagatcagtagccgagcttccctaggaagatcatatagtattttatttatttactttttttttttttttgagacggagtcggtttgtcactcaggctggactgcagtgctcgttgcaacctccgcctgccgggttcaagcgattctcgtgcctcagcctctccagcagctgggattacaggcacgtgccaccacgcccggccaatttttgtattcttagtggagacggggtttcgctatgttggtcaggctggttttgaactcctgatttccggtgatccaccaccctcggccttccaaagtgctgggattacaggcgtgagccaccgcgcctggccggaaatcatgtaatttaaaactatatatgggtgtcttaggcggcatcggtcccaactctaaagtacgcgttagacgggcctgggccagaagtgggccatggagacctcgggacccgcagggctgccgcccgacccagcgagcctctgaaggtgcaccgccacccccactgtttatcttactgcctcatagtaggcacattgtcgttctcaatataattgcacacagttttattctggatcctcatttgcctttaagaattttctcaatttttctttttatttgatcgcaccactgcaacctccgcctgctgggctcaagcaattctcctgccgcagcctcccgagtagctgggactacaggcgtgtaccaccgcgcctggcttatttttgtatttttagtagagacgggatttcaccatgttggccaggctggtctccaacgcctgaccttgtggtccgccacgccaggccgaagattttcataatttggaagcattgcgtttcgtaattatgctttctcgtatttttgtgatttgggtcatttttatttttatatttttaggattacaggcgtgagccatcgtgcctggccgatttgggggtaattaacaagtccacgtgtttcatttgaatttaggatagctgggcctaattgttgtctttgcttctgcggtaccttccacatagtactaaccgcctattgtaaagtaattagaatagctgaatatgcatgttaccagtctagaaaccgatttttttttaacaccccactgtggacagggtggaaactcgtttgctttcttgtttaagatctgtagtaacatgaatggatgaaattgtttcctattggattctgtaaatttatgcgttacactgattgtccaacgtggatacacccgggaggtcactctccccgggctctgtccaagtggcgtaggggagcatagggctctgccccatgatgtacaagtccctttccacaacgttggaaataaagctgggcctcgtgtctgcgcctgcatattcctacagcttcccagagtcctgtcgacaattactggggagacaaaccatgcaggaaacagccttctagagcactgaatctggattgaagtctttttttttttttttttttttggagatggagtcgctctgttgcccaggctggagtgcagtggcgcactccattgcctctgcctcccgggttcaagtgattatgctaagtgattctcctgccttggcctcctgagtagctgggattacaggcccccgccaccacgccaggctaatttttgtatttttagtaaagacagggtttcaccatgttggtcaggctggtctcaaactcctgaccttgtgatccgccagcctctggcctcccaaaatgttgggattacaggcgtgagccaccacacctggctggattgaagtcttaatacatgtttaagaaaaattggctaaaaagtagccaggcatgatgataggtagctggaggaaggagaatcgctggagcccaggagtgacctatactcaaacctatactccagtgccactgtactccaaccccaggcgatagcatgaggcccctcgttgaaaaagtttagggttttgctgtactaatagattaatatcttgttttgcaggatttgttaaggattccaagtaactcttatttggtgagtaaatctgctaattgttttttgcttatcagctctttgtcaatgatttctgtaatggaaataggattgaagagacttttattctagttggtcaggatttacctctgaggcatttaatcattctcagagcaatagccaaatatcgactttgctgcatttttgtaggcatgttgacataacttcaacatatgctctgttctgtaaaaattgctttttttagtcagctcattaaaagtgcaaagtagtaaaagctgccctagtgaactgtaggaagcctaattggctttatctacatgtgtagcctgagctgagaaagatactagcccttgaaaatactgtgggtgattagcaatattggatttgtcggttactccaattcctcactaatgagcattccaacgtggataccctgggaggtcactctccccaggctctgtccaagtggcataggggagcttagggctctgccccatgatgtacagtccctttccacaacgttgaagatgaagctgggcctcgtgtctgcgcctgcatattcctacagcttcccagagtcctgtggacaatgactggggagacaaaccatgcaggaaacatatctagtatactagattttaagttgaagtaggatcttcaggagtctaatcattatttcttttcttttaggagagaagacgatctgcacttcgcattttggcattgacatttaattttagggtcctttatatagaagggagagtaggtaaactgatttttttttttaacagggagggtttgacaatctttggcagacttggagcaaaagattgaggtgcatttcatgcctccttttgagagtcttgctctgtcgcccaggctgtagtgcagtggcgcaatcttggctgcaacctcagcctcccaagtagctgggattacaaacataagccaccacgcccagccctcatacctcttttaaaagtcgacctgttttgcagaaagtctgctgtttttgtactaaaggctttggaatttggcatttagctaggaatgcacattctttcacctcattcatactttaagaaccacagaagtgactctgcttggccagaaggcacactgtgttggtggttatattaaaagtccttgagtattttgcttttcatgatcttgctcactgcaacttccgcctcccaggttcaggcgattctcctgcctcagcctcccaagtagctgcgactacaggcgtgtagcaccacacctggctaatttttgtatttttagtagagatgaggtttcaccatattggccaggctgttctcaactcctgacctcgtgatccgcccacctcagcctcctaaagtgctgggattacagctgtgagccaccctgcccggccacttttgtatgatttctaatgtatttgtaatttacctaacaaattgcctaatctgctatgttaatgtatttatgaattaaaataaatacgactgcatgtttgtggttcatttttgtggaggtggctgtggtgacatcagccaagaatctgaatggtactgttgaaggaaactagcatgatagcttcagttctaaaggccctgaaacctagtctcaggtgggtcccccttgggttcactttatattggcagtttattgggaaaatggatattaggtcctgaccaataggaccgtaagtctgggttgagtgcaagatgagttagaccgattctttagcttcctgcagtgtagtggaggaaaaatcgatggtagcaacgggaggttgtatccctagctgatgagttgtatgagcctctactacctggcgcacctccgcctgaagattgccagaattgcttgcctcatgacgtgagtcacaatggaaactttgtcaagccccctgcactggctgccaacataaatgttcagtaccctgaaggatgggactgaagggggatcatctagaaggtaaagttacctactggcataggggaggtgggacagccgttaagccatttggaacttgatggagacaggtttgagggaggtgggtgagattggagtttggtggactgtagagcttgcttgccaaggtgttgaggtcagggttggtttgagaatggaagctagttactagctatgattgtgggggaacacagcttgatttttcttacaagctaagaggagtgaggcagtgtttaagagggcatgttaaatgcagccaggcttggtggctcacacccgtaatcccagcacttaggctaaggcaggcggatcacaacatctagagatcctggccaacgcggtgaaaccctgtctgtactaaaaatacaaaataactgggcatggtggtgtgcacctgtgggaggctgaggcagaattgctggaacccgggagatggaggttgtactgagctgagaccttgccactgcgctccagcctggtgacagagttaagtctcaaaaaaaaggcatcttcctaaagcaattgtatttgtgcttacctgtgccaggcactgttctaggtaagcactaagtgggctttaatacagcatattccaatggggaatcccaggaaccaaaagactaattgtccaagtccacaactagaagtggcacctctgcagaaacaagcatcaaattccctgctcaggaagaagccagatgagtcagccccattcgtctgtatgcccagtcccatccgtgtcctgctgtaactacatagatctcacctgagtaaagtgatttttttctgaa

SEQ ID NO: 191 - DNA, 4950 bp, Homo sapiens; identical to SEQ ID NO: 190

SEQ ID NO: 192 - DNA, 33254 bp, Homo sapiens
gattctctaactgcgcatgcttctgcgcacgcgcaatagacattccaggacttccgggcacttcgtaaggtttaaaaaggatgcttcgcgttttctctctcctttttggagacagattcgcagtggtcgcttcttctccttggtaagtgtgatccttggtaagtgtgatcagatgcttgccaccggagttgtgggtctaatgctatagatcagtagccgagcttccctaggaagatcatatagtattttatttatttactttttttttttttttgagacggagtcggtttgtcactcaggctggactgcagtgctcgttgcaacctccgcctgccgggttcaagcgattctcgtgcctcagcctctccagcagctgggattacaggcacgtgccaccacgcccggccaatttttgtattcttagtggagacggggtttcgctatgttggtcaggctggttttgaactcctgatttccggtgatccaccaccctcggccttccaaagtgctgggattacaggcgtgagccaccgcgcctggccggaaatcatgtaatttaaaactatatatgggtgtcttaggcggcatcggtcccaactctaaagtacgcgttagacgggcctgggccagaagtgggccatggagacctcgggacccgcagggctgccgcccgacccagcgagcctctgaaggtgcaccgccacccccactgtttatcttactgcctcatagtaggcacattgtcgttctcaatataattgcacacagttttattctggatcctcatttgcctttaagaattttctcaatttttctttttatttgatcgcaccactgcaacctccgcctgctgggctcaagcaattctcctgccgcagcctcccgagtagctgggactacaggcgtgtaccaccgcgcctggcttatttttgtatttttagtagagacgggatttcaccatgttggccaggctggtctccaacgcctgaccttgtggtccgccacgccaggccgaagattttcataatttggaagcattgcgtttcgtaattatgctttctcgtatttttgtgatttgggtcatttttatttttatatttttaggattacaggcgtgagccatcgtgcctggccgatttgggggtaattaacaagtccacgtgtttcatttgaatttaggatagctgggcctaattgttgtctttgcttctgcggtaccttccacatagtactaaccgcctattgtaaagtaattagaatagctgaatatgcatgttaccagtctagaaaccgatttttttttaacaccccactgtggacagggtggaaactcgtttgctttcttgtttaagatctgtagtaacatgaatggatgaaattgtttcctattggattctgtaaatttatgcgttacactgattgtccaacgtggatacacccgggaggtcactctccccgggctctgtccaagtggcgtaggggagcatagggctctgccccatgatgtacaagtccctttccacaacgttggaaataaagctgggcctcgtgtctgcgcctgcatattcctacagcttcccagagtcctgtcgacaattactggggagacaaaccatgcaggaaacagccttctagagcactgaatctggattgaagtctttttttttttttttttttttggagatggagtcgctctgttgcccaggctggagtgcagtggcgcactccattgcctctgcctcccgggttcaagtgattatgctaagtgattctcctgccttggcctcctgagtagctgggattacaggcccccgccaccacgccaggctaatttttgtatttttagtaaagacagggtttcaccatgttggtcaggctggtctcaaactcctgaccttgtgatccgccagcctctggcctcccaaaatgttgggattacaggcgtgagccaccacacctggctggattgaagtcttaatacatgtttaagaaaaattggctaaaaagtagccaggcatgatgataggtagctggaggaaggagaatcgctggagcccaggagtgacctatactcaaacctatactccagtgccactgtactccaaccccaggcgatagcatgaggcccctcgttgaaaaagtttagggttttgctgtactaatagattaatatcttgttttgcaggatttgttaaggattccaagtaactcttatttggtgagtaaatctgctaattgttttttgcttatcagctctttgtcaatgatttctgtaatggaaataggattgaagagacttttattctagttggtcaggatttacctctgaggcatttaatcattctcagagcaatagccaaatatcgactttgctgcatttttgtaggcatgttgacataacttcaacatatgctctgttctgtaaaaattgctttttttagtcagctcattaaaagtgcaaagtagtaaaagctgccctagtgaactgtaggaagcctaattggctttatctacatgtgtagcctgagctgagaaagatactagcccttgaaaatactgtgggtgattagcaatattggatttgtcggttactccaattcctcactaatgagcattccaacgtggataccctgggaggtcactctccccaggctctgtccaagtggcataggggagcttagggctctgccccatgatgtacagtccctttccacaacgttgaagatgaagctgggcctcgtgtctgcgcctgcatattcctacagcttcccagagtcctgtggacaatgactggggagacaaaccatgcaggaaacatatctagtatactagattttaagttgaagtaggatcttcaggagtctaatcattatttcttttcttttaggagagaagacgatctgcacttcgcattttggcattgacatttaattttagggtcctttatatagaagggagagtaggtaaactgatttttttttttaacagggagggtttgacaatctttggcagacttggagcaaaagattgaggtgcatttcatgcctccttttgagagtcttgctctgtcgcccaggctgtagtgcagtggcgcaatcttggctgcaacctcagcctcccaagtagctgggattacaaacataagccaccacgcccagccctcatacctcttttaaaagtcgacctgttttgcagaaagtctgctgtttttgtactaaaggctttggaatttggcatttagctaggaatgcacattctttcacctcattcatactttaagaaccacagaagtgactctgcttggccagaaggcacactgtgttggtggttatattaaaagtccttgagtattttgcttttcatgatcttgctcactgcaacttccgcctcccaggttcaggcgattctcctgcctcagcctcccaagtagctgcgactacaggcgtgtagcaccacacctggctaatttttgtatttttagtagagatgaggtttcaccatattggccaggctgttctcaactcctgacctcgtgatccgcccacctcagcctcctaaagtgctgggattacagctgtgagccaccctgcccggccacttttgtatgatttctaatgtatttgtaatttacctaacaaattgcctaatctgctatgttaatgtatttatgaattaaaataaatacgactgcatgtttgtggttcatttttgtggaggtggctgtggtgacatcagccaagaatctgaatggtactgttgaaggaaactagcatgatagcttcagttctaaaggccctgaaacctagtctcaggtgggtcccccttgggttcactttatattggcagtttattgggaaaatggatattaggtcctgaccaataggaccgtaagtctgggttgagtgcaagatgagttagaccgattctttagcttcctgcagtgtagtggaggaaaaatcgatggtagcaacgggaggttgtatccctagctgatgagttgtatgagcctctactacctggcgcacctccgcctgaagattgccagaattgcttgcctcatgacgtgagtcacaatggaaactttgtcaagccccctgcactggctgccaacataaatgttcagtaccctgaaggatgggactgaagggggatcatctagaaggtaaagttacctactggcataggggaggtgggacagccgttaagccatttggaacttgatggagacaggtttgagggaggtgggtgagattggagtttggtggactgtagagcttgcttgccaaggtgttgaggtcagggttggtttgagaatggaagctagttactagctatgattgtgggggaacacagcttgatttttcttacaagctaagaggagtgaggcagtgtttaagagggcatgttaaatgcagccaggcttggtggctcacacccgtaatcccagcacttaggctaaggcaggcggatcacaacatctagagatcctggccaacgcggtgaaaccctgtctgtactaaaaatacaaaataactgggcatggtggtgtgcacctgtgggaggctgaggcagaattgctggaacccgggagatggaggttgtactgagctgagaccttgccactgcgctccagcctggtgacagagttaagtctcaaaaaaaaggcatcttcctaaagcaattgtatttgtgcttacctgtgccaggcactgttctaggtaagcactaagtgggctttaatacagcatattccaatggggaatcccaggaaccaaaagactaattgtccaagtccacaactagaagtggcacctctgcagaaacaagcatcaaattccctgctcaggaagaagccagatgagtcagccccattcgtctgtatgcccagtcccatccgtgtcctgctgtaactacatagatctcacctgagtaaagtgatttttttctgaaccagtggttttagtatgttttcaatccatatactcaggtgggtttgggtaactgcagtgctgggcaggaaatgaatgaatttctattgacttgcaaggtagaggtgaagcaaagctgtcagtaggtgttcaggtcccactctgctaaacttcagcttgcaataccccttttttagactttccaaacaggcacttctggccttgttctttgtgtaggcagacagtattggttgcctatcttaggagtactagactgggtttgaatcctgatcccaccacttgctgttcatgagactttgggtgagttactcagcccctctgcctcaatttcatgttcacaaaataagtgataaactacctcatagagttgtaataaggacaaaggagttggtatttgtgaaaagattcttagggtctctagatggagtgcagcagcatgatcacttattaaataacattcttttgtgacttctcagaaaccaaggatacagtatccaattttttgttttttgtttttttttttttttgagagggagtctcgctctgtcgcccaggctggagtgcagtggcacaatctcagctcactgcaagctcagcctccccagcagctgggactacaggtgcacgccgccacacccggctaatttttttgtatttttagtagagaaggggtttcaccatgttagccaggaaggtctccatctcctgacctcgtgatccgcccacctcggcctcccaaagtgctgggtttacaggcgtcagccaccatgcccagcttttttttttttgagatctaatctcactctgtctccaggagggagtgcaatggagccatcttggcttgctgcaacctccacctcccgggttccagcaattctcccacctcagcctcccaagtagctgggattacaggcgcacgccaccatgcccggctaattttttttgcattttttagtagagacgggtttcaccatgttagccaggctggtctcgaactcctgacctcaagtgatccacctgcctcagcatcccaaagtgttgggattacaggcgtaagccactgcgcctagcctcaagcctgatccttttttttttttttttttttgagatggagtctttgcctcccaggctggagtgcagtggcgtgatctcagctcactgctacctctgcttcctgggttcaagcgattctcctgcctcaacctcccaagtagctgggattacaagcgcctgcaccgcacccggctaatttttgtgttttttttttcagtagagacagggtttcgccatgttggccaggctggtctcaaaactcctgacctcaggtgatccaccacgcccggcagagccttgatctcttaaccactatcctcacctcccctttccctaaggatccacaatggcctcactggctcttgaaggcaggctggcaccttgatcattcttcctggtcattagtattctgatctggttattttccattttatgtccatctaacctacttggaggatcctcaagagactgcatatgtaaactcagtacttattcttgtactgtgcctgccatatagcaagcactggctgatttaatttttctgtgttcttttttattgatttgtttttatctttattattttctttgcttattttggggttagtttgctcatctattcctagtttcttaagctagtagctgagctcattgattggagacctttctttttttctaatgtaggcatttagtgctataaatttcctccagatactgttaacaacacacaaattctggtatgttttgttttcattttaattcatttcaaaatatttttgagttccttttctattctttgatctatgggctacttgaaagtgtattattgttgttgtattagtgttgttcaaatctatccttgctagtttctttttttttggagactgcgtctccaaaggctggagtgcagtggcacaatcttggctcactgcaagctccgcctcctgggttcacaccattctcctgcctcagcgtccccagcagctgggactacaggtgcctgccaccatgccctgctaattttttgtagagatggggtttcaccatggtctcaatctcctgaccttgtgatccacccgcctcggcctcccaaagtgctgggattacaggtgtgagccaccgcgcccagcctcttttttttttttagacaagagtctcactctgttgccaaagccagagtgcagtggcacaatctcagctcactgcaacttctgcctccggagtagctggaattacagtcacgcaccaccacgcccagctaatttttttgtatttttagtagagatggggtttgcgcggctgaagtgcagtgatgcgatctcagctcactgcaacctctgcctcccaggttcaagcaattttcatgcctcagcctctggagcagctggtactacagcatgcaccaccatgcctggctaatttttttgtattttagtagagatggggtttcaccatgttgcccaggctggtctcaaactcctgagctcaggcagtccgcctgccctgacctcccaaagtgctagaattacaggcatgagccaccgtgcctggccttattttaaaattttatttcttgtaggtaacatgttgggtttttcagtatgacagtctatgtcttttaattggagtgtttaggctatttactttttttttttaagacagggtctcactctgtcacccaggccagagttcagtggcaagattatgactcactgcagccttaaactggaactcctgggctcaagccatcctcccagctcggtctcctgagtagtgaagaccacaggcatgtgccactatggctggctaaattttgtattttttgtagagacaaggtctcatgatgttgtcccagctggtcttgacctccagggctcaagcaatcctcccaccttggcctcccaaagtgctaggaatacaggcatgagtcaccatgcccagccatattatacatttttaacttacaatagtccacattcaattgatattaaaccagttcacttgtagtataagaatcttccccagcctggccaatatggtgaaaccccgcctctactaaaaatacaaaaaaaaaaaaattagccaggtgtggtggtgctcgcctgtagtctcagctacttgggaggctgaggcagaagattgcttgaacctggaagcagaggttgcagtgagctgagatcgtgccagcctaggcaacagagcaagactccgtctcaaaaaaaaaaaaggcggggcccggtggctcacgcctgttatcccagcattttgggaggccgaggcgggcggatcacgagatcaggagatcaagaccgtcttggctaacacggtgaaaccccatctctactaaaaatacaaaaaattagccgggcgtggtggcgggtgcctgtagtcccagctactagggaggctgaggcaggagaatggcatgaacccaggaggtggagcttgcagtgagccaagatcgcgccactgcactccagcctgggcgacagagcgagactccgtctcaaaaaaaaaacaaaaaaaaaaccttctggcggcctggtgtggtggctcacacttgtaatcccagcactttgggaggctgagactggcggatcacctgaggtcgggagtacaagaccagcctgaccaacatggagaaaccccgtctctactaaaaatacaaaattagccgggcatggtggcacatgcctataatcccagcaactcgggatgctgaggcaggagaattgcttgaacctgggaggcagaggttgcagtgagccgagatcatgccattgcactccagcctgggcaacaagagcaaaactccatctcaaaaaaaaaaaacaatcttccggctgggcacagtggctcacgcctgtaatccatcccagcactttgggaagccaaggcaggcagatcacgaggtcagagcgagactccgtctcgaaaaaataaataaatatttcttccatttctcactatatagtctttgatattgtcatgtgtcttacttttatatatgttataaaacccacagtacattattacagccagaacctccatatcagccagttgcgatggctcactcctgtaattccaacactttgggatgccaaggcaggctgactgctgaggctcagaagttcaagaccagcctggccaacatagtgaaaccctgtctctaccaaaaatacaaaaattagatgggcaattagctggacgtggtggtgcacgcctgtaatcccagctactcgggaggctgaaacaggagaattgcttgaacccaggaggcagagattgcagtgaactgagatcacgccattacactccagcctaggcaacagagtgagactccgtctcaaaaaaaaaaattagctgggcatggtggtgcacatctgtggtcccagctactcgggaggctgaggcagaggttgcagtgagccgagatcctgccactgcactccagcctggatgacagagtgagactcttgagacaaacaactggggctgggcgcagtagttcacacgtgtaatcccagcactttgggaggccgagatgggtggatcacttgaggtcaagagctcaagaccggcctggccaacatggtgaaaccctgtctctattaaaaatacaaaaatgagccgggcatggtggtgcgtgtctgtaatcccagctactctggagactgaggcaggaaaattgcttgaacccagggggcagaggttgcagtgagccgagattgcaccactgcactccagcctgggcaacagaatgagactccatctcaaaataaaataaaaaatacaaatacaaaactaaaaaaataaaaataaaggccaggtgcagttgctcatgcctgtaatcccagcactttgggaggccaagatgggcaggtcacctgaggtcgggagttccagaccagcctggcaaaaatggtgaaacccggtctctactaaaaatacacaaaatggccaggcgcggtggctcacgcctgtaatcccagcactttggtaggctgaggcgggtggatcacctgacgtttaggagttcaagtccaggctggccaacatggtaaaaccccgtctctactaaaaatacaaaaattagctgggcatggtggcaggcgcctgtaatcccagctactcaggaggctgaagcaggagaattgcttgaacccaggaggaagaggttgcagtgagctgaaatcgtgccattgcactctagcctgggcgggtcaggagttcgagatcagcctggccaacatggagaaaccccatctctactaaaagtacaaaaattaaggctgggcgcggaggctcacgcctgtaagcccagcactttgggaggatgaggtgggtggctcatgagatcaggaattcaagaccagcctggccaagatggtgaaaccctgtctctactaaaaatacaaaaattagctgggtgtggtggcaggcacctgtaatcccagctacctgggaggctgaggcaggagaattgcttgaacctggctgcagtgagccgagatcgcaccactgcactccagcctgggcaacagagtgagaccccatctcaaaaaaaaaaaaaaaaagagttgaggtctccttccaccacttgtgtgaagaccccagaaaacttgctttacctctttaaacttcagttttcttatcttccaactgccatgaggtttttgtgaggaacaaatgagctgacatggatgtttctgtagttaacaaaataaagggtcttacaaaataggcaataataataataatcacttattattattacatgaagctacatgaatgtgtaagatcttggaggaagacagcagagagagagagagagatcagagatcccagggttaaaagttggagaaatttcacagtacatcatccaaaagaggagtccatgatggaggcagaggtaaacttggagaggtaagaaaccctgaagacaggggagtgctttgtggcaggctctgcatataagaattcagcctggccaacatggcgaaacccagtctctactaaaaatacgaaaattagccaggctttgtggcaggcacctgtaatcccagctatttgggaggctgaggcaggagaatcgcttgaacctgggaggcagaggttgcagtgagccgagatctcaccattgcactccagcccgggtgacaagagcaagactcgatctcaaaaaaaaaaaaagttcagttcagttggtaagaactcatcaaaagtgtccatctagactttgggtgccgtagaatgactcagagtctgaatcaacatgaaatcgagaaaacgtcctttgcaagggtttcagggaacacctgaaatcctgaagaactgtttgtatccatcctgaagaatgggtgttaataagagacagccttttcttggtacctgttttccatctctaacccaaccccaactcacacccttctattttatctggtctctctcattcctcttgctcctccccacttggctcccgttttccccaagtccattctctattttgttctataagatctgatcatattaggatgctcttgtagctcataagaagatgactgggtgttcacacgcatatgagatgtgcctccctcaaaccttgttaagacatgggcacatacccatctgatgttaactcacggggaaaaaaatctgatcatgccattcccgtgcccaaattcccatatatccctactgcctcaggatagaggctggaccccttagacacacaagaccctgtatccatgatctgtcactcccacaggcaccctctactcccatctacttggcagtttcccacaacctccctgggttctcgtggttccctgtcattgcaaacgtcgcttctcctaggatgtcctgcccccctagacttaacttggaaagctgttcttaagccccggactgagtcagatgcccctctgggtatccctgtcatagcgttgtgtggttgttgatagtctgatttttcaaccttctccatgccctcttgagggtagggaagatgagtatcttttttctccgtacagaccctaccgcacaagattttcctaaacagaccgaactcaaggagtctttctggttgttagtccacgtgtcccgatttggggtttccaaaatacacgcccactggaaccgggccaggggagccagcctggccaagggctcccccagcccggccaagggctcccccagcccgggagcgcgccacatgcagatcctgggatggccgccaggggccgccgggctctttgttttcctttctcacccgggtcggggccagaggcctgcagagcgcatgctctggggcagttcgcggcccggcggggagcgccggagttccttgtggccgacgtgcaccaaggtaggtctcgcctgggacgcgcggagggtccgggcagagggcggtaagcggagcggccacagccggagcacgggccggtccacgcgggcctaagtcgctgcccgctctcgcccgtgtcgcgcggcgccggccccacgtgaagcccggaggcaggaaggcgcggtgcgggctcgcgattccccggccccgcggggcgctccagcagcggctgggcgctgcctcgctggagctagggccgcgcggcccctccgccgccgcgcctctcacgcccgcaccgcggcgcccgcgcaggcgggagattcaaactgcgcgagcgcggcgggccgggtgcgcgcggccgcccgggcgggggatgggtctctgccgcgaggaggatggttttgtccggcatgcgcttggagaaggcggtttgcagatcggggagggagccctgcccgggagagggtgggtcgtaggagctcgagggtctcccgctgtggacctttgggagccgtgtgtcttgaactccgcagcagctcagtctgtcagcagattatttgctggccatttattgcgtccctctcttgcggggctgggggacagtagtgagaagagcaggcccgtgtcattagcgaactatgcccttgaacccaggcgacggacgctactggcaagtcattcatacgtcacatattgacctaacttcgaccacgtgtgacttgtgtgccctagcagaagttgagtgtgtggggtgttacggggagccctcagggggatcccccaccctgcccaggaggctcagggatggctttccaggtgaagtgactcttgaatggggttttgaaggaacagagtttttcaggcagtctgagggtagtgggattagggtgatacaggcagagggattgcacgtgcaacggcatgaaggtataggtattgtggtcagggataccacaggtcttgaggtgactggaggaggagagtaacaagatgatacagcaggggctgggtcacgaagcgtcttgtgtgcaagactaaggaactctgcggggtggaggaggcagggaagatttcccccaagaagggtatcagagtgaaacctggacagatgaattaggagttcacgaggctcctgtttcaaagacatcccaagagcaggaatcctgttctgttcatcgttacaactttctcatcagatgcccttgggcaacccacccagtcccccagagcattggtttccttatctgtaaagcaatggtagggggcatgtggtgaggatataatttttttttttttgagacggagtttccactcttattacccaggctggagtgcagtggcgcgatctcagctcactgcaacctccacctcctaggttcaagcaattctgcctcagcctgctgagcagctgagactacaggaacacaccaccaggcccagctaatttttgtatttttttttttttagtagagacggggtttcaccatgttggccaggctggtcttgaactcctgacctcaggtgatccacctgcctcagcctcccaaagtgctggaattacaggtgtgagccaccgcacccggccaattttttttttttttctgatacagaatcttggtctatcgcccaggctgtagtatagtgtcgtgctctcagtcgctgcagcctccacctcccgggttcaagcgattctcctgtctcagcctcccgaatagtaatatcctataattttcataaagcagtgaagttgtgtgtcccttcccccaggaaaaatgaacacataggcccaggcacaggttgtatagaacggggatcccaggtgagaaactcctagtgtgaaatataccacctgtgtgcctggcataacagcagctcaccaaatgtatattgttgacacatgagccctctcctcccttccctcctggggaccttacacacagagatttttcagccttagtctggcaggcaagttcttcctcctggtgtgggggacggagggcacagctgcagtggcctgggagggctctgtctccttttacagaaatcgaggctgtggtgaggtcactggaggtcagggcaggagcaccaggctccgggcagactgtctagactggcgtgcctacccactttcttcaataaataaggaaggtgaggtgggggtagggcagctccagctctggtggagcatggtcatgagactgggatttcattccacctctctgtgacctgggtcacctttccctgagcctcatcttccccttagctgtaaaactgggatgagtctgctcacctcaaagggcagctgtgggcattcaggagtgcctgatggtggaagctgactctgtagccgacttatctgtgactgtctcactcttctcccagagactgtatgctccttgaagatggaagctgtgttgtgtggggcggggtggggaagcatgatgccaaaagccaactccttattcccagcccagacactcactgcctggttaagaaaacagccagagaggccgggctcggtggctcacgactgtaaccccagcaatttgggaggccaaggtgggcagatcacctgaggtcaggagttcaagaccagcctggccgacatggtgaaaccccgtctttactaaaaataccaagcagttagccaggcgtggtggcttgcgcctgtagtcccagcactagggaggctgaggcgggagaatcgcttgaacctgggaggcggaggttgcagtgagctgagatcgtgagtctgaactccagcttgggcaacagagtgaggctccatctcaaaaagaagaaaagaaaagcaaataaaggaaaacacacccagagcagtgagagaagtctgtatacaagacccatttgtgcagtagaggctgtgcaggcaggtaccgggaacagggctccaccttttagaaggtggtcctctggccgggagcagtggctcacgcctgtaatcccagcactttgggaggccgaggtgggtggatcatgaggtcaggagatcgagaccatcctggctaacacggtgaaaccccgtctctactaaaaatacaaaaaattagctgggtgtggtggcaggcgcctgtagtcccagctactcgggaggctgaggcaggagaatggcgtgaacctgggaggcggagcttgcagtgagccgatatcgcgccattgcctccagactgggcgacagagcgagactccacctcagaaaaaaaaaaaaaaaaaaaaaagaaggtggccctccatcccctgcccttccctggcgattgccagcccagtgcagggcctcaagtcttccattttggagaggaagcctctgggactcaaagagcactcaggtgccgtctccaccgcagcagggagttgtcgccactgtccttccccacatctgtgggtggatctgtcaccacccaccccaccttccctcaggctctagctgcctcattgtctcctctctggtctcaccatcctctcctcagctggcttctgctctctgcttcttggacttggccaagtgcataggggatactggggaggcctgcccagactgccttagcccctgcctggaccaaggtctgccttcagaatcagtcagataggcctgggttgcttttctaggctgccctttacttgctctgtgaacttaggccgataaagttatctttctgagcctcagttccttaactgtgaaataggagtgacagtgctgccttcttcagcttcctgtgaggaataaaagggttttgcatatggaagatacagtgagttagccggtgcccccaggggctcatattttaggaagttgattggtatggtggacaggcatgtaaattaaagtgattgtgatccaaaagtctgtcccagtttctcagagagaatgactagttcaggatggaggagggatcagaggaggtgactttgagacaccagtagatgttcttccagtgggataagggatgggaaggcgttccaggtaaagagatgcaaatagtatggagaggacagttagcattctggcctggtgggtctggcaaggagattgtgtgggaagagaagggaggatgtgatagataggaaatgaagctaaaggttctgtcagtacccgatgttggagacctctaatacccagctaagaaatgtgggctttatcttccaggaaaaggggaccactaaggagtccaagcaggccagcagcttgcttcaggtttgaggtttggaaagatcatgaatgaggccgggcatggtacctcacgcctataatcccagtactttgggaggtcgaggtgggaggatcacttgagcccgggagtttgagaccagcctgggcaacatagtgagaccttgtctctacaagaaaaaaaaaaattacaaattagccaagcgtggtggtacatgcctgtagtcccagctactctggaggctgaggcaggagggtcgcttgagcctaggaggtggaggttgcagtgagccgtgtacgtgctgctgcactacagcctgggcaacagagtgaaaccctgtctcaaaaaaaaataaatatatatatgtatatatatacacacacacatatttattgatcacgaatgacttggagaatgagaggaggggatgagggtggggaccggaagaccagtgaaaagttgctgtctttcctagggaaaggaggaggagacacagttccaggcaagctgagagactactagggagcatggggaggaaggaggcagaagaaatttcttttttttttttttttttttttgagacggagtcttgctctgtcacccaggctggagtgcagtggcgtgatctcgactcactgcaagctctgcctcccgggttcacgccattttcctgcctcagcctcccgagtagctaggactacaagcgcccgccaccacgcctgtctaattttttgtatttttagtagagacggggtttcaccgtggtctcgatctcctgacctcatgatccgcccgcctcggcctcccaaagtgctgggattacaggcgtgagccaccgcgcccggccagaagaaatttctaataacactcaaggacgccagctctggagtctgactaacttggttcagatcttggccttctcttccaatcttgagtgagatacttcacctttctgagcctcagttttcttctctgtagagtgggatcattgtggccagcttgtagtgaaacgctccagaatattagccaaacacaactaaggagatgttgactgggtttgttccatccatgataacagattttttggttaatgccccatgacaccaacacttcatatagcccttatgtgtctgactccattccgggctgtgctcatggcagcccagccatcagcaccaactgtgctgacataattgtttcctgctttttctcctgacttcttattgtgagtacttttcatgctaatacagtctccctcccaggcacagcagactgctacagattattctgatgaactgatgagatgtttgccttggcatacagctgtctatctaaaacaagggtgcctctttttttggtggagggacagagtttcactcttgttgcccaggctggagtgcaatggtgcaaactcggcttaccacaacctccacttcctgggttcaagcgattctcctgcctcagcctcccgagtagctgggattacagcacgcgtcaccacgcctggctaattttgtatttttagtagagatggggttcctccacgttggtcaggctggtctcgaactcctgacctcaggtgatccacccgccttggcctcccaatctgctgggattacaggcgtgagccaccgtgcccggccacaaagatgcctcttatatcccacatccctaccccatctaactttgcctgcctgacatcctttctgggatggctcccaagcacttcagattgaatgaaaacacctagcaacatggagcttcacgtctcttctctcctgtttgttcaacagtgttctctatctcactacatggaagtctaccatctacctggtcatttaagcccaagcctgggagtctttgtgtttggccaagctcatagggggatcttgggcaggcctgccaagaatcctctggacttttttaggatgaacaaatcaagccaagtgctgtggcacgtgcccatgatcccaggctcttgggaagctgaggtgggaagatcgcttgagtccatgagttcgaggctgcaataagctaattgcaccactgcactccagcctaggtgacagagtgagaccccctctcttaaaaaaataaaataaaaggccaggcatggtggcttacacctataatcccagcactttgggagtccaaggctagagaatcgcttgagcccaggagttcgggaccagcctgggcaacatggcaagacgttgtttctgcaaaatatacaaaaattagccgggcgtggtggtgcacacctgtagtcccagctatccaggatggctcaagcccgggtggttgaggctgcagtgagccatgaccatgccactgcactcaagtctgggcaggaccctgtctcaaaaataaatacaaaggatgaacaaattatgagagtaaaaaagggttagtctcctttatccttgctacacctcctcacccaaagccaagcagtagtgtagcaggataagccgcagacaaaaccccccagacacccagttaaagaaggaagggctttattcagctgggagctttggcaagattcacgtctccaaaaactgagctccccgagtgagcagttcctgtcccttttaagggcttacaactctaagggggtctgcatgaagaggtcgtgattgattgagcaagcaggggatatgtgactgggggctgcatgcactggttatcagaacggaacagaacaggacagggattttcacagtgcttttccatacgatgtctggaatctatagataacataaccggttaggtcaggggtcgatctttaaccagacacaggtcgcggcgccaggctgtctgcctgtggatttcatttctgccttttagtttttacttctttggaggcagaaattgggcataagacaatatgaggggtggtctcctcccttagtagtaaagcactataaatatttgtggatttacaaccatttcattcagtcttgatgacagccctgagaagtagtcattgcatccccttttatagatgaggatacagttcagagaggttaaggcaactggccagccacaagctctggaaggtgaacccagttccctctaatcccaaagaatgtgcactttttagtgtgggacaaggggtctcaaaagacaggtgggaggattctcagccctgggagaataaaagttgggtgaagttcagaactgccacctcatcagtcagaactgggccagtgacaacctgcagaagctcagcctgcaaaggcttatcaggattctagacctttggttactttcccatctttagtatttagttctccttccccaggataatcagcagaaaagtgcctggccttgtgtccatataccatggaggggagagctagagaggcgaggttctcgggaaccactagaaggaaggaatgagggggctgctggttaggcccagagctgagaccgagaagggctcttggagttctccttcccttcgtaacattaggtagaggcttagacaacttgattgtttttcatgaccttaaagactgtggctccggccgggcatggtggctcacagctgttgtaatcccagcactttgggaggctgaggcgggtagatcgcttgagcccaggagttctagaccagcctgggcaacttggcaaaaccctgtctctacaaaatatataaaaattagctggacactgtgatgcgcacttgtagtcccagctattctagaggctgaggtgggaggatcacctgagctcaagaggtcaaacctgcaatgagccgtgattgtgccactgcacttgagcctgggcaacagagagtgagatgctgtctcaaaaaaacaaacaaacaaacaaacaaaaacaagtacttgatgactccattggggtcaattatgaagagacctcttagtgcaagaccaggaccttctaacagcacaccgaagtctcgagaaattcgcttagttaaatctgacaagggtgcgatgtttatgtggcccaaagcaccattctttcttggtgtatttatccaggcaagacggctaaagtgggaatccactgagactgcaacaacttcaaagttcacatcgtgaaattccttagctttgtcactagaagcaacaatttctgtaggacacacaaaggtgaaatccaaaggatagggctgggcgcggtggctcacacctgtaatcccagcactttgggaggctgaggtgggtggatcacctgagttcaggagttcaagaccagcctcaccaacatggtgaaatcccatctctactaaaaatacaaaaattagccaggcgtcgtggcaggcgcctgtaattccaggtactcaggaggctgaggcaggagaattggcttgaacccaggagggggaggttgcagtgagccgagatcgtgccactgcactccagcctgggtgacacagcaagactccgtctcggaaaaaaaaaaaaaaagaaagaaatccaaaggatagaagaaaagcaccaaatatttcccctcaaagtcatcaaggcttaggtctttgaactctccattgaccacggctgtacccttaaaatagggcgcatgctgggtgacatcaggtgcatggtatgaggaactggtaccagaattttgcttgaccggaaccagaccacaatatgtttgtcaaacttgttcttccagaagcagcaggcctgagggctgcagtggcagaaatgcccccaaggaatggcactcacatgccgggcaactgatgctcagagtaaccttcccacagcagccgcgatcttcagtgcatgtgtgtttttgtttttttgagacagtgtctgtctctttcgcccaggctaaagtacagtggcacaatctcagctcaatttagcctcagcctcccaggctcacgccatcctcccacctcagcctcctgagtagccaggacttcaggcgtgcaccaccatgcccggctaatttttgtaattttttggatagaaatggggtttcgccatgttgcccacgctggtcttgaactcctgggctcaagcgatcctcctgcctcgacttcccaaagtgctaggattacaggtgtggtggcaccttgtctctaaaaaaaatcaatcaattaaataagaaaagaaaatagctcttctccccctctgattataacaacacattaccaaagttactggtgcttacatggggttgaatggagttatgatggatatttcatttaatgttgttcttcaatgttttaattttttacaacagacttaaaaattttttaaatacatgtggccaggcacgatggctcacgcctgtaatcccgcactttgggaggccaaggtgggtggatcatctgaggtcaggagttcaagaccagcgggaccaacatggagaaaccccatctctactaaaaatacaaaataagccgggcgtggtggcacatgcctgtaatcctagctactccagaggctgaggcaggagaatcacttgaacctgggaggtagaggttgtggtgagccgagattgcgccatggcactccagcctgggcaataagaacaaaactctgcttcaaaaaaaaaaaaaaaaaaacatgtaatcggctgtacgcagtggctcacgcctgtaatcccaggacttcgggaggctgaggcaggtggattacttgagattaggagtttgggaccagcctggccaacatggtgaaaccccgtctctactaaaaatacaaaatttgggctgggcacagtggctcacgcctataattccagcactttgggaggccaaggcggggtggatcactgagatcaggagttcgagaccagcctggccaaactggtgaaacctcgtctctactaaaaatacaaaaattagctgggtgtggtggtgggtgcctgtaatcccagctactcgagaggctgaggcaggagaatcacttgaacccaggaggcagaggttgcatgagccgagatcgcaccattgcactctagcctgggtgacagaacgagactccatttcaaaaaaacaaaaacaaaacaaaacttagcagggcatggtgatgcacacctgtaatctcagctactcggaaggctgaggcacaagaattgcttcaacccgggaggtggaggttgcagtgagctgagatcatgcctgtgcgctccagcctggcgacagagtgagactccgtctcaaaaaacagaaaaatacatgtaatgctccttgttaaacatcttagataatataggaagataaaacgaaacaagtaatgattatctataataccattttccgaggttaccattgttaatatgggatatattttcttccccacatttttctcacatattttttgtgtatgcattttttttccaaaaaaaaaaaaaatggatgataggctgtttttcttccttttttttttttttttttttggttggggggtggagtttcactactctttctcccaggctggagtgctgagtgcaatggcatgatcttggctcaccgcaacctccacctcctaggttcaagcaattctcctgcctcagcctcccaagtagctgggattacagtcgcacaccaccatgcctggctaatttttgtatttttttttttttttttggtggcgacggggtttcaccatgttggccaggctggtctcgaactcctgacctcaagtgatccacccaccttggcctccgaaagtgccaaagtactgggattacaggcgtgagccaccgcgcccaggctttttttttttttttttttttgagacagtctggctctgttgcccaggctggagtgcagtggctcgatcttggctcaccacaacctccacctcgcgggttcaagcgattctcctgcctcagcctcctgagtagctgggattacaggtgcccatcactgtgcctggctaatttttgtatttttagtagagacggggttttgccatgttggccaggctggtttggaactcctgatctcaggtaatccgcccgccccggcctcccacagtgttgggattacagatgtgagccaccacacctggccgtctgtttttcattctgcttgttttacttggcaatggggaacatctttctattcaatagattgatctctgaaaacatcacttttgatggcttcatactgttctatcatgaatataccacatatttagttcactactattgaacattcgggttctgtttttgttgtttttaaaatgttatgaaggatacagtagagaatatttgtgtaattaatctgtgggtgcatccattattctgttcttgggatacattttgagaagtggaattgttgggcaattcctcttaacgtatttctagagtgtttgataaatattgtctgattggcccaggaaaatgtttgccatttctcatatgtagtatttgactgactttcaggacaggaagatgtcacccaagcgcatagctaaaagaaggtcccccccagcagatgccatccccaaaagcaagaaggtgaagggtaagttggccttggcctctttgtgggtacaggtggccccttgaaaccctaagaacccgggactgggctcctttcttcctgaggcttgaagctgaagggtgtggatgtgcagagaccccacccagctggaaggtttcctgtagctcattgaatcctaccctctgggaatcacaaagtgggcagaaactcctctcaaagcactcaggcagcactggcacaaaaaaaaaaaaaaaaaaactagaccctagggcttcaccccaggcagtgatgcattatggttaggaccactgactttccgacatgggttcaagtccttgctctgccactttctagctgctgggcaagtcacttaatcccgcagtttggattatcaacttcttaaaatggcggcagccagagcagcgtcaccctctctgggctgtgtgaggatgagatgagataatggcctggcagcatttgagggaggtggctgtggtttcctctgtcctgggaccccggagggggacagggaggagagaaaagccagcaccaaactgggaggggaagtgtggacccacgctcagacagtgtctgtcttttgcagacacgagggccgctgcctcccgccgcgttcctggcgcccgctcctgccaaggtgcctgcgggccgagccctcctgaccagaaaacccgaccaggtggctccgcgcccggggcgccctctgtgctgccagcgcgggctcctcagcggtggccacatcctcgggggaggggctgggcgccattggctgcccggggctgcgggttggggggccgcctttggcccacagagagccccgggcgcgcacctcccgcaaatgccgctgtccgctcttcctcccgcccctcctgcctctccactggatggtggagggaagagtccgtttctgcagtggatttgcccgggagctgaacttattcactggcggacggcttgggcatggaggagggcttggatggagactggggattgttctctgacccacgtagtctcccttgctttcggtgcagattctgctattataattagctttctgcggggcaaggtggctcacgcctgtcagaagatcgagaccatcctggctaacacggtgaaaccccgtctctactaaaatacaaaaaattagccttgcgcggtggcgcgcgcctgtagtcccagctactcaggaggctgaggcagaggaatcgcttgaacccgggaggcagaggttgcaattagccaagatccaccactgcactccagactggcgacaaagggagactccgtctcaaaataacaataacaataattagctttcttttctttttctttttttttttttttttgagatcaagtatcactctgtcgcccagactggaggcggcagtggcacgatcttggctcactgccacctccgcctcccaggttcaagtgattctcctgcctcagcctcctgagtagctgagattacaggctactgttggcaaggctggtctcttaactcctgacctcaagtgatccgcccgccttggcctcccacagtgctaggattacaggtgtgagccaccgcacccagcccttcttgccctctccaccaagattcatttcacagtatccagtgtctccttgtttccctttctcccctttcacgtgaataatgtgctcagttcttaatctccacaaaaatcctgtgagagaggtacttttgttgtccccatttcacagatgacaaaacttagaaagttcatactaacagtctgtggcagagcaggggcttctgcacaggtttgtctgatcccagagcctgtgacctctcctcgctgtcgtcatcctctacactcagggtctatcttcttcacccttcagtctcacacaggtcccacagcacagaacccggcttggtgctgacactaggccagggcgacgtgggccagctggggctgggtgagaatgtgatggagaggaagaagccggccctggtatccattccggaggatgttgtgcaggctgaggctgggggcatgcacaccgtgtgtctaagcaaaagtggccaggtaggtgttggggactggcacagggttggacaaggcctggggttgggtggcttggggcagggcttttgaaccacgcatgttcactgtggaaatggagctggctagtcaagtggggagtggcctacatgagaatggactgcgaggccagacgttgcattaatgagggcatcctgggcacaggtctattccttcggctgcaatgatgagggtgccctgggaagggacacatcagtggagggctcggagatggtccctgggaaagtggagctgcaagagaaggtggtacaggtgtcagcaggagacagtcacacagcagccctcaccgatgatggccgtgtcttcctctggggctccttccgggtaaggctgggtctgaaagtctgcatggtccctgaaagacagaattaattggcggggccccaaagataatccacttccatgcccccatggtacttactggtggggagatgaaagcccacaggtagagctgaggcccagacccaggactctagcttcctcatgtgggcctgtccacgccactggctgcttccttgaatccgatgtcatcaagtgtctgtcctgggaagtgagtgggtcaaggatgtccctgggttgaggctgatccaggaggcctgctgtcttcacccatctccctgacttctgtctccccctcaccttgccagcactgcctcttccacacttcccagaggcttggatggggcaaggaggtgtggaggcagggattgtcgcatctcagagtttccaaggtacagaggagtgtagttgaaaaaacagattgtgggtttttgttgttgttgttgttgttgtttttgtattgttttgagatggagtttcactcttgttgcccaggctggagtgcaatagcgcaatcttggctcactgcaacctctgcctcccaagtttaagtgattctcctgcctcagcctcccaagtagctgggattacaggcatgcgccaccacgcctggctaattttgtatttttagtagagacggggtttcccctgttggtcaggctggtctcgaactcccgaccccaggtgatccacccgcctcagcctcccaaagtgctaggattacaggcgtgggccaccacacccggcctgatgggtgtttccttatcacatctattttgaaattttcatggagaatttcaaacacatgaaagtaatcagaattgggctgggcgcggtggctcatgcctgtaatcccagcactttgggatgccaagatgggcagatcacgacgtcaggagatcgagaccatactggctaacatggtgaaaccccgtctctactaaaaatacaaaaaattagccaagcgtggtggcgggtgcctgtagtcccagctactcgggaggctgaggcaggagaatggcttgaacccgggaggcggagcttgcagtgagccaagatcgcgccactgcactccagcctaggggacagagcgagactccatctcaaaaaaaaaaaaagaagtccgggcgcagtagctcatgcttgtaatcccagcactttgggaggccgaagcaggctgatcacctgaggggtcgggagttcgagaccggcctgaccaacatggagaaaccctgtctctattaaaattacaaaattagctggacatggtggtgcatgcctgtaatcccagctactcgggaggctgaggcaggagaattgtttgaacctgggaggcggaggttgcagtgagccgagatcgcgccattgcactccagcctgggcaacaagagcgaaactctgtctcaaaaaaaaaaaaaaaaaaaaaaaaaggaagtaatcagaatatcagaattatatttttttcttttcttttcttttcttttttttttttttttttttttttttttttttttttttttttttttttttgagacagagtcttgctctatcacccaggttggagtgcaatgacacaatctcggctcagtgcaacctctgcctctcgggctcaagcaattctccttcctcagcctcccgagtagctgggattacaggcatgcgccaccacacctggttaatttttgtatttttagtagagacggggtttcaccatgttggccaggctggttgtgaatttctgatctcaggtgatccgcccgtctgggcctcccagagtgctggattgcaggcttgagccgccacgtctggcctcttttcttttttctttgttttgagacggagtctcgctttgtcgcccaggctggagtgcagtggcgcgatctcggctcactgcaagctctgcctccctgattcacgccattctcctgcctctgtctcccgagtagctgggactacaggcgcccgctacaacgcccggctaattttttgtattttttggtagagacggcatttcaccgtgttagccggaatggtctcgatctcctgacctcgtgatcgcccgccttggcctcccaaagtgctgggattacaggcatgagccaccgcgcccggcctcttttcttttttaattagagacgagatcctgctctgtcacccaggccagagtgcaatggcatcgtcttagctcattacagcctcaacttcctgggctcaggtgatttcttccacctcagcctcgcaagtagctggtactagaggcttgtgccaccacgcccagctaatttttgtattttttgtagggacggggtttcaccgtgttgcccaagctggtcctgagctcaagcgatctgcccacctgggcctaccaaagtgctaggattactggcatgaattaccatgcctggcccagaatagtatattgagtgcccatttacttgccacacagtttcaatgattatcagcttgtggccagacttgtttatctctatttgcatccgctctctgactccttgattattttaatgcaagtcgcagaccataaatgatttcattcataagtatttgagtatgtggcctggctcctgcccacttctccatccccatctggtgccactgcccttctggatttcactggcacggggcaggcaggactggctgataagtgccctgtccctcccttctaggacaataacggtgtgattggactgttggagcccatgaagaagagcatggtgcctgtgcaggtgcagctggatgtgcctgtggtaaaggtggcctcaggtgggtctgggggcacttgctcagggcaggagttggaggaccttgttctggggctggcctagccttgggccttacagttgtggcctgcatcccttaccttttcatccttaggaaacgaccacttggtgatgctgacagctgatggtgacctctacaccttgggctgcggggaacagggccagctaggccgtgtgcctgagttatttgccaaccgtggtggccggcaaggcctcggtaagtggccttggtacctccagcagggcaaattggcaggccacccccacagtgaaggccaaaggcaggaaggatttgctgtggtcaggcttgcatcagatgggcttgtggtgttggttaggactttggagacagactgctctggtagttttgccacctactgtctatgggactctgaacatagtttcttcatcactaagtctacctacctgtaaacctacttcattaggttgctgtgaagttaaatgagttaatgagaagaatatcaggcagatggtaagttccacgtaaatgatacccgtaatgactgtgggaatctgagcaaggcacttgtattctcttgatctcagtttccttttctataaaatagggataagagtccctacttagcctctcaagggcttttataatggaggagaattaaactcggggcagagagaagccatgtgtgtctgtctgtcactgaccgtggctttccctttgcctgcagaacgactcctggtccccaagtgtgtgatgctgaaatccaggggaagccggggccacgtgagattccaggatgccttttgtggtgcctatttcacctttgccatctcccatgagggccacgtgtacggcttcggcctctccaactaccatcagcttggtgagccccgagcccagcttcaggcatgacccagtggcctgcgttcctgtcctggctctgccactcattcattgtgcatcctttgcggggtcgtctaacccctccaagccagttttgtcatctgtaaagtgagaatgtccatatcctgatgggaggtggcctcactgtgggaggagattgagaagggcagctctcagaacaccttcacccctgatggctccggcctttcccccaggaactccgggcacagaatcttgcttcataccccagaacctaacatccttcaagaattccaccaagtcctgggtgggcttctctggtggccagcaccatacagtctgcatggattcggaaggtagggcctttacgtccttctctagtttgggggtggagtgttccctggcctaggcctagccagattcctgagaccatggtccttggagcctgggtctgttccatgggttgtaccatacatgggtccatgagagtcactctcatcctcctagagtcctggtgttcttccaagtgtgagttcaatgggggcccatgtagattctcctaggcctcctccaaaactgggaagagacactgcagatctccttctgatcgctctgggagcagggacacactcccatggacaggtggactcacctagcctgccacccattttgcctgtagcacgccctctgctattgctcatctctctccctcctcccataggaaaagcatacagcctgggccgggctgagtatgggcggctgggccttggagagggtgctgaggagaagagcatacccaccctcatctccaggctgcctgctgtctcctcggtggcttgtggggcctctgtggggtatgctgtgaccaaggatggtgagtggggctgcctacactctgtctagttgggacctgggggtcatggttcttacccaattccccaataggctgtgatgtccactctcgggggagccgaggtacagagagcagtgtttgtgatggcactttgttcctgcttctcagaagctctggcattgatgaatatgaaatgagtacacaaattattttagtaaaggtgacttattatgcagaggagagaaatagcaaagagtgagatatcactgaggcctaaggaggcaatgggactggaacccaagtctccagactcctaacccaggctgctctctcccctcagggtgaccccttcatatatcaccttgtatgttcccgctttccagggacttttacttagaatctaaatcaagaaaaaaaaaggcttagtagtcagagttgtagcaactatagcagaggagggtgtgaacaagtgaccaccaaagcctgagtgggtgagggggatagccatggaggtcctgtagaagcctggagctggcagaggtgcttgacctgaggttatctgggaagacttcctcaggaagtggggcttgcactgtaccttgaaggttccattccttgtgaaaagcaaagaatgccattccaggcagaggaacatcagggcagtctcaaaggtggctggtcctgggaacagagggtggggtaggaccttgaatgccacgcctaggagcagcctttggcagtgtgtagggactgtgctctctggtttacagagttcttttttatccatcatctccttgggttctcccaacttccctgaactcccagagtctggtaccttgccaagctgctattggccaaggccacagtccacgcccatgtcccaggtttctcctgctacagaaaggtgggctggggatcctggagacagctgtacccatttctctctcttgcaggtcgtgttttcgcctggggcatgggcaccaactaccagctgggcacagggcaggatgaggacgcctggagccctgtggagatgatgggcaaacagctggagaaccgtgtggtcttatctgtgtccagcgggggccagcatacagtcttattagtcaaggacaaagaacagagctgatgaagcctctgagggcctggcttctgtcctgcacaacctccctcacagaacagggaagcagtgacagctgcagatggcagcgggcctctccccagccctgagcactgtgtcagttcctgccttttctcatcagcagaacagaatccttttcctcttttccttcctcctctttggaattttcctgggacctacagaataaagggggggatggacagggggttttcaaaaggaacatggctcactcagagctatatggttagacgtttctccccttttccctaccttccatggtcctggttggccctggctttgcctactagaaaaccaaaacttcccccctggggttttgtgcccactctctgagaagttggggctccatcaagccccattctagtcatgtgcccctttcctgtccctaacagtccacaggcaaacaaatggtacagtcataagagccatctgtcacggacccacgcccagaggaacgtgcagaaaaaagcagagctacatggctgtgggcaactataagccaaatatttggctcagaacaggtgtccatgggacaaaaaagaacgatcctccacttgaccaagaaaaaagtgattctcccagaagcacaaagcatactcttgcccctcaggtgttgcttgtgtacatcgtacccatccattcggcttcacctgcagccaacggcctggaatcgcaaagagacaccactctgggcagagcagagcagggtatggggtggggagagagggtggagggttttataaacaaacttaacagcaatattgaaaggaggtgggggattgagggagggacagagtgttggagggccagagactagtcctgagatggaaacagcaacttgtacagtggctgagaaaataggatatagttttgatttttttaattgtaaaatattttggagggagaacaaaatcttttaacattttgaataaatttagagttttataaaataggccacttgttttctacacattccctgctttttaagggagcacatattatgtgccaggcactgctgggaaagacagaataaactataaacctggtgttgaggctacaacttaagtgatgtcaagatgtcctgaggtgccaaccagctgtcagtgtgactgtaacaaaggcttcaaatctgtcaagaagtaaggaaaagttttgtttg

SEQ ID NO: 193 - DNA, 33254 bp, Homo sapiens; identical to SEQ ID NO: 192

SEQ ID NO: 194 - DNA, 33254 bp, Homo sapiens; identical to SEQ ID NO: 192

SEQ ID NO: 195 - DNA, 20964 bp, Homo sapiens
tgcagagcgcatgctctggggcagttcgcggcccggcggggagcgccggagttccttgtggccgacgtgcaccaaggtaggtctcgcctgggacgcgcggagggtccgggcagagggcggtaagcggagcggccacagccggagcacgggccggtccacgcgggcctaagtcgctgcccgctctcgcccgtgtcgcgcggcgccggccccacgtgaagcccggaggcaggaaggcgcggtgcgggctcgcgattccccggccccgcggggcgctccagcagcggctgggcgctgcctcgctggagctagggccgcgcggcccctccgccgccgcgcctctcacgcccgcaccgcggcgcccgcgcaggcgggagattcaaactgcgcgagcgcggcgggccgggtgcgcgcggccgcccgggcgggggatgggtctctgccgcgaggaggatggttttgtccggcatgcgcttggagaaggcggtttgcagatcggggagggagccctgcccgggagagggtgggtcgtaggagctcgagggtctcccgctgtggacctttgggagccgtgtgtcttgaactccgcagcagctcagtctgtcagcagattatttgctggccatttattgcgtccctctcttgcggggctgggggacagtagtgagaagagcaggcccgtgtcattagcgaactatgcccttgaacccaggcgacggacgctactggcaagtcattcatacgtcacatattgacctaacttcgaccacgtgtgacttgtgtgccctagcagaagttgagtgtgtggggtgttacggggagccctcagggggatcccccaccctgcccaggaggctcagggatggctttccaggtgaagtgactcttgaatggggttttgaaggaacagagtttttcaggcagtctgagggtagtgggattagggtgatacaggcagagggattgcacgtgcaacggcatgaaggtataggtattgtggtcagggataccacaggtcttgaggtgactggaggaggagagtaacaagatgatacagcaggggctgggtcacgaagcgtcttgtgtgcaagactaaggaactctgcggggtggaggaggcagggaagatttcccccaagaagggtatcagagtgaaacctggacagatgaattaggagttcacgaggctcctgtttcaaagacatcccaagagcaggaatcctgttctgttcatcgttacaactttctcatcagatgcccttgggcaacccacccagtcccccagagcattggtttccttatctgtaaagcaatggtagggggcatgtggtgaggatataatttttttttttttgagacggagtttccactcttattacccaggctggagtgcagtggcgcgatctcagctcactgcaacctccacctcctaggttcaagcaattctgcctcagcctgctgagcagctgagactacaggaacacaccaccaggcccagctaatttttgtatttttttttttttagtagagacggggtttcaccatgttggccaggctggtcttgaactcctgacctcaggtgatccacctgcctcagcctcccaaagtgctggaattacaggtgtgagccaccgcacccggccaattttttttttttttctgatacagaatcttggtctatcgcccaggctgtagtatagtgtcgtgctctcagtcgctgcagcctccacctcccgggttcaagcgattctcctgtctcagcctcccgaatagtaatatcctataattttcataaagcagtgaagttgtgtgtcccttcccccaggaaaaatgaacacataggcccaggcacaggttgtatagaacggggatcccaggtgagaaactcctagtgtgaaatataccacctgtgtgcctggcataacagcagctcaccaaatgtatattgttgacacatgagccctctcctcccttccctcctggggaccttacacacagagatttttcagccttagtctggcaggcaagttcttcctcctggtgtgggggacggagggcacagctgcagtggcctgggagggctctgtctccttttacagaaatcgaggctgtggtgaggtcactggaggtcagggcaggagcaccaggctccgggcagactgtctagactggcgtgcctacccactttcttcaataaataaggaaggtgaggtgggggtagggcagctccagctctggtggagcatggtcatgagactgggatttcattccacctctctgtgacctgggtcacctttccctgagcctcatcttccccttagctgtaaaactgggatgagtctgctcacctcaaagggcagctgtgggcattcaggagtgcctgatggtggaagctgactctgtagccgacttatctgtgactgtctcactcttctcccagagactgtatgctccttgaagatggaagctgtgttgtgtggggcggggtggggaagcatgatgccaaaagccaactccttattcccagcccagacactcactgcctggttaagaaaacagccagagaggccgggctcggtggctcacgactgtaaccccagcaatttgggaggccaaggtgggcagatcacctgaggtcaggagttcaagaccagcctggccgacatggtgaaaccccgtctttactaaaaataccaagcagttagccaggcgtggtggcttgcgcctgtagtcccagcactagggaggctgaggcgggagaatcgcttgaacctgggaggcggaggttgcagtgagctgagatcgtgagtctgaactccagcttgggcaacagagtgaggctccatctcaaaaagaagaaaagaaaagcaaataaaggaaaacacacccagagcagtgagagaagtctgtatacaagacccatttgtgcagtagaggctgtgcaggcaggtaccgggaacagggctccaccttttagaaggtggtcctctggccgggagcagtggctcacgcctgtaatcccagcactttgggaggccgaggtgggtggatcatgaggtcaggagatcgagaccatcctggctaacacggtgaaaccccgtctctactaaaaatacaaaaaattagctgggtgtggtggcaggcgcctgtagtcccagctactcgggaggctgaggcaggagaatggcgtgaacctgggaggcggagcttgcagtgagccgatatcgcgccattgcctccagactgggcgacagagcgagactccacctcagaaaaaaaaaaaaaaaaaaaaaagaaggtggccctccatcccctgcccttccctggcgattgccagcccagtgcagggcctcaagtcttccattttggagaggaagcctctgggactcaaagagcactcaggtgccgtctccaccgcagcagggagttgtcgccactgtccttccccacatctgtgggtggatctgtcaccacccaccccaccttccctcaggctctagctgcctcattgtctcctctctggtctcaccatcctctcctcagctggcttctgctctctgcttcttggacttggccaagtgcataggggatactggggaggcctgcccagactgccttagcccctgcctggaccaaggtctgccttcagaatcagtcagataggcctgggttgcttttctaggctgccctttacttgctctgtgaacttaggccgataaagttatctttctgagcctcagttccttaactgtgaaataggagtgacagtgctgccttcttcagcttcctgtgaggaataaaagggttttgcatatggaagatacagtgagttagccggtgcccccaggggctcatattttaggaagttgattggtatggtggacaggcatgtaaattaaagtgattgtgatccaaaagtctgtcccagtttctcagagagaatgactagttcaggatggaggagggatcagaggaggtgactttgagacaccagtagatgttcttccagtgggataagggatgggaaggcgttccaggtaaagagatgcaaatagtatggagaggacagttagcattctggcctggtgggtctggcaaggagattgtgtgggaagagaagggaggatgtgatagataggaaatgaagctaaaggttctgtcagtacccgatgttggagacctctaatacccagctaagaaatgtgggctttatcttccaggaaaaggggaccactaaggagtccaagcaggccagcagcttgcttcaggtttgaggtttggaaagatcatgaatgaggccgggcatggtacctcacgcctataatcccagtactttgggaggtcgaggtgggaggatcacttgagcccgggagtttgagaccagcctgggcaacatagtgagaccttgtctctacaagaaaaaaaaaaattacaaattagccaagcgtggtggtacatgcctgtagtcccagctactctggaggctgaggcaggagggtcgcttgagcctaggaggtggaggttgcagtgagccgtgtacgtgctgctgcactacagcctgggcaacagagtgaaaccctgtctcaaaaaaaaataaatatatatatgtatatatatacacacacacatatttattgatcacgaatgacttggagaatgagaggaggggatgagggtggggaccggaagaccagtgaaaagttgctgtctttcctagggaaaggaggaggagacacagttccaggcaagctgagagactactagggagcatggggaggaaggaggcagaagaaatttcttttttttttttttttttttttgagacggagtcttgctctgtcacccaggctggagtgcagtggcgtgatctcgactcactgcaagctctgcctcccgggttcacgccattttcctgcctcagcctcccgagtagctaggactacaagcgcccgccaccacgcctgtctaattttttgtatttttagtagagacggggtttcaccgtggtctcgatctcctgacctcatgatccgcccgcctcggcctcccaaagtgctgggattacaggcgtgagccaccgcgcccggccagaagaaatttctaataacactcaaggacgccagctctggagtctgactaacttggttcagatcttggccttctcttccaatcttgagtgagatacttcacctttctgagcctcagttttcttctctgtagagtgggatcattgtggccagcttgtagtgaaacgctccagaatattagccaaacacaactaaggagatgttgactgggtttgttccatccatgataacagattttttggttaatgccccatgacaccaacacttcatatagcccttatgtgtctgactccattccgggctgtgctcatggcagcccagccatcagcaccaactgtgctgacataattgtttcctgctttttctcctgacttcttattgtgagtacttttcatgctaatacagtctccctcccaggcacagcagactgctacagattattctgatgaactgatgagatgtttgccttggcatacagctgtctatctaaaacaagggtgcctctttttttggtggagggacagagtttcactcttgttgcccaggctggagtgcaatggtgcaaactcggcttaccacaacctccacttcctgggttcaagcgattctcctgcctcagcctcccgagtagctgggattacagcacgcgtcaccacgcctggctaattttgtatttttagtagagatggggttcctccacgttggtcaggctggtctcgaactcctgacctcaggtgatccacccgccttggcctcccaatctgctgggattacaggcgtgagccaccgtgcccggccacaaagatgcctcttatatcccacatccctaccccatctaactttgcctgcctgacatcctttctgggatggctcccaagcacttcagattgaatgaaaacacctagcaacatggagcttcacgtctcttctctcctgtttgttcaacagtgttctctatctcactacatggaagtctaccatctacctggtcatttaagcccaagcctgggagtctttgtgtttggccaagctcatagggggatcttgggcaggcctgccaagaatcctctggacttttttaggatgaacaaatcaagccaagtgctgtggcacgtgcccatgatcccaggctcttgggaagctgaggtgggaagatcgcttgagtccatgagttcgaggctgcaataagctaattgcaccactgcactccagcctaggtgacagagtgagaccccctctcttaaaaaaataaaataaaaggccaggcatggtggcttacacctataatcccagcactttgggagtccaaggctagagaatcgcttgagcccaggagttcgggaccagcctgggcaacatggcaagacgttgtttctgcaaaatatacaaaaattagccgggcgtggtggtgcacacctgtagtcccagctatccaggatggctcaagcccgggtggttgaggctgcagtgagccatgaccatgccactgcactcaagtctgggcaggaccctgtctcaaaaataaatacaaaggatgaacaaattatgagagtaaaaaagggttagtctcctttatccttgctacacctcctcacccaaagccaagcagtagtgtagcaggataagccgcagacaaaaccccccagacacccagttaaagaaggaagggctttattcagctgggagctttggcaagattcacgtctccaaaaactgagctccccgagtgagcagttcctgtcccttttaagggcttacaactctaagggggtctgcatgaagaggtcgtgattgattgagcaagcaggggatatgtgactgggggctgcatgcactggttatcagaacggaacagaacaggacagggattttcacagtgcttttccatacgatgtctggaatctatagataacataaccggttaggtcaggggtcgatctttaaccagacacaggtcgcggcgccaggctgtctgcctgtggatttcatttctgccttttagtttttacttctttggaggcagaaattgggcataagacaatatgaggggtggtctcctcccttagtagtaaagcactataaatatttgtggatttacaaccatttcattcagtcttgatgacagccctgagaagtagtcattgcatccccttttatagatgaggatacagttcagagaggttaaggcaactggccagccacaagctctggaaggtgaacccagttccctctaatcccaaagaatgtgcactttttagtgtgggacaaggggtctcaaaagacaggtgggaggattctcagccctgggagaataaaagttgggtgaagttcagaactgccacctcatcagtcagaactgggccagtgacaacctgcagaagctcagcctgcaaaggcttatcaggattctagacctttggttactttcccatctttagtatttagttctccttccccaggataatcagcagaaaagtgcctggccttgtgtccatataccatggaggggagagctagagaggcgaggttctcgggaaccactagaaggaaggaatgagggggctgctggttaggcccagagctgagaccgagaagggctcttggagttctccttcccttcgtaacattaggtagaggcttagacaacttgattgtttttcatgaccttaaagactgtggctccggccgggcatggtggctcacagctgttgtaatcccagcactttgggaggctgaggcgggtagatcgcttgagcccaggagttctagaccagcctgggcaacttggcaaaaccctgtctctacaaaatatataaaaattagctggacactgtgatgcgcacttgtagtcccagctattctagaggctgaggtgggaggatcacctgagctcaagaggtcaaacctgcaatgagccgtgattgtgccactgcacttgagcctgggcaacagagagtgagatgctgtctcaaaaaaacaaacaaacaaacaaacaaaaacaagtacttgatgactccattggggtcaattatgaagagacctcttagtgcaagaccaggaccttctaacagcacaccgaagtctcgagaaattcgcttagttaaatctgacaagggtgcgatgtttatgtggcccaaagcaccattctttcttggtgtatttatccaggcaagacggctaaagtgggaatccactgagactgcaacaacttcaaagttcacatcgtgaaattccttagctttgtcactagaagcaacaatttctgtaggacacacaaaggtgaaatccaaaggatagggctgggcgcggtggctcacacctgtaatcccagcactttgggaggctgaggtgggtggatcacctgagttcaggagttcaagaccagcctcaccaacatggtgaaatcccatctctactaaaaatacaaaaattagccaggcgtcgtggcaggcgcctgtaattccaggtactcaggaggctgaggcaggagaattggcttgaacccaggagggggaggttgcagtgagccgagatcgtgccactgcactccagcctgggtgacacagcaagactccgtctcggaaaaaaaaaaaaaaagaaagaaatccaaaggatagaagaaaagcaccaaatatttcccctcaaagtcatcaaggcttaggtctttgaactctccattgaccacggctgtacccttaaaatagggcgcatgctgggtgacatcaggtgcatggtatgaggaactggtaccagaattttgcttgaccggaaccagaccacaatatgtttgtcaaacttgttcttccagaagcagcaggcctgagggctgcagtggcagaaatgcccccaaggaatggcactcacatgccgggcaactgatgctcagagtaaccttcccacagcagccgcgatcttcagtgcatgtgtgtttttgtttttttgagacagtgtctgtctctttcgcccaggctaaagtacagtggcacaatctcagctcaatttagcctcagcctcccaggctcacgccatcctcccacctcagcctcctgagtagccaggacttcaggcgtgcaccaccatgcccggctaatttttgtaattttttggatagaaatggggtttcgccatgttgcccacgctggtcttgaactcctgggctcaagcgatcctcctgcctcgacttcccaaagtgctaggattacaggtgtggtggcaccttgtctctaaaaaaaatcaatcaattaaataagaaaagaaaatagctcttctccccctctgattataacaacacattaccaaagttactggtgcttacatggggttgaatggagttatgatggatatttcatttaatgttgttcttcaatgttttaattttttacaacagacttaaaaattttttaaatacatgtggccaggcacgatggctcacgcctgtaatcccgcactttgggaggccaaggtgggtggatcatctgaggtcaggagttcaagaccagcgggaccaacatggagaaaccccatctctactaaaaatacaaaataagccgggcgtggtggcacatgcctgtaatcctagctactccagaggctgaggcaggagaatcacttgaacctgggaggtagaggttgtggtgagccgagattgcgccatggcactccagcctgggcaataagaacaaaactctgcttcaaaaaaaaaaaaaaaaaaacatgtaatcggctgtacgcagtggctcacgcctgtaatcccaggacttcgggaggctgaggcaggtggattacttgagattaggagtttgggaccagcctggccaacatggtgaaaccccgtctctactaaaaatacaaaatttgggctgggcacagtggctcacgcctataattccagcactttgggaggccaaggcggggtggatcactgagatcaggagttcgagaccagcctggccaaactggtgaaacctcgtctctactaaaaatacaaaaattagctgggtgtggtggtgggtgcctgtaatcccagctactcgagaggctgaggcaggagaatcacttgaacccaggaggcagaggttgcatgagccgagatcgcaccattgcactctagcctgggtgacagaacgagactccatttcaaaaaaacaaaaacaaaacaaaacttagcagggcatggtgatgcacacctgtaatctcagctactcggaaggctgaggcacaagaattgcttcaacccgggaggtggaggttgcagtgagctgagatcatgcctgtgcgctccagcctggcgacagagtgagactccgtctcaaaaaacagaaaaatacatgtaatgctccttgttaaacatcttagataatataggaagataaaacgaaacaagtaatgattatctataataccattttccgaggttaccattgttaatatgggatatattttcttccccacatttttctcacatattttttgtgtatgcattttttttccaaaaaaaaaaaaaatggatgataggctgtttttcttccttttttttttttttttttttggttggggggtggagtttcactactctttctcccaggctggagtgctgagtgcaatggcatgatcttggctcaccgcaacctccacctcctaggttcaagcaattctcctgcctcagcctcccaagtagctgggattacagtcgcacaccaccatgcctggctaatttttgtatttttttttttttttttggtggcgacggggtttcaccatgttggccaggctggtctcgaactcctgacctcaagtgatccacccaccttggcctccgaaagtgccaaagtactgggattacaggcgtgagccaccgcgcccaggctttttttttttttttttttttgagacagtctggctctgttgcccaggctggagtgcagtggctcgatcttggctcaccacaacctccacctcgcgggttcaagcgattctcctgcctcagcctcctgagtagctgggattacaggtgcccatcactgtgcctggctaatttttgtatttttagtagagacggggttttgccatgttggccaggctggtttggaactcctgatctcaggtaatccgcccgccccggcctcccacagtgttgggattacagatgtgagccaccacacctggccgtctgtttttcattctgcttgttttacttggcaatggggaacatctttctattcaatagattgatctctgaaaacatcacttttgatggcttcatactgttctatcatgaatataccacatatttagttcactactattgaacattcgggttctgtttttgttgtttttaaaatgttatgaaggatacagtagagaatatttgtgtaattaatctgtgggtgcatccattattctgttcttgggatacattttgagaagtggaattgttgggcaattcctcttaacgtatttctagagtgtttgataaatattgtctgattggcccaggaaaatgtttgccatttctcatatgtagtatttgactgactttcaggacaggaagatgtcacccaagcgcatagctaaaagaaggtcccccccagcagatgccatccccaaaagcaagaaggtgaagggtaagttggccttggcctctttgtgggtacaggtggccccttgaaaccctaagaacccgggactgggctcctttcttcctgaggcttgaagctgaagggtgtggatgtgcagagaccccacccagctggaaggtttcctgtagctcattgaatcctaccctctgggaatcacaaagtgggcagaaactcctctcaaagcactcaggcagcactggcacaaaaaaaaaaaaaaaaaaactagaccctagggcttcaccccaggcagtgatgcattatggttaggaccactgactttccgacatgggttcaagtccttgctctgccactttctagctgctgggcaagtcacttaatcccgcagtttggattatcaacttcttaaaatggcggcagccagagcagcgtcaccctctctgggctgtgtgaggatgagatgagataatggcctggcagcatttgagggaggtggctgtggtttcctctgtcctgggaccccggagggggacagggaggagagaaaagccagcaccaaactgggaggggaagtgtggacccacgctcagacagtgtctgtcttttgcagacacgagggccgctgcctcccgccgcgttcctggcgcccgctcctgccaaggtgcctgcgggccgagccctcctgaccagaaaacccgaccaggtggctccgcgcccggggcgccctctgtgctgccagcgcgggctcctcagcggtggccacatcctcgggggaggggctgggcgccattggctgcccggggctgcgggttggggggccgcctttggcccacagagagccccgggcgcgcacctcccgcaaatgccgctgtccgctcttcctcccgcccctcctgcctctccactggatggtggagggaagagtccgtttctgcagtggatttgcccgggagctgaacttattcactggcggacggcttgggcatggaggagggcttggatggagactggggattgttctctgacccacgtagtctcccttgctttcggtgcagattctgctattataattagctttctgcggggcaaggtggctcacgcctgtcagaagatcgagaccatcctggctaacacggtgaaaccccgtctctactaaaatacaaaaaattagccttgcgcggtggcgcgcgcctgtagtcccagctactcaggaggctgaggcagaggaatcgcttgaacccgggaggcagaggttgcaattagccaagatccaccactgcactccagactggcgacaaagggagactccgtctcaaaataacaataacaataattagctttcttttctttttctttttttttttttttttgagatcaagtatcactctgtcgcccagactggaggcggcagtggcacgatcttggctcactgccacctccgcctcccaggttcaagtgattctcctgcctcagcctcctgagtagctgagattacaggctactgttggcaaggctggtctcttaactcctgacctcaagtgatccgcccgccttggcctcccacagtgctaggattacaggtgtgagccaccgcacccagcccttcttgccctctccaccaagattcatttcacagtatccagtgtctccttgtttccctttctcccctttcacgtgaataatgtgctcagttcttaatctccacaaaaatcctgtgagagaggtacttttgttgtccccatttcacagatgacaaaacttagaaagttcatactaacagtctgtggcagagcaggggcttctgcacaggtttgtctgatcccagagcctgtgacctctcctcgctgtcgtcatcctctacactcagggtctatcttcttcacccttcagtctcacacaggtcccacagcacagaacccggcttggtgctgacactaggccagggcgacgtgggccagctggggctgggtgagaatgtgatggagaggaagaagccggccctggtatccattccggaggatgttgtgcaggctgaggctgggggcatgcacaccgtgtgtctaagcaaaagtggccaggtaggtgttggggactggcacagggttggacaaggcctggggttgggtggcttggggcagggcttttgaaccacgcatgttcactgtggaaatggagctggctagtcaagtggggagtggcctacatgagaatggactgcgaggccagacgttgcattaatgagggcatcctgggcacaggtctattccttcggctgcaatgatgagggtgccctgggaagggacacatcagtggagggctcggagatggtccctgggaaagtggagctgcaagagaaggtggtacaggtgtcagcaggagacagtcacacagcagccctcaccgatgatggccgtgtcttcctctggggctccttccgggtaaggctgggtctgaaagtctgcatggtccctgaaagacagaattaattggcggggccccaaagataatccacttccatgcccccatggtacttactggtggggagatgaaagcccacaggtagagctgaggcccagacccaggactctagcttcctcatgtgggcctgtccacgccactggctgcttccttgaatccgatgtcatcaagtgtctgtcctgggaagtgagtgggtcaaggatgtccctgggttgaggctgatccaggaggcctgctgtcttcacccatctccctgacttctgtctccccctcaccttgccagcactgcctcttccacacttcccagaggcttggatggggcaaggaggtgtggaggcagggattgtcgcatctcagagtttccaaggtacagaggagtgtagttgaaaaaacagattgtgggtttttgttgttgttgttgttgttgtttttgtattgttttgagatggagtttcactcttgttgcccaggctggagtgcaatagcgcaatcttggctcactgcaacctctgcctcccaagtttaagtgattctcctgcctcagcctcccaagtagctgggattacaggcatgcgccaccacgcctggctaattttgtatttttagtagagacggggtttcccctgttggtcaggctggtctcgaactcccgaccccaggtgatccacccgcctcagcctcccaaagtgctaggattacaggcgtgggccaccacacccggcctgatgggtgtttccttatcacatctattttgaaattttcatggagaatttcaaacacatgaaagtaatcagaattgggctgggcgcggtggctcatgcctgtaatcccagcactttgggatgccaagatgggcagatcacgacgtcaggagatcgagaccatactggctaacatggtgaaaccccgtctctactaaaaatacaaaaaattagccaagcgtggtggcgggtgcctgtagtcccagctactcgggaggctgaggcaggagaatggcttgaacccgggaggcggagcttgcagtgagccaagatcgcgccactgcactccagcctaggggacagagcgagactccatctcaaaaaaaaaaaaagaagtccgggcgcagtagctcatgcttgtaatcccagcactttgggaggccgaagcaggctgatcacctgaggggtcgggagttcgagaccggcctgaccaacatggagaaaccctgtctctattaaaattacaaaattagctggacatggtggtgcatgcctgtaatcccagctactcgggaggctgaggcaggagaattgtttgaacctgggaggcggaggttgcagtgagccgagatcgcgccattgcactccagcctgggcaacaagagcgaaactctgtctcaaaaaaaaaaaaaaaaaaaaaaaaaggaagtaatcagaatatcagaattatatttttttcttttcttttcttttcttttttttttttttttttttttttttttttttttttttttttttttttttgagacagagtcttgctctatcacccaggttggagtgcaatgacacaatctcggctcagtgcaacctctgcctctcgggctcaagcaattctccttcctcagcctcccgagtagctgggattacaggcatgcgccaccacacctggttaatttttgtatttttagtagagacggggtttcaccatgttggccaggctggttgtgaatttctgatctcaggtgatccgcccgtctgggcctcccagagtgctggattgcaggcttgagccgccacgtctggcctcttttcttttttctttgttttgagacggagtctcgctttgtcgcccaggctggagtgcagtggcgcgatctcggctcactgcaagctctgcctccctgattcacgccattctcctgcctctgtctcccgagtagctgggactacaggcgcccgctacaacgcccggctaattttttgtattttttggtagagacggcatttcaccgtgttagccggaatggtctcgatctcctgacctcgtgatcgcccgccttggcctcccaaagtgctgggattacaggcatgagccaccgcgcccggcctcttttcttttttaattagagacgagatcctgctctgtcacccaggccagagtgcaatggcatcgtcttagctcattacagcctcaacttcctgggctcaggtgatttcttccacctcagcctcgcaagtagctggtactagaggcttgtgccaccacgcccagctaatttttgtattttttgtagggacggggtttcaccgtgttgcccaagctggtcctgagctcaagcgatctgcccacctgggcctaccaaagtgctaggattactggcatgaattaccatgcctggcccagaatagtatattgagtgcccatttacttgccacacagtttcaatgattatcagcttgtggccagacttgtttatctctatttgcatccgctctctgactccttgattattttaatgcaagtcgcagaccataaatgatttcattcataagtatttgagtatgtggcctggctcctgcccacttctccatccccatctggtgccactgcccttctggatttcactggcacggggcaggcaggactggctgataagtgccctgtccctcccttctaggacaataacggtgtgattggactgttggagcccatgaagaagagcatggtgcctgtgcaggtgcagctggatgtgcctgtggtaaaggtggcctcaggtgggtctgggggcacttgctcagggcaggagttggaggaccttgttctggggctggcctagccttgggccttacagttgtggcctgcatcccttaccttttcatccttaggaaacgaccacttggtgatgctgacagctgatggtgacctctacaccttgggctgcggggaacagggccagctaggccgtgtgcctgagttatttgccaaccgtggtggccggcaaggcctcggtaagtggccttggtacctccagcagggcaaattggcaggccacccccacagtgaaggccaaaggcaggaaggatttgctgtggtcaggcttgcatcagatgggcttgtggtgttggttaggactttggagacagactgctctggtagttttgccacctactgtctatgggactctgaacatagtttcttcatcactaagtctacctacctgtaaacctacttcattaggttgctgtgaagttaaatgagttaatgagaagaatatcaggcagatggtaagttccacgtaaatgatacccgtaatgactgtgggaatctgagcaaggcacttgtattctcttgatctcagtttccttttctataaaatagggataagagtccctacttagcctctcaagggcttttataatggaggagaattaaactcggggcagagagaagccatgtgtgtctgtctgtcactgaccgtggctttccctttgcctgcagaacgactcctggtccccaagtgtgtgatgctgaaatccaggggaagccggggccacgtgagattccaggatgccttttgtggtgcctatttcacctttgccatctcccatgagggccacgtgtacggcttcggcctctccaactaccatcagcttggtgagccccgagcccagcttcaggcatgacccagtggcctgcgttcctgtcctggctctgccactcattcattgtgcatcctttgcggggtcgtctaacccctccaagccagttttgtcatctgtaaagtgagaatgtccatatcctgatgggaggtggcctcactgtgggaggagattgagaagggcagctctcagaacaccttcacccctgatggctccggcctttcccccaggaactccgggcacagaatcttgcttcataccccagaacctaacatccttcaagaattccaccaagtcctgggtgggcttctctggtggccagcaccatacagtctgcatggattcggaaggtagggcctttacgtccttctctagtttgggggtggagtgttccctggcctaggcctagccagattcctgagaccatggtccttggagcctgggtctgttccatgggttgtaccatacatgggtccatgagagtcactctcatcctcctagagtcctggtgttcttccaagtgtgagttcaatgggggcccatgtagattctcctaggcctcctccaaaactgggaagagacactgcagatctccttctgatcgctctgggagcagggacacactcccatggacaggtggactcacctagcctgccacccattttgcctgtagcacgccctctgctattgctcatctctctccctcctcccataggaaaagcatacagcctgggccgggctgagtatgggcggctgggccttggagagggtgctgaggagaagagcatacccaccctcatctccaggctgcctgctgtctcctcggtggcttgtggggcctctgtggggtatgctgtgaccaaggatggtgagtggggctgcctacactctgtctagttgggacctgggggtcatggttcttacccaattccccaataggctgtgatgtccactctcgggggagccgaggtacagagagcagtgtttgtgatggcactttgttcctgcttctcagaagctctggcattgatgaatatgaaatgagtacacaaattattttagtaaaggtgacttattatgcagaggagagaaatagcaaagagtgagatatcactgaggcctaaggaggcaatgggactggaacccaagtctccagactcctaacccaggctgctctctcccctcagggtgaccccttcatatatcaccttgtatgttcccgctttccagggacttttacttagaatctaaatcaagaaaaaaaaaggcttagtagtcagagttgtagcaactatagcagaggagggtgtgaacaagtgaccaccaaagcctgagtgggtgagggggatagccatggaggtcctgtagaagcctggagctggcagaggtgcttgacctgaggttatctgggaagacttcctcaggaagtggggcttgcactgtaccttgaaggttccattccttgtgaaaagcaaagaatgccattccaggcagaggaacatcagggcagtctcaaaggtggctggtcctgggaacagagggtggggtaggaccttgaatgccacgcctaggagcagcctttggcagtgtgtagggactgtgctctctggtttacagagttcttttttatccatcatctccttgggttctcccaacttccctgaactcccagagtctggtaccttgccaagctgctattggccaaggccacagtccacgcccatgtcccaggtttctcctgctacagaaaggtgggctggggatcctggagacagctgtacccatttctctctcttgcaggtcgtgttttcgcctggggcatgggcaccaactaccagctgggcacagggcaggatgaggacgcctggagccctgtggagatgatgggcaaacagctggagaaccgtgtggtcttatctgtgtccagcgggggccagcatacagtcttattagtcaaggacaaagaacagagctgatgaagcctctgagggcctggcttctgtcctgcacaacctccctcacagaacagggaagcagtgacagctgcagatggcagcgggcctctccccagccctgagcactgtgtcagttcctgccttttctcatcagcagaacagaatccttttcctcttttccttcctcctctttggaattttcctgggacctacagaataaagggggggatggacagggggttttcaaaaggaacatggctcactcagagctatatggttagacgtttctccccttttccctaccttccatggtcctggttggccctggctttgcctactagaaaaccaaaacttcccccctggggttttgtgcccactctctgagaagttggggctccatcaagccccattctagtcatgtgcccctttcctgtccctaacagtccacaggcaaacaaatggtacagtcataagagccatctgtcacggacccacgcccagaggaacgtgcagaaaaaagcagagctacatggctgtgggcaactataagccaaatatttggctcagaacaggtgtccatgggacaaaaaagaacgatcctccacttgaccaagaaaaaagtgattctcccagaagcacaaagcatactcttgcccctcaggtgttgcttgtgtacatcgtacccatccattcggcttcacctgcagccaacggcctggaatcgcaaagagacaccactctgggcagagcagagcagggtatggggtggggagagagggtggagggttttataaacaaacttaacagcaatattgaaaggaggtgggggattgagggagggacagagtgttggagggccagagactagtcctgagatggaaacagcaacttgtacagtggctgagaaaataggatatagttttgatttttttaattgtaaaatattttggagggagaacaaaatcttttaacattttgaataaatttagagttttataaaataggccacttgttttctacacattccctgctttttaagggagcacatattatgtgccaggcactgctgggaaagacagaataaactataaacctggtgttgaggctacaacttaagtgatgtcaagatgtcctgaggtgccaaccagctgtcagtgtgactgtaacaaaggcttcaaatctgtcaagaagtaaggaaaagttttgtttg

SEQ ID NO: 196 - DNA, 20964 bp, Homo sapiens; identical to SEQ ID NO: 195

SEQ ID NO: 197 - DNA, 20964 bp, Homo sapiens; identical to SEQ ID NO: 195
